United States Patent 7,750,207 (ZEA MAYS RIBULOSE BISPHOSPHATE CARBOXYLASE ACTIVASE PROMOTER) - sequence listing, part 17

SEQ ID NO: 23597 - DNA, 1207 bp, Zea mays
gtacggtccgaattcccgcatcttctctcctcgtccaaagactccaagcttctgtgacctctgttctgctgccgcctctggtccacatctctctacgccgccgccccgccgtccaccgataccgcagcgctgggaaggatcacgggggagcggagcgaggcgggggacccgcggttttgtcgcccggatggcggcggagcgatgacactggcggcgggtgcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctctggtcgcacaagttcaattcagttccgacgcggcggcgaattcg

SEQ ID NO: 23598 - DNA, 1273 bp, Zea mays
cattgggacctcgagccggcgggacatccaatcatatacctcttccgccgtgtcgtcgcccttcgctagtcgcttcgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatatacatttcaactacatatactgttctatacgagttcattttgtggtgtgtgtgtgtgtcactaatttttactcaattctaaattataagtcattctaacttttttgaagaggtaaagtatctcaggtttgactaaaattgtagaggtaatcacagatttatgacatcaactaggtatattttaaaaatataattaattaaaacactaataatacttatttggtatcatgaatgtgattgttttattatataaatttgatcaaacttgagatgctttggctctcttaagaaaattagaatgtactagtaagtatatttttggcagagttgtagct

SEQ ID NO: 23599 - DNA, 2104 bp, Zea mays
  misc_feature (1900)..(1900): n is a, c, g, or t
cttagtgggttttgtgtgataagtaagatatgctttaggttggagctaaagattgaagttgtgtgagcacctgtgtgatacggtttgactcccttcccacttatcacacattggcaagggtttcatgtaaataaagattaagacacgaaaggttggaggtgtaagatagatttgttcccagcctcgctataaaagagctaacgaaaaacttagagcatttttttccatctcactattctatgatgttatggctcatctatgcttgcgttggttcaatcagggcatgcatggaaaaagaagactcaaatattaatccctgaaaaatccgaaaattagcagagcaatacgtcagtaccaattccaaacaagcaactggtctgccaactaaaatgagcatattcattacaaaatgtacaagctgatgcaaccaagaaaggccaatctcacactgaacaacactccacagttggtacagcatgattcctcagcctttcatatttcatataaatcatttcatgtgcaccagagctactcaaagcaaaagcgagaccactgttgttgcatacttcactgccgtcccacaaaaaaacagatcagttgtttcttcatgtaccaaaatggtgccgagagtgcactagggcagcgtcagtcgtcagtaatcttttcagctgcccatgtcataaagctatcctgtgaaaattcctgcaaacagaggttatgtttagaaagtacgtggagaaatggagagctggtcatttaagtgatggtagttgatggtacccgaaccatacaatttggctgagtcgaaactcatcagtgttgtcaagctcaaggtttgtgttatctgtgggctccaaccgctggcactcctctaaatccttcttgaagtcctctgctgacagatgggcataagcagccaggcagggtttggtctctctaggttcatctccacctccacaagaggtctgagactgactcaggaggaactcgtcacagagagcgagtccttctgccagctgctgagagtctaacaattcaaactgggaatcgccttcccacaacttctgatcttgtgattggagattatctccgtcctttgttgtttttacagagggtgggaggacaacagtctcttcaatgcttatttcacagtttctattaagctgcacattaggaaaaacaaatgtatttctaaattctattttcaattatcaaaaaataagttagcagtatatgttctattttctggttcaacttacctatcacctacaaatgtgggccacatagaaaatatagataatgaacacaagagaatattcagttacctggtaaagattatgctcaggattatgaacaacttcttggactgtaccaacatgtttgtcagtgggcaatgtagtaaaatctgggagatttgattcagcagccattgattccagatcatcggatgtagttagctcttgagcattcttgtccccaggtttaaactgttgctgaaaaaatagtttggagacaacatattcaccatctctctcatcctctccagtgcctaggtggtactggtggatcacccaattggtcttctcagcctttccacccttcaacgggcttatataaagcaccattattttcttacaaccaaggtgttttccatcaactagtactggctttgtcttgcctgtcttgtgccaacggacatcagcatcgtcagtgtttatccttcgacgcttcctagtcccagtgttgtaagccttaaatgttctgtggaagaaatgtgatacacttccattttgtttaacacctggaagtttctgtggatgagtgtaacagatgccttcatcttcctcaactgttggaatgaattcatcaatgaacggatgtggttttattccagattttnccatgttttgcccttaagcgccagattaattcctggtcagaaggatcaaattttacacctttaggcaaaccgggccactggtgaacaacctacagcaagaaaacagtcatgagctgatcacactttaacggaactttcagatttgcagctgaccacactttaatagacccctaccaagggatatcacaagcaaaagccccagaa

SEQ ID NO: 23600 - DNA, 3581 bp, Zea mays
tgcaataaacagcaaggagaacaacagcctagctattagtgggattgatgggaagcaaaattcagcatagcgttgggtaagtgcaatgaacaaaaagcagaacaacaaatactgtgtcgtctgtcccttgagcttttaaacagtctgaactaatgcgagcagcaagccaaacactacatggtactctgaattggtgtcaacagcaagccaaactattcatcatcgtcgagatcgtataggatatgtttaaactgaacaacaggacaaagatgttaactatgagtctatgattgtagtcctaaatcacatgacagaaacatattgctacaaaactgatttaaacttgtgcataacattcgacacatagctatcatgggctctccggtactacaaggctatcgaattagttctcaacataaaaatagaactacaaagagtattacctctatgtgatttcagtcgtcctcgttctccggcacgcgcgcagtcttggtgatacccacttgcgaactaaaaaaatggaagggttgcagaacggtgaaatcaagattatcactgagaacatggattaaatccaatgaaaaggaagcctttgctccacctatagtttatttaaatccatgttgtatagttcaattacagaacggtttagcagttacactacaaatatgaaaggcaaccatggggagggaacccgcacaggaacaaacaacagacgtgcagcgatgcatggaaaaagaagactgaaatattaatccctaaaaaatcctaaaattagcagagcaatacgtcagtaccaattccaaacaagcaactggtctgccaactaaaatgagcatattcattacaaaatgtacaagctgaggcaaccaagaaaggccaatctcacactgaacagcacgccacagttggtacaacatgatttctcagcctttcatatttcatataaatcatttcatgtgcaccagagttacgcaaagcaaaagcgagaccactgttgttgcatacttcactgccgtcccacaaacaacagattagctaatccaattgatgggattgatgggagcatacatatgtatgagtttggactgctgaaaatcaaaacagcttatgctaatccaactaatgggattgatgggagcacaatgcaataaacagcaaggagaacaacagcctagctattagtgggattgatgggaagcaaaattcagcatagcgttgggtcagtgcaatgaacaaaaagcagaacaacaaatactgtgtcgtctgtcccttgagcttttaaacagtctgaactaatgcgagcagcaagccaaacactacatggtactctgaattggtgtcaacagcaagccaaactattcatcatcgtcgagatcgtataggatatgtttaaactgaacaacaggacaaagatgttaactatgagtctatgattgtagtcctaaatcacatgacagaaacatattgctacaaaacttatttaaacttgtgcataacattcgacacatagctatcatgggctctccggtactacaaggctatcgaattagttctcaacataaaaatagaactacaaagagtattacctctatgtgatttcagtcgtcctcgttctccggcacgcgcgcagtcttggtgatacccacttgcgaactaaaaaaatggaagggttgcagaacggtgaaatcaagattatcactgagaacatggattaaatccaatgaaaaggaagcctttgctccacctatagtttatttaaatccatgttgtatagttcaattacagaacggtttagtagttacactacaaatatgaaaggcaaccatggggagggaacccacacaggaacaaacaacagacgtgcggcggggcttggaaaaagaagattgaaatattaatccctgaaaaatcctaaaattagcagagcaatacgtcagtaccaattccaaacaagcaactggtctgccaactaaaatgagcatattcattacaaaatgtacaagctgatgcaaccaaggccaatctcacactgaacagtactccacagttggtaccgcatgattcctcagcctttcatatttcatataaattattttatgtgcaccagagctactcaaagcaaaagcgagaccactgttgttgcagacttcactgccgtcccacaaaaaaacagatcagttgtttcttcatgtaccaaaatggtgccgagagtgcactagagcagcgtcagtcgtcagtaatcttttcagctgcccatgtcataaagctatcctgtgaaaattcaatttggctgagtcgaaactcatcagtgttgtcaagctcaaggtttgtgttatctgtgggctccaaccgctggcactctaaatccttcttgaagtcctctgctgacagatgggcataagcagccaggcagggtttggtctctctaggttcatctccacctccacaagaggtctgagactgactcaggaggaactcgtcacagagagcgagtccttctgccagctgctgagagtctaacaattcaaactgggaatcgccttcccacaacttctgatcttgtgattggagattatctccgtcctttgttgtttttacagagggtgggaggacaacagtctcttcaatgcttatttcacagtttctattaagctggtaaagattatgctcaggattatgaacaacttcttggactgtaccaacatgtttgtcagtgggcaatgtagtaaaatctgggagatttgattcagcagccattgattccagatcatcggatgtagttagctcttgagcattcttgtccccaggtttaaactgttgctgaaaaaatagtttggagacaacatattcaccatctctctcatcctctccagtgcctaggtggtactggtggatcacccaattggtcttctcagcctttccacccttcaacgggcttatataaagcaccattattttcttacaaccaaggtgttttccatcaactagtactggctttgtcttgcctgtcttgtgccaacggacatcagcatcgtcagtgtttatccttcgacgcttcctagtcccagtgttgtaagccttaaatgttctgtggaagaaatgtgatacacttccattttgtttaacacctggaagtttctgtggatgagtgtaacagatgccttcatcttcctcaactgttggaatgaattcatcaatgaacggatgtggttttattccagattttccatgttttgccattaagtgccagattaattcctggtcagaaggatcaaattttacacctttaggcaaaccgggccactggtgaacaacatcactgttatcaatcacatgactgcactttgggcactctttacttgggttgccgatccatttctgtttacttggatctgaagacccagaagcattttttattttggtggcaaatctttggctgtcaattatccaagttgtccctgtcatggctgcggcagcgcttcctaccacggccgcagggtcctagggttccggcgagcacgcggcgacggagtgagaacggggtggagcagggagaacattggtttgtgcgccggcta

SEQ ID NO: 23601 - DNA, 901 bp, Zea mays
ggagcagttaatttaagactgcgatattgtgaagtttcttattctgagtcaaatttgtccacagaatattacgctgacaatagccaaaatggtgtacgagttaagagcaccaactggaagcatatgtcaatgcgggaaaacaaaaattggaccagacatggctttcaaactggtaacacacattctaagtggtagcggcaagagaaaattttcttccagcatctgtgagtgtacaaatgtccatagttaaccatgatatataaagtagaaaactcctgcttggtcactcggcctggggcttatcctcggctttctttggcttgatgccagggaacgacatgccaagctcctcctcggggatgacgacgggccacttctccccgccgtcgcggaacatcttctccgtatcgatgagccggccccgtgcgacgatctggtcccggatgccctgcgccgtagctccctcagcaaagacgatggcctcttcagctccggtgaagtaggtcacgaggaccctcggaggcgggagagtcggctgcgacttgaggtccgtggacggagctggggaggggaggcggcggagctcgaccgagcaggccgggttggagtccttggccttgcggccgttgcactgcgcgaggagctccactgccgccgccttccgcgggtccagagggcagtactccaccaccaccttggacaggaacttcagcatgctcttcctctcgccactggccccgacgccttcgtcgttgccgcgcactcgccggagccgcctcttcgctcgctggagatttggtggcggcgcgaggtttcgtgcctgttgtatgctgagggttgggccagccccaaacttgttttgggtcgggtcacaagtccggcccggctcgaggtaccaatg

SEQ ID NO: 23602 - DNA, 1754 bp, Zea mays
  misc_feature (10)..(10): n is a, c, g, or t
acacagtgcncgtacgtactactactacaagcagccgcgggcgggtcgaagaaaatggagatcctcagatccggacggacgcgacggagaagacgaatccggcgaactccggcggcgggcggaccacggtccagctcttggtcttgacgtcgaacacccagagcgcgtggcggccgccctcgccgtcgagcgcgccggtgaccacgaccttctccccgccgccgacgcagacggcgcgcgcggtgccggccttgaggcccggcgggtacgggccgacctcgcgccagccgcggcgggtgcccatccactccatgacggcgttgccctcgatgcaccagacgcggccgcggacgacgacgtgcgcggcggagggcggcgcgcgcacgcggtcgagcctgcgccacgcgcgcgccgccgggtcgaaccactcggcgtcgcgctcgaacccaccctggcgcgccgtgcggtagccgctgacggccaggaagcggtcgccggcgacggtggccatgccgtcgcactcgtcgcgctcctccgacatgtcgggcagcgggtcccaggcgtcggccccggcgtcgtacgcctcggcggtcttgagcgcgttcttgtgcttgtcgtggccgcccgccacgtagatcttgccgccggcctcggcgcaggcgaagaaggagcgcgccgaccgcatgggcgcggcgcggcgccaccgccccgtggcggcgtccagcacgtgcacgtccgccacgggctcgaaggtgcgcgggtcccagccgcccagcacggccacgcgggtccccaccgccgcgcactgcgcgaacaccggcaccacggggggcgcgccgcgctcccgccgccactcgcccgtcgtcacgttgtacaccgccacgccgtacgccggggtgctgccgggcccgtcgtcgccgtccttgggcccgtcgtcgccggacgggttcccgaactgcatcaggtacacgaggtcctcgttggcgcccgccgcggcgcgcgccgacgcgaaggccggcgcggcggcggcgctccgccagccgcggcagacccggcgcatcgcgcggtgggaggcgtgggggacgcgcgccaggcagtccacggccacgtcgtcggggatgccagggatcagttccacatgctcctggccgccgcggcagccgcctccgccccttggagcccgcatcttgcgtgcgagatgagcttatcgcttgttctcttcctctctctctctagtcgctcttgagatgagacgaggcgaggggaatgggatgtgccccgcccgggatcccctgcgaggcggttaaatagaggggtgcccgtgcgacgtggcgcttggttattggaccgaacgcacagcgaagccgatataaaaaccattagtataaaagctgggcctgggccgagctggtgttttctgtccggttttgacgacgccttttctgtgtttatttgtcgtggaaaagtttgcatctttaagctaaaactactaggcctagtggactcctcaagcaggcagaagaaaaaaaaacacacacacacagaaaggatggaaagcttgcaacctacagatgggaccgaaacattttttttcttggtacatgtcgtctgtgcatgtctagaagaatggtctgatcttttcttttgggtcgtgtacagcgtgtagatgaggtcgaggaggaggatgccaatgccaggatgggaagtgatgtttccgtttggcagcaaatggacgacgcaggctgcaaattaaa

SEQ ID NO: 23603 - DNA, 1312 bp, Zea mays
actagcactagcactagtttgtagcctttacgtctcttgatcgatcgcggagggacggacaggacgaagaagatctaggttttctcagatccggacggacgcaacggagaacacgaagccggcgaactccggcggcgggggcaccacggtccagcctcttgttcgtcacatcgaacacccagagggcgtgccggccgccgcagccgcccacaccgtcgagcgcgccggtgacgaccaccttctcgccgccgccgacgcagacggcgcgcgccgtgccggccttgagccccggcgggtagggccccacctcgcgccacccgcggcgggtgcccatccactccatgacggcgttgccctcgatgcaccagacgcggccgcggacgacgacgtgcgcggcggagggcggcgcgcgcacgcgctccagcctgcgccaggcccgcgccgccgggtcgaaccactcggcgtcgcgctcgaacccgccctgccgcgccgtgcggtacccgctgacggccaggaaccggtcgccggccacggtggccatgccgtcgcactcgtcgcgctcctccgacatgtccgggagcgggtcccaggcgtcggcctccgcgtcgtaggcctcggccgtcttgagcgcgttcttgtgcttgtcgtggccccccgccacgtagatcctgccgccggcctcggcgcacgcgaagaaggagcgcgccgaccgcatgggcgcgccgcgccgccaccgccccgtcgccgcgtccagcacgtgcacgtccgccacgggctcgaagctcagcgggtcccagccgcccagcacggccagccgggtccccaccgccgcgcactgcgcgaacaccggcaccacgggcggcgcgccgcgctcccgccgccactcgcccgtcgtcacgttgtacaccgccacgccgtacgccggggtgttgcccggcccgtcgtccccgtccttgggcccgtcgtcggcggacgggttcccgaactgcatcaggtacaccaggtcctcgttggcgcccgccgcggcgcgcgccgacgcgaaggccggcgccgcggcggcgctccgccagccgcggcagacccggcgcatcgcgcggtgggaggcgtgcgggacgcgggccaggcagtccacggcgacgtcgtcggggatgccgggaatcagatccacgtgctccaggccgcctccaccccttgggctccgcatcttgccttttcctttggcttgcgtgcgagctgatctaatctcctgttctcctctctccactagttctacttctcttcacttgagatgtggggaatgggatgtgcggcc

SEQ ID NO: 23604 - DNA, 3479 bp, Zea mays
cagctgttttatttatagtgttgttttgacttgccaacacaccacattctttgcattgagtgacatcacttgtagttgacattccaatgtctgacatctgtatgggtatggaagaatggaagggaagaaagggttgagcaaagacaaattatagagagcagagaaaactcatctatctaaggttttacctagctaactggtgtcattgtggacaaaagtcacacaatacaccaacaatcatttcaaagaaacaaatcaaacatgaacacaaaggacaatgaactcaagcataccagcacaacacaatccaattctactcattcaaccaaaacaaaaggtgagacaaggtttagaataagaaggatattataacatcaaggagttggataagaattatcaaggagttagacaagacatattcgtcggtggctaagagtgaaataagataaccatgaactattaaagtaaggataaatgatacaaccaaggatatgaagtgagttagggaaaaagtattatcaaggagaaaagtagacaagggtgattccacaaatctgaacccccctggcctcatctaacgatcggacaagacaagggtgattttacctcaaaattgtggcacagctatcgggcatggcatacacgtcatggcgggacaaggacgacggagcagtacccagcccacttctgctcctgctccgacagcacctgcgcgcatcgtttatggatcatctggttagccaaatttaaagggtgctacaagagattagtcaaatttactgatttaactactctctaaaatatattttacaaaaaaaaaagagtgcactcgtccaatagactctgtaaattcagaactctgtatggcgagtgaagcaggctggaaggtgtacgggagctactaaatttgaaaaaccatttacagtgtctattggaaacgtttttcttcttataatagacaaacttaactttacaaaaatatacggttagtcccttggagttgctctaaacagcctaatgctatgtggctttatctccgtcactaagcgaagaagaaaggatcatcgtcttggcccagcgctgctgcggcctgacaggacaggatcaggaggctggatgcacggcccactgggtgccatttgtttatttactgcagtgcaggcagtaagtactgtggtattgaagccttcacatggaatgtattaaaatttggtaactgcttacaccagactaggaaagagtataccggttcccctttcacaacaaatcatgtcgcgtcgcatctttactgggtttttcagtaagattagagccagaaagcatgctgctacaatggatcctaagcagctaagaaaaaaattgaacacagtagagtagatcatctgccagatgtccatatgtctcacgggtcgcaagttaaagtgcaggacattattttaagagaacaaccagaaccagctaagtagtaaatatttcaactcaccagaatgccgtataccaataaatttcactttctcaaactttatgcgctttctgaactaatgttgaatggctcctcatgcactgcaccgatcaccagcaatgacaatatatcagtgccatgtcattcatcataacgtaagctcggaatgggaaattatacatacaattcaaaggctgtaggaggataattctgagacatctcttaccagagttcataaggccactggaaataaaaggtaaaactatgcggatcttacatggtgagaacttttaatccacattgcactaatttaatatggttgaaacttctttattaattgaacagaccatttttttctctcttttctttaatgaaaaagatacgtgtttctgatgtgtgttcatgttttttttgcttctttctatgtttaatgaacctttctgatttatgcaaacttaattacacaagagaatcaggttcgaccattgtaatctccagtgatttcaatcttcataaggcatgacgaaggcaacatttcacaactaactaacatctctgatgcactaagaggaacaaaactagatacatcatattaggcagaatacactgccctgacaactgcctagccttattgcagctgataagtgctgactaacatcagctgacaactgataagtgatgactaacgttagttgacaaaaaggagatgattgctaagggccgctgggaatcaagactataaggacattcttattctttatcatcatggctacaatcactggcatcacattcaatctcgtcttcactattctccacagcatgcgcaagcgaattggcttgaagcgtcttaaaactgcttatgaagtcggttgcttctgagatgagagcatttttagcagccttcagactaccagcttgctgctcagaaagagacttcccagaatcagcagctttagagccagctggagcccttctgcgaggcctttttgcgccttctctacgtgccaatttatcaatgtacctctcatgtaggataacattctttataggctttagaactcctgggctgggttcagatggtttagttcttaaccttgaaaatggtttctttcgtgctgaagaccttccactgtgcttgcctagagaatctgaattcatataactgtcaggagtcccaggagaattgtcaaaagataagttcaattgtaaggcacttggtgagctttcaaaaactgagaagtggtcagcctcttgagcttggtcaatgcggcaatgtttctgcaacaaatgcctcactgtcttctgtgctactagactcttctgtttagcggactttcgcattccaactgtaggttccaagatatttggaggttttggatcagacaatgtgaaatttcctataggagaaaatgttgttttacttgctctgggacgtggggcaattggagtcggtgttgagaggtcagtataaattctgttgaagcaatcttcagcagatctccctggcaccatttttgaaaccctcttccagaaatgtggggatggtcgggcactgaagtaagctttgcgcaatgccatgtcctgctcttttgtccaatcatcaggaccacaaaaaatttctattccttctctctgagtcccactgggcttgttgatgttttcatcaatgtttgccaatctcacatcaccaactttaagcttcacctcggtagaagggtcattttcaatccttctgtgggtggattttctggattcattgcaagatgcaatttcttggcgatacgcaggcaatggtccagggtcctggcaactttgcttcttcgataacaacctcctttctgttcctctcttcctctttcctgtttgcactttacaatggatgggcttcaactcttgcttgtcactctttttgttagatacatctgaaatatctttcctaggaggaaatccagcacttcccctattccctttcaggccctcttgatttttgtcttttctatgagcatttttagtcttt

SEQ ID NO: 23605 - DNA, 953 bp, Zea mays
  misc_feature (12)..(13): n is a, c, g, or t
  misc_feature (934)..(934): n is a, c, g, or t
ccgggttatgannttcttattttaccaaaaaaaaaaaaaaaaaaaaaaaaaaaaaaaaaaaaaaaaaaaggaaaaaactcccccgaccgccccccgaacccgcccggagcagcaaagcataggcgctcgagcgctccctcctgagctcctccgcctcacggtcacgcctcgtgtccccccaccccctcctcgtcctccaccggccgcctcacgccgtcacctccgctcggcgagtctcggctccgaccccagccgccacgtgcgacctcccctactcctgactcctgagagatctgcggggctcggcatggggtgaccagatcgggccgctgctcggtgctttccagctgaattctgcccgcagctcgtgtcggaggcagcggagatggcggaggccggcgtggcacgcggctcagggagtgctggcgatgctttgttcagggaactctggcatgcttgtgctgggccgttggtcacagtgcctcgccaaggcgagctggtttattacttcccgcagggtcatatggaacagcttgaagcgtctacagatcaacaacttgatcagcacttgcctttgtttaatctaccgcacaagatcctctgcaaggtggtcaatgtagaacttagagctgaaactgattctgatgaagtttatgctcaaattatgctgcaaccccaaacagagcaaagtgagcccaccagcccagatcctgaaccacctgagcctgaaagatgcaacattcattccttctgcaagaccttgactgcttcagatacaagtacccatggtggattctctgtcctcaggaggcatgctgaagatgtttgccccaactgggacatgacttcagaatccaccggtgggcaaggaactagtggctaaaggatctcccatggaaatgaattggcatttcggtcacaatctttcgagggncaaccaaggaggcatctac

SEQ ID NO: 23606 - DNA, 2866 bp, Zea mays
  misc_feature (12)..(13): n is a, c, g, or t
ccgggttatgannttcttattttaccaaaaaaaaaaaaaaaaaaaaaaaaaaaaaaaaaaaaaaaaaaaggaaaaaactccccagacaaccaaacgaaccctcccggagcagcaaagcataggcgctcgagcgctccctcccgagctcctccgcctcacggtcacgcctcgtgtccccccaccccctcctcctcctcctcggccggccgcctcacgccgtcacctccgctcggcgagtctcggctccgaccgctgccgccacgtgcgacctcccctactcctgagagatctgcggggctcggcatggggtgaccagatcgggccgctgctcggtgctttccagctgaattttgcccgcagctcgtgtcggaggcagcgaagatggcggaggccggcgtggcacgcggctcagggagcgctggcgatgctttgttcagggaactctggcatgcttgtgctgggccgttggtcacagtgcctcgccaaggcgagctggtttattacttcccccagggtcatatggaacagcttgaagcgtctacagatcaacaacttgatcagcacttgcctttgtttaatctaccgcacaagatcctctgcaaggtggtcaatgtagaacttagagctgaaactgattctgatgaagtttatgctcaaattatgctgcaaccacaaacagagcaaagtgagcccaccagcccagatcctgaaccacctgagcctgaaagatgcaacattcattccttctgcaagaccttgactgcttcagatacaagtacccatggtggattctctgtcctcaggaggcatgctgaagaatgtttgccccaactggacatgactcagaatccaccgtggcaagaactagtggctaaagatctccatggaaatgaatggcatttccgtcacatctttcgagggcaaccaaggaggcatctacttacgacaggctggagtgtttttgttagctcaaaaagattggttgcgggtgacgcgtttatcttcttgagaggtgagaacggagagctgcgagtcggggtaaggaggctcatgagacaactaaataacatgccgtcttcggttatctcaagccacagcatgcatcttggagtcctagcaactgcatctcatgccatctccactggaactctattttctgttttctacaaacccagaacaagtagatctgaatttgtcgttagtgtaaacaagtacctcgaagctaagaatcacaagatgtctgttggtatgaggtttaaaatgagatttgagggtgatgaatcccctgaaagaagattcagtgggacaattattggtatgggatgcatgccagctaactcaacatctccatgggctaactctgaatggagatcattgaaggtccaatgggacgagccttctgctattctgcgtccagatagagtttcaccatgggaagtagaaccccttgatcgaacaaatccacagccacctcaacctcctttacggaataagcgagcacggcctcctgcttcaccttcgattgctccagaacttgctccagtttttggtttttggaagtccccagctgagcctgcccaagctttctcattctcaggactgcagcgaactcaggagctataccattcaagccccagttcaatgttctcatcgtcgttgaatgtgggattcaatccaaagtacgagggtcccactccaaacaccaaccatttgtactggacaatgagagagacaagaactgaatcctactccgctagcatcaacaaagctccaactgaaaagaagcaagaatccactacttctggctgcagattgttcggtatcgagataggttcttctgcagtgtcacccgtggttactgttgctagcgtcgggcatgatcctccgccacctgctctctcagtagacgctgaatctgaccagctgtcacagccgtcccatgccaacaaagcaacggatgccccagcggcaagcagcgatcgctctcctaacgagacagagagccggcaagccaggagctgcaccaaggtaatcatgcaaggggtggcggttggcagggcggtggacttgacgaggctagatgggtacgatgacctccgccgcaagttggaggagatgttcgatatcccgggagagctttccgccagcctcaagaaatggaaggtgatctacacagatgacgaggacgatatgatgctggtcggggacgatccatggagtgaattttgcaggatggtaaaaaggatatacatttattcctacgaggaggccaagtctttgactcccaaggcgaagctgccggccatcggtggtgacaccggcgtcaagccggacccaagcaaactgccagcagaatctgacgtgccacagagcgactccgacaacagtgctcccgttgctgctgataaggactgatggacgctagctcggccgtaccttctctttatgttggccatgggaggccagtgcagtgcccatgctccttgagactgctaagagttgatcatctgttccatctgcctcggcttggaccagcgaggatggccgggagggagtgcatgccgctccgtgcgtgtttcgtttgccgtgtttggtaggagccatggcttgttgccggctacttgggttctgtagactgttacactgactgctgccgtctcacctggccgtcggcgcgggccgccccctctcacctctctagtaatatactagggcttatgtacacacagctgttttggtagtggcatatgtatatcgtcggtcatgttgcttgcgacatttagcatcctccgtagctgctatttcctctcctgcattttaaaaaaaaaaaaaaaaaaaaagctctggcgcaatatgtgttccagcg

SEQ ID NO: 23607 - DNA, 4377 bp, Zea mays
ccgggacggagccccaccgcacaccccatcccgcccggagcagcaaagcataggtgctcgagcgctccctccagagctccccgcctgccgccccgtcctcaccctcctcggtcgcctcccgccgaggctcggctcccatccgcagccaccacgtgcgacctcccctcccctgttcctgagagtaagatcctctctccagtcccgtgcttcggctcctccggtaccctgaatttcgcgggctcagcgggtctaacggctacgtcgctgctgctgcgcgcgcagatctccgtaggtcggcatggggtgaccagatcggtgctctccagctgaattctgctcgcggctcgtctcggaggcagcggagatggcgagcgccggcgtggcgggctgctcagggagtgctggcgatgctttgttcagggaactctggcatgcttgtgctgggccgttggtcacagtgcctcgccaaggcgagctggtttactacttcccacagggtcatatggaacagcttgaagcatctacagatcaacaacttgatcagcacttacctttgtttgatctaccacccaagattctctgcaaggtggtcaatgtagaacttagagctgaaactgattctgatgaagtttatgctcaaattatgctgcaaccagaagcagatcaaagtgagcccaccagcccagattctgagccaccggagcctgaaagatgcaacgtctattccttctgcaagaccttgactgcttcagatacaagtacccatggtggattctctgtcctcaggaggcatgctgaagaatgtttgccccaactggacatgactcagaatccaccatggcaagaactgctggctaaagatctccatggaaatgaatggcatttccgtcacatctttcgagggcaaccaaggaggcatctacttacgacaggttggagtgtttttgttagctcaaaaagattggttgctggtgacgcgtttatctttttgagaggtgagaacggagagctgagagttggggtaaggaggctcatgaggcaactaaataacatgccatcttcggttatctcaagccacaacatgcatcttggagtcctagcaactgcatctcatgccatctccacaggaactctcttttctgttttctacaaacctagaacaagtcgatcggaatttgtcgttagtgtaaataagtaccttgaagctaagaatcacaaggtgtctgttggcatgaggtttaaaatgagatttgagggtgatgaatctcctgaaagaagattaagtgggacaattattggtctgggaagcatgccagctaactcaacttctccatgggctaactctgattggagatctttgagggtccaatgggacgagccttctgctattctgcgtccagatagagtttcaccatgggaactagaaccccttgatgcaactaatccacaaccacctcaacctcatttacggaataagcgtgcacgaccccctgctttactttctattgctccagaacttcctcaagtttttggttttttgaaatccccagctgagcctgcccaagctttctcattttcaagaccgcagcaaactcaggaattataccattcaaatcccagttcaatcttctcatcatcgttgaatgtaggattcagttcaaagaatgaccgttctactccaatcaacagtcatttgtactggacaatgaggcagacaagaactgaatcctactctgctagcattaacaaagctcctactgaaaagaagcaagaatctgctacttctggctgcagattgtttggcattgagataggttctgcagtatcaccagtggctactgttgctagtgttggccaggatcagccacctgctctctcagtagacgttgaatctgatcagctgtcacagccatccaatgccaacaaaacggatgccccagtggcaagcagcgagcgctctcttaacgagtcagagagccggcaagtcaggagctgcaccaaggtaatcatgcaaggaatggcggttggcagggcagtggacttgacaaggttagatgggtatgctgatctccaccgcaagttggaggagatgtttgatatccagggagagctttctgccaacctcaagaaatggaaggtcatttacacagatgacgaggatgatacgatgctggtcggggacgatccatggaatgaattcctcaggatggtaaaaaggatatacatttactcttacgaggaggccaagtctttgactcgcaaggcgaagccgccggttgttggtgacaccatcaagccagacccaaacaaattgccaccggaatctgacgtgccacatgactcaaacaacaatgctcccgttgctgctgattatcaggactgatggatgctaacttggctcctaccttttctttcccctcttggatgtcggtcatgggaggcaatgcacgctccttgggacttgtaagagttatctgttttgttgcttcgcgggcccaaaggacgcttccctgcaccatctgcctttgtttggaacggcttggaccgccgtggtccttttacctgcagcaaggaaaggaatggctgggagggaatggatactggtatcgttccgtgtgtggcaccccgtgatctgtttgccgtgctttgtaggaggcatggcgtattgccgggtactttggttttggagactgctactgactgctgccgtcgtcgggccgctcctctcacctctggtaaataggactttgtacacaattattttgttagtagcagtatatgtacatcatcggtcgtgttgcttgctacatgtactcctatgtagcatcctcccctgcattttagtcctggctaggtatcagatgctctggtgcaaaaatgtctctgcttgttccaacggcatgctcttttcggcccgtgctgccttgctgggtgtcgtgtgtgccttttcggttggaacattgctgccaccgcccggcatttggtgctttcttggtgttatgtgtctgccctcgtgtacaaggcatctgtaacgcctggggtctctgtttgacgcgatgctgatgcgggcgcggccctttctgctttgtgctttacctccgtggaagaggcatgcgcatggcgaccggcgatggacctgatggtctttctacgggtcaccattcctcccgtcttccggggagaaggctcgttggaatgaatgccacgcccgtgggtattgagatctccgacaagaaattctatatttgactcatgaaaaattaaagtaagaatctgatttaaaatgtttaggtgccattaaaaacgtttggcagttctaacaattgaatcatatatcatattattagaaaatagattatgttatttagaaaataaaatgttaggaatgatgtactaaatgagaatacggttctagtatatgtggtactttatttagaatccgagagatcgagtattataatcgtttaatgaatttttataaaatatggcccttgttagagcatattttagtgttagagtactatattttaaaatataactccgtttaaaattcttgttggagatgctctaagtactggttgtgcaagccttctcttttagcgctcatagtattttcttctcactaagaacatctgtaacaaagaactctaaaatagagccttcaaattgaaataggaccacatttaaagtgtttaggaccttaatttttttactccaataggtagaccttaaatattgttatttaggaaataaatcatgctaccgtgaaataaatagttgtagattaagaggaaataaggatagagatcaaatatatggggtactatatttagaatacgagagaccgagacctataatcgtttgatgaattttcatgaaatagggcaaccgttggatgatgttttatgttactgggtcttatattttaaaatacaatctcgtttagggtccctcttgaagatactctaggaatttgtttaggagcaatgtgatttggggatggagggggacaaaatctctttctttaaaattaaataacaagggattctagtctcatcaatcctcttgctcccaaacaagctctaatagtatttacaagttgatattcgaaataataggctgacctctttttcaatatttttattttcttttttatttctaagcacataagttgactatattgtccctttttattttttcctccctctcttgctccgatccaattggtgaaatcacatatgggggcactgatgatgtcttcggtgtgccaatccaatgtcttgatcgactgctttttttggattgcggctgcttctgctgagaccaaactatgtatccctgtagagtgttgtttgtgtacatcaactgcaggcatgc

SEQ ID NO: 23608 - DNA, 5214 bp, Zea mays
  misc_feature (3630)..(3630): n is a, c, g, or t
tcaacaggaatatgactcacacgggactggacgcaccccttttaatgccgtttgcgcacgtggaagggtacgtgtggcgcacaacggcacatttcacgcaacctaaccgtatttctgttcgagtacatacatgactacaggtacacgacataaacctcgtacgcacgcaccgctaataaatgacgcatgcagccgccgctgccataaatagaataggccattgggataggtagcaggtgcaccgtgcacgggcaccgccccgaggctcgcggcgaaccgaacagcccagcagaggctgcagagcaagcaagacaacaagcccagcgtccccgcgcacgcacgcgagcgcctaggccgacgaggcgaggtggccccgccggacccatggggggctgctactccgccttcgcctgctcgcggaagctgcgcggccgcatctccttcatcctcccagtcaccgagcgcgaccgcgacgaccgctccagcgacggcggcgccagctccgtcgcctcccattcgccgtccccgtccccgtccccgcgcaaggacgacgccgggccgctcgtggtgcggaccaccgcggccgagtttgcgcgccgctacgtgctgggccgggagctggggcgcggcgagttcggggtgacgcgccgctgccgggacgccgccacgggggaggcgctcgcgtgcaagaccatccggaggaaccgccggcctcgcggacccgccgcccgccgcctgggggccggtccgccccaccacggacccggagcgcccccagcagcagccgggcaggacccggcagcggcggcgcacgcggcggacgtccagagggaggtggccatcatgcggcgcatgtcgtcccgcggcggcggcgccgtggtgcggctccgcgaggcctgctgcgaggactccgccggcgccgtgcacctcgtcatggagctctgcgagggcggcgagctcttcgaccgcatcgtcgcgcgcgggcactactcggagcgcgccgcggcggccgtcttcggcaccatcgtcgatgtcgtgcgcctgtgccactccaacggggtcatccacagggacctcaagcccgagaacttcctcttcgccaacaagtcggaggactcgcagctcaaggtcatcgacttcggtctctccgtcttcttcagccccggtatgtacgcatctgcttgcttgattcatcaaatcgacattgaaatgaaactccaaccgaacgaggcatccatgcaggcgatcggttcacggaggtggtggggagcgcgtactacatggcgccggaggtgctgaagcgcaactacgggccggaggtggacgtctggagcgctggcgtcatcctctacatcctcctctgcggcgtcccgccattctggggaggtaggccgtaggcgcgcggagcgcatgctttttcttcctcctccgatccagtgctggtcgctgacgatatcatgtccaccgacgcgacatggacaacgcagacaacgacgagaagatcgcgcaggcggtactccgcggcaacatcgacttcaaccgggagccatggccgagagtgtccgccaacgccaaggacctcatccggcggatgctcgacccaaacccctccacgcgcctcacggcgaggcaggtgcttggtaagccgccatcgccgcctggcctggctggcctccgccctccagtgctgctgagtgctgatcgctgacgatatgatgatgtcgaggatgcgcaactgcatgcagagcacccgtggttgaagaacgcggacacggcgccgaacgtgtcgctgggcgaggccgtgcgcgcccggctgcagcagttctccgccatgaacaagttcaagaagaaggcgctgggcgtggtggcgcggaacctgccggtggaggagctggacaagtacgtgcagatgttccacctcatggacaaggaccacaacggcaacctcacgctggaggagctcatggacggcctccacatcaacggccagcccgtgccggagtcggagatcaggatgctgctcgaggccgtgagtggctgctagctgcttttgtttgccatcgtcgtgtttcgtcaaaccggccgggatgacgatgaggatcaccatgcatgcaggccgacacggacggcaccggcaccctggactgcgacgagttcgtgacggtgtccctgcacctcaagaagatgagcaacgacgagtacctggcgtcggcgttcaggtacttcgacaaggacggcagcggcttcatcgagcccgaggagctgcgggatgagctgggccccaacgaccaggccatcctcgacatcatccgcgacgtcgacaccgaccgggacggccgcatcagctaccaggagttcgagctcatgatgaagtccggcaccgactggaggaacggctcccgccagtactccagggccaacttcagcagcctcagccgcaggctctgcaaggacatgtgatcgggccccgcgcttggcactgactagtgtcggcaaaagggagaaacgcttgcttgtacgcctgctgcggacagaaaatcgtttcgaattagttgggatattagaactgcatttacaaattcagtcaaaacttgcaaaggaacaacggatgcgataaagggcgcaaaccaacgaaactgacgcagtttcgatttcagaagccgaagcaaaccagagcaactctaaaaacatgctaaaatttttccaaaaaaatgattattagagctaggctaaaaatttttagagttgaattattgtgaatactccaacagttccttaaaaaaaactgaaaaacagaaaattagactccgaattgaaaaaacaccctccaaccagccctatttgcacctacatataggagtgataatagatcgtgatctaaatgtttcttcataattttttagtgccctaaaaatattttaattaaaaatgaataaaaataaagcacgatcttaattcgacctgatccttaaattttagtgttgcgcccacgtgatttagttgttttaggtttgttctaagttaaactgtttgaactttaaccaacaatatatatatatatataaaagattcaaacattttaaactaaaaaaattaaatactatggtagttaaagtaataatgaatctagtaattttacttttctattgtaacatccgttataattggttaaaattaatagtgattgacttaggacaaagcaaaacgactaatttatataggaggaagtaaaatttagagcttattatcaccctacctatgtatgggccgctgccactttgccaggttgatgccgcctccatcaggagagcgccggaaaaaacgcgggagccatgcgtatacagccggattggggaggatggctctcactgcacggaaatatacaataggggagaagatagatgcgggatgcgaaattttttagaaagaatgagagagctgttgaagcaagaaaaaatcagttttattttctaatatctattttagatagatttacaactttttttaagttgctctgcaacatgtcccaaagaaaagaacttgtaaaactgaccgaccaactgtttcgttgttttgttgtctgaaacgccaccatttcctgcatatggtggccgacattcactttcaaanattgcacctatagcggacaagcatagattcaaatgattgagccaactttcaaaccgaaaggaccaaaaggttcaaaatagaagcaaaattagacatctctacatttctttttataaagtaaagcttattaaatagcacacttcgtcttttgtgtctagaaatatttctaccttgtgatgagaagttttacatcctagttttaaatcctatattagtattataattctagtaatataaataattggctgtaattgttaaaaaataaatgctcaaagtaaataaggaatatatagaaacaactcaatgttcttctgagataacagagagtcatcattctccgctaatcctctttgaaacacttgcacaaagttattgctccttcttgatccgtatgggttgattctttgtcactctaacatagtgaatcatccacaaccatgtacatttaagttgggtcagccacaaactctttgagtgatcatcaactcctaatcatcatcaaaccatctatgtgatgtcgatcaccaagactaacaagcacaaactctcatttgacttatggatgcacactagctactctcaatgctctaaggccactaataacacaattatcaactcaagtttctcaatagggaaataatcttcctcacactctaaagagtttttaattgataaatgggaaagagagttagaatggattggttgggtttatttatacacctcaatcggccaactagccattacaataactctaagatgaaaacgtagacgttagacaatctggtgcctcatcgttggaccatacaccttagttcgacgagactcaatggtttgagtgacctcactatgtcagatataactgttagattcgaaggggccgtgatgcctaagagagggtaaactatacaatctatttcaggaactaaagtctctaaattttcctagtaaaatctatgcaagaaataagcaatctatgtgcaaatgtgattatgactaattatgttgctatctatttgcaaagatatacaacttaggttcaaaccctattaactagcgtaacaactaagctagaagggtaaatcacacaatcaaggtatataatataaatgtagaagctaaaaggtgacagagatacaaactcctatcaatggcttcattatttttaccaaggtaccaaggacccctcgcaaggatgctcacgtgagggcaagctctcaatagggtaactccatggacaacattgactttccccatgtgcatgttggtctctagaatgtcctctctaatgggacaaatgggttctcgatctttctatgaaagcgtggggtaatttgatttggatatgttgttgtccttgtcatgccataaaaagaactctgaacctatgagcaaattaaaaaaacaagcaagagcgagtggacacgcaaacaacacacataccttgcccaaggatgcatttcacaatcatgaagttggggatctgagtagagtaaaataggtgctctagtcgagtcatgtgattacaaggaagcagtagtagctaaacttcaacggtaaaaaactcgttcttccccgcctaatgag

SEQ ID NO: 23609 - DNA, 1098 bp, Zea mays
  misc_feature (80)..(80): n is a, c, g, or t
cccagaactcctcttcgccaacaagtcggaggactcgcagctcaaggtcatcgacttcggtctctccgtcttcttcagcnccggcgatcggttcacggaggtggtggggagcgcgtactacatggcgccgcacgagctgaagcgcaactacgggccggaggtggacgtctggagcgctggcgtcatcctctacatcctcctctgcggcgtcccgccattctggggagacaacgacgagaagatcgcgcaggcggtactccgcggcaacatcgacttcaaccgggagccatggccgagagtgtccgccaacgccaaggacctcatccggcggatgctcgacccaaacccctccacgcgcctcacggcgaggcaggtgcttgagcacccgtggttgaagaacgcggacacggcgccgaacgtgtcgctgggcgaggccgtgcgcgcccggctgcagcagttctccgccatgaacaagttcaagaagaaggcgctgggcgtggtggcgcggaacctgccggtggaggagctggacaagtacgtgcagatgttccacctcatggacaaggaccacaacggcaacctcacgctggaggagctcatggacggcctccacatcaacggccagcccgtgccggagtcggagatcaggatgctgctcgaggccgccgacacggacggcaacggcaccctggactgcgacgagttcgtgacggtgtccctgcacctcaagaagatgagcaacgacgagtacctggcgtcggcgttcaggtacttcgacaaggacggcagcggcttcatcgagcccgaggagctgcgggatgagctgggccccaacgaccaggccatcctcgacatcatccgcgacgtcgacaccgaccgggacggccggatcagctaccaggagttcgagctcatgatgaagtccggcaccgactggaggaacggctcccgccagtactccagggccaacttcagcagcctcagccgcaggctctgcaaggacatgtgatcgggccccgcgcttggcactgactagtgtcggcaaaagggagaaacgcttgcttgtacgcctgctgcggacagaaaatcgtttcgaat

SEQ ID NO: 23610 - DNA, 1750 bp, Zea mays
  misc_feature (1669)..(1669): n is a, c, g, or t
  misc_feature (1741)..(1741): n is a, c, g, or t
ttttttttttttttttaacgaaaaggatgcagagttctttgccaaaattttgttggaccacgaatagtacagctacatataatgtgcctcattagacagaacaggcgtcttggcctccatctgttacatccaaaagaagctggctacaaacatcctgaaaggagggctctttagcaaaaatatatacatcgcaagtgtcatacagaagcatgttatcctatgcaactaaaccataattctgcatcccacccgatcataatactcgcctatactcttcgcgaggcaaactgacttgattgcctatatctgtatagatgattttgaacagtaaatcaccttagttgagaatccaccaaaatgtgtcattcagacttcacggatagcctttttatgagctcatatgtcacgatcattgatgtgccccagacagacatgttaagaaacctcggtccaaaacctctatagaatcccctccagccatcttcatcaagcagcagcctggtagttttcatgactgaaggcctgcctttaccatagttgtccataacctgaagccgagtcttgatggtatctactggagtggtgataatcgacgagcaagcaccagcaattgttcctgctgttgcttggacaacaacaagttctgattgagatggttttgtttgtgagtcatttccataacccaaactcctccaaatagcatgttgagcaccaccatatgcactccaccaaagggctgaagctggcgactgagtcaacatagtgataccaaaacctcgataaagcccccggatcccttctgttctgacaaccttatttatcacatcgaatgggcccctgtatgttgccatccctggcaatccttgaaccatgagcctttggcaaatcacatctagaggcacaaagtatgagcatgaacagatactcgacattagacctgcaatgccatttgctatagcaatttgtgacgcctctgacagatcaaaatgttcacaatacttaaatgtcatttctttagagatctccagtgatgttagagctagcactcgcccaggcagagctccaacagcagcggtgccaaatcctctgaaaatgccagggatgccatcgcttctcaatatcctcctaaaaacagcaaacccagacatatgtgcaagcccaccttcagcaacctgcatcctagtcttcacaacagctgttgggtgcagagcaccttgctgggccgtgaacaggatagctccaatcacatgaaacctcgtcttgtccaacctctcccagttgatattggcctctgcgagcgcgattcctgccgcggacgcctccgaggtatccgccgccgctgccatggatccgccacacgcttacacacgatgcggctccgggagaggaacaaatataggagaagcggcgcggtgtttggtgctggtcctcacttcgtgcgtgtttccggtccggacgaagtgatgtcggcgcctctgcgagcgactatgcgcacggggaaaagaaggcagcggcggaggccggaggggaggaggaaggaggcggagccagtttgttggggtgcgccacctcgagacattaggggttttggttagaagtttccagcacggtcgtcggcggcgcccctcggaccgcgctgcccaacttgccattcgtccggcctcgcctnactgacttgcggggcctggattgggcgagggtcgtagtgaaaccgaggagtgggtcccgtcagtggggccgngtcggagat

SEQ ID NO: 23611 - DNA, 1931 bp, Zea mays
gggaggagaagctgtgggtcgatcacttgggtcttgggtggcacgcgctacaagctagggcttctgctccgtcctccgcgaatccgcggcgagcctgctagctgcgtggcttccctcttcccgggagcggcgcggcggtagtgctggtgctgcccggaccagaccagacccgaaagcggagaggcccccgtgcaaccagagccgtgcgttggaggtggacaggtggtggcacctgtgggcaacggccaacggcacggcagattctggtcgatcgtcgatgaggccggcgccggagacaagcacgcggcggccgcagctgcgtcgccgtcgtccagtgccattggtgacggtggccgtgtctttggcgctcatctcgctggcgtgccttcctgtcttcgcggatgcaagcagagcgctgcaccgcgaccgggaggagcaccggaggcagcaccaccgcacggaggacaagaagagccgcgtctcgctccctcccgacgctgacggcgactctccgcccgagcctccggactccggcggcgcgccgccgcctgccgacgacagcgactgcggcaacgtgttcgacgtgagggcgttcggcgcgtcgggcgacggctcgtgcgtcgacgacgacacggccgcgttccgcgcggcgtggaaggcggcgtgctcctccgactccgccgcggccacgctgctggtgccgtcggacggcgtgttcaccatcgcctccaccatcttctccgggccgtgcaagcccgacctcaccttccaaatcgatggcgtcctcatgccgccggacggcccggcgagctggccggcgacggacagccggaaacagtggatagtcttctacaaggccgatcgcttgacgctggcgggggaaggcaccatcgaaggcaacggtgaggagtggtgggatctgccgtgcaagcctcacaggggtccaaacggatcgacgctgcgcggaccatgtgacagccccgcgctcatacgattcttctcgagcaatgacgtgacggtatgcggcctgcggatcgagaacagcccgcagttccacctcaggttcgacgactgcgagcgcgtgcgcgtcgacggcctcttcgtcagctcgccggcgtccagccccaacacggacggcgtccacgtcgagaacaccaagtccgtccagatcctcaactctaggatctacaacggcgacgactgcgtctccatcggcgccggatgctccgatgtccacgtcgagaacataacatgcggccacggccatggaattagcatcggcagcctgggtgtccacaacacccacgcctgcgtgtccaacgtcacggtccggaacgtgcggatactcgactccgacaacggcgtccggatcaagacgtggcagggcggcgccggcgcggtgtcggcggtcgagttcaccggcgtgcagatgcagaacgtgaagaactgcatcgtcatcgaccagtactactgcctcggccacgggtgcgccaaccagacctccgcggtgcgcgtggccggcgtcgcgtacagggacatccacggcacgtacaacccgcaggccggcgcgcccatccgcctcgcgtgcagcgacgccgtcgcctgcacggacatcaccatgtctggcgtcgagctgctgccggccggcggggacgacggagcactgctcgccgacccctactgctggaacgcgtacggggtcatggagacgctcacgctgccaccggtgtactgcttgctggagggcagcccggagtctctccaggatccgctcaccagttgctgagatgagatcgttttctttactaacaaagatttctctcctgagacagtcaacgctaatacactggacattctacatgtgacaaattacaaattacgcagacaatgtgaatttctgaaatggcatgctcccaaaaaaaaaaaaaaaa

SEQ ID NO: 23612 - DNA, 2485 bp, Zea mays
ctaactaatcatgcatatatataataaaggggaaaaggccaccatataagttatgtatcctatgtgtcccataaaaaaatttaagtgacattcctacttaatttctgataagataaaaaaaatttaaattttgataattatatattagaaaatattgatatctacggtatttaattattaacattgtataattgtagcgtatatttttgtaataaacgtatttaaacatacataactactctctactaatgagcctagttaaatttaagaatgtttgaccaacgcgaatctcagtgatatttttatgatatgcagggactagactgctatacattctacatgttttgtatgatgttttgctttaactttgcttggcaagtctaacttttctattgtataacaagatttatgtaataaaatacatataattagttttattaaatattctatggagtgtatgtttatagggcaattgtgagtttgtacgtgttaatatacttttttctaaaaactaagttagttaaatttagtcagcgacacgacgttgttggttaggctggggaacatcggtcatgctcatgcatcacctggggccacaccacacgagttgatacagccaaacaacgcaaacaacgtaaagagcgacgaggcttacggacaaaccacgcaccgaaggatatgattgttgatggcacgctgatccgtcttgtgtcatggaagcctaaacacagccatgctaatactacgtcagtcttacttgatccctcatcatcttcttccagagttgtcattaagcgagatctggtagatcgtgagcttcgtggctatttgtagatgatgtggatgagaatgtgtaatctgttgacatttgtattttattttcataactaataaatggtaatatatgttctacttaaactagcctatcaatcacacaggacatgtctatcatgtattcatgtcacgcgtgcgggacgtcaaaaaaagagagctcctatcaagaaccatcaacagagaagtagcagtcccgtgaaccctttctgatcccaccaagtccacaatcagaacgtctgaacgcgcgacatgaagatgtcaaactgccaaaagcatcgtcagaattcagacagccgcagggaaccggcctctcaaatcgtcagacactcagacgtgcacgtgccagtacaaatggcttgctgcacgaacagagccggcaacaccatgcatcgcagcgtcacactcgcgctaacaaacaacacgcgacagaccaaacaaaaaccactgcgtcaacaaggctgtaccactgctgaagacgatagtacattctgttcctaggtgtagccacttttacaggcaatttcctgccacatgccttcttctccgatccaatcccccccaacaccattcccagacatacaacccacaggatgggccctagcacaggatgaacaaaaaagagagataaaccgaagctacaaaaatagagtatgagtatctgatgaggaactctctctctccctttcttccatccatcgacgcgataagttcccttctgtcaccactgattcttctgaaagagctagctaaccgaatcactcctccaactgttagaagcagaacttatgtacagacactaggctctcattgttgctgttgctgtcctcccttctctagagagggagggtgactactacggaagcgatcttgaataatcgatagccagagagatcaggctggctgggctagaactcggctgtggttgtggtcaccctcgtaggtaacgatcagcatcgaagggtcgtccacgcacctctcgacgtgcttcctcgcggggcagcctctcacgctgctacacttgtagtaacccctgcaaggccggtgagctttgtgagtatctgtgatctgcatattttgacaaaggtacaggagagtgaactgtgctccaaaaggggttgccagttgtggcctttcttggattgcaacaggcatgctaccagaattacaacaggtttgtaaccataaatgtatgctcagtagtcagtatgcttattgtaaaatagtaggaaacaaaactgagaacttaggttagaagccaaacgacccaatgctataagcagcataagactagggagaggatgcttgttcatatttttcatatcagtacaatcctttgtggtgcctccttcatgggagatcatgcactccagaacatgaaaagggagagatacttacctgagctcaacagcactggtggtcgtatttaaataagatagcatgaaatcagtgggtacaaccgcactatacccggctgacgttataagcagatagagctttgctacgatacatccaaatgactgtgagccgttcatttattttgatcgaacggttatggtcacctaggtgaaatatgtatttatttattttgtaaagtatgatgaattaggaaagttttatacataaaaattattttccctagatttgacatgca

SEQ ID NO: 23613 - DNA, 1473 bp, Zea mays
ggccgctttttttttttttttttttgcgtcaacaagattgtaccactggactgaagacgattgtacattctgttcctaggtgtagccacttttacaggcacttttcctgccttgtgcccttcttctcgatccaatcccctaacaccattaccagacatacaactgcggctcaatgtcacactgcaaccacaagatggggccctagcacaggacgaacacaaaggagaaaccaaaactacaaaactagagtatttgatgaggaaccctcctccccctttctccatcgacatgacaagtttcccccctgtcaccattgatttttctgaaagagctagctaactgactctctcctccaactgttagaagcagaacatatgtacaggcactaggctcttgttattgctactgtcgtcgttgtcatcccttctctagggagggagggagggtgactgtagaagcgatcttgaattgatagcctgaaagatcaggctggctgggctagaactcggttgtggttgtggtcaccttcataggtaacaatcagcatcgaggggtcgtccacgcacctctcgacatgcttcctcgcggggcagcctctcacactgctacacttgtaataacccctaggatgtggggatcccttaattggcttctgcccatacttcctccatgagaattcatcagctgggatgtctgcaaccttgttgcttattgcagggactttgatggacctccttatccttagcttccttttctttgaacaatggcaccggctcccggttgcacaccgaccagtcccatcctccctgccagcgcaccttctcctttgcaccaggcccagctccggcgtgctagctgtctgagagccactaagtagctggaacggcctgctggtccggcttccatccaaactcgcaagactcccttccatgctcagagacgaaaggaacgagcgagacgatgacgccgtgcaattagagctgtcaaacttgagattcacacccttacgaccgccgccgccgccgccacttaagctaccaccctgatcaccaagattgctcctcttcatcatctcgctctggatcttcatctgctgcatgagctgaaacctctggtagctttgctgctgctggatgaaatgaaggtgagcggggggcaatgccggggtgggcgtccctgcggggggcgcaacggacaccggctggaccatctggacgatcggaggggactgcgacgtcgacccctccataccggcagtcggcttctctagcagcaacctcttggggaactgggtagggatcctgcacaggatcctcagacgacgagccctcaaactggtggtacctcgggaacagctggaggccaaggatcgggctcgggctggggacgagctggccgtgcgggttggagaggagcgccagcacccggtggcagctctccactgccgtcctgttggcctcctccatcccctcc

SEQ ID NO: 23614 - DNA, 1816 bp, Zea mays
gcgtcaacaagactgtaccactgctgaagacgatggcccattctgttcctaggtgtagccacttttgcaggcaatttcctgccacatgccttcttctccgatccaatcccccccaacaccattcccagacatacatttgctgccctttgttacactgcacccacaggatgggccctagcacaggatgaacaaaaaagagagataaaccgaagctacaaaaatagagtatgagtatctgatgaggaactctctctctctctccctttctcccatccatcgataagttcccttctgtcaccaccgattcttctgaaagagctagctaaccgaatcactcctccaactgttagaagcagaacttatgtacagacactaggctcttcttgttgctgttgctgtcctcccttctctagagagggagggtgactactacggaagcgatcttgaataatcgatagccagagagatcaggctggctgggctagaactcggctgtggttgtggtcaccctcgtaggtaacgatcagcatcgaggggtcgtccacgcacctctcgacgtgcttcctcgcggggcagcctctcacgctgctacacttgtagtagcccctaggatgtggggatcccttgattggcttctgcccatacttcctccacgagaactcatcagctgggatgtctgcaaccttgttgcttactgcagggactttgatggacctccttatccttagcttccttttctttgaacaatggcaccggctcccggttgcgcactgaccactcccatcctccttcccagcgcaccttctcctttgcaccaggcccagctccggtgtgctagatgtctgagagccactaactagctggaacggcctgctggcccggcttccatccaagctcgcaagacttccttccatgctcagagacgaaaggaacgagcgagacgatgacgccgtgcaattggagctgtcaaacttgaggttcacacccttaccaccgcccccgccgccacttaagctaccaccctgctcaccaagattgctcctcttaaccatctcgctctgaatcttcatctgctgcatgagctgaaacctctggtagctttgctgctgctggatgaaatggaggtgtgcggcgggcaatgccggggtgggcatccctgagggaggcgcaacggacaccggctgaaccatccggaccggaggggctggcggcgaccacccctccagaccggcagccaggttctccagcagcaacctcttggggaactgcgcagggatcctgacaggatccttacacgacgagccctccatctggtggtacctcgggaacagctggaggccagtggtcgggctcggactggccacagttgcggcggcggccaccgcagagctgctctcgaggaagaggttgctgtcgaagatgggcaggggcttcttggtcttcctgaccctagcgtggccctgcaggccattgccgttggagctggagagcttggccgccagggagccgaacctggctacggcctccccggtggtggccacgagctccctgctggggacgagctggccgtgcgggttggagaggagccccagcacccggtggcagctctccactgccgtcctgttggcctcctccatcgcctccatggacggcgcgcctccctcgacgagcgaagcccgccgcgccgcgcctcgctggtgtggtggtgacgacgagcgagcgagagcgagggtggaggcctggaggaggaaagcgacgcactcgccctcggctggtagcctggttggttttacaacccgtggaccgtggtccgtct

SEQ ID NO: 23615 - DNA, 2048 bp, Zea mays
acgagcaagctagctcggacagacaagacttggctgtgcgcctggcccgcctgcagtttatttttgcggctgttaactccaaacaggctttactgtagctaagaactgtagaagctgccattgcagcagcaactctgaaactgagaaacgaacagctgcgccaatcctatcacgtcacgcgggcgaaaggtcaaaaacaaaactcttagcacgaaccagcaacagagaaatagcaggcccgtgaacccctctgatcccaccaaggccacaatcagaacgtctgaacccgcgacatgaagatgccaaactgtcaaaagcagcgtcagagttcagacagtggcgacacgcagaccgcagcaaaccggcctctcaaacggcagacgccccagtacaaatgccactgcacggatgcggcacgctgagagccggagccggcaaccggcaacccccatgcctcgcagcatcactggcgctaacaaacaacacgccacagacccaaaccactgcgtcaacaagattgtaccactggactgaagacgattgtacattctgttcctaggtgtagccacttttacaggcacttttcctgccttgtgctcttcttctcgatccaatcccctaacaccattaccagacatacaactgcggctcaatgtcacactgcaaccacaagatgggccctagcacaggacgaacacaaaagagaaaccaaaactacaaaactagagtatttgatgaggaaccctcctccccctttctccatcgacatgacaagtttcccccctgtcaccattgatttttctgaaagagctagctaactgactctctcctccaactgttagaagcagaacatatgtacaggcactaggctcttgttattgctactgtcgtcgttgtcatcccttctctagggagggagggagggtgactgtagaagcgatcttgaattgatagcctgaaagatcaggctggctgggctagaactcggttgtggttgtggtcaccttcataggtaacaatcagcatcgaggggtcgtccacgcacctctcgacatgcttcctcgcggggcagcctctcacactgctacacttgtaataacccctgcaagagggtggagatcgtcagtatttgcaatttacatatctgccacaggtacaagagagtgaattctgtccaaaagagggtgccagggggaacctttcttggattgcaacaggagtgctaccagaactagaacaggtttctaaccacatgcatgctcagtagtcagtatgcttatattgtaaaataggaaacaaaactgaataacttgatcagatgccaaacgacccaatgctataagcagcatctaaagagtaggggggacacttggttcagatttttcatatcagtaaccctttgtgtaaccctttgtggtgcctccactcgagatcatgcattccagaatacacaaaaggccaactcaacacatccgtatgtaaataaaatagcatcaagtcagtgggtacgactgcactataaatagcaaagcaagtaccagataaatataagcagactgagggggtgtttgaataaattagagctaatactacctccatttttgaatatatgtcgtccgctagttcatttttcaactaaaccgcgaaaaataaaaaataacggagggagtagttagctgctaaaattagctaaagacattcaaacaatctagctaatagttcggctattagctagttttgggaaattagctaatagttagctagctaattccactagcaattttttagccaaataactattagctctagtgcattcaaacacacctgaggccacgtttgaatgcacgaaagctaataattagttgctaagattagttaaaagcatcctaacagtatagctaatagttcagttattagctacttttagtaaattagctaataattagctagctacttgttatctagctaatttcactagtaactttttagtcaactaactattagctttagtgcattttaacaccccctgagaaacacttcacgttcac

SEQ ID NO: 23616 - DNA, 4401 bp, Zea mays
tttctactacaacgaaatgcatgtcaacttgtcaagttagcactactgaaacggaaacgtgagaggctgcagagtcctagcctgtttgacatcagtgtaactgccgatgaagtgtcactgtgtcagacttcagactggagccagccaaggcacaggcacgcacgaagaattgaagtcagatgcggtcatactgcacgtacatgacaagcgatacagttgctagtactgtctgatgtttttggtactgcacctgcactgatatatggagcagtgcactgcaggctcggttgcgtgcgttgtctccgagatccggtgaccagtgaggtacgcagatcctgctccaggcaggtacaatactcgttgaacatttgctttgttgaaaaatatacatcactatctcatttcaggatgaaggtcaccgttggattttgattggatgcaccagattgctcaatccacatttgttacatgaaccatccgaatagcaaataacgagtaacagtaattgaggcacgtattagcacagcgaagtgcaataatggctccattgaaaaacactagcatggtacgccggggaaacatgaagttcagagagatgccgagcaccaaataaacattccagccttccaggataggatgcaacgttgcaacagcactctggcagatgcggatgcagaatcacatcgaaatattggtacgacgacaaaataagggcgggcatgtttggatggcggcacgggaaagctgcctaagccagcaggcggtccaggccagggctgcatccaaacatgtcctaaaagactgaaaaacagatcatccaactgctcatcagtcctcaagtccttttactccttagtgaccctgccctggaagtagttcatacatgaatcctttgcttcctttccaaaccaccagattgaagtcaatagccagcatagttcattcacgttgtgaagccaccttcacaacagtatcaattatgagaacattaacgaacaaagttcacgatactacgatcatcaggagggaagaggggggggggggggggtcaaagaaaaagttctttctagatggaaaataccacaatgagaatatgagatgctccagttccaaatacattgaagtccagttcaaagaaagtttattccatccgtacagttagcaaactactaagagaactaatacgtacttattggtaatactaaaagcgtaacaaaacaccagcaagaaccaaacaagtgtgagacatcattagcaatgcaattcgtgattacaaccaaggacactagcactgcaactgcagttcagcctgctattctctatgctttagctggtagtttattagcatagacaactagacaagaacaccaacgcaaccgcacccttatgcgcttaaatttcagtggcatgtggcaaagcggagtaatctgactacaagatcctacagaaaacttattttttcacgcattcccaactgtactctaaactatagggcactaggccactagtgaattgaagtgtagaacaagcacttatcaatattgcaaagtccagaacaaaacatgattagtactcttatttcgcattccactcaaaccatcaaaccaaaagacatttaccaaattaccaaacgttggattgccagataagcaagtttccataccaaaccgggctctgcatcacatgagcaaccgcccattgtctgcaaaacatatataagaggtacggaaaaattggatagcaagtttaccatttcatatgcttggtagggacaatgacggtggaaaaccagtgtacagtttggcgtatagaagattcctgatgccacaaattttctcaacctgcatagactcgaactcaacagagaagtatcctatatcagcgccaggagtagaaggctccaggtgcaaattccatggaatcccacgaaggagtaagtgcttatccgttgcatctgcaaagctgaaaatatattgggacggcaacctgactctcctcttaacctgccaaaggttgttgccttcttcgcggattacctgaacagcatgaaccaggtaagatgcagcagaaatcatgctgttgtggagagtgaacattctgaatctgccttccgctgcctccacaatgacagaatcttgctggccgtaaccagacgggatatcgaaagaggagaacaccatggaacgcgtgtcgagcccaaggagtttgttactcccagtcaccttccagtagcagctgccgaaaccgtaggaggaccacgaaaatttgcaagagggaggcaccctgacatccacggtcagacttccccatcgcccggtgtccgaagagaagacgaaggcgaccagctgtccaggtttgcgctctgccacgcagaccaccctcagcgacgtctccggctcctcgttactggcgggaacgaggaacggctccagacggcggcagcgctgagtggctgggtgtccggggatacggggcagaaagaggtatcgccgggacacagggtcgcacaccgcaaagtcgccgcccatggtctcgctctccaggaggacgcggccgtcgcgggcgtcgatcgggatccagcggccggcgcaggggacgaaggagaaggagaggtctgcggccctctgcagagctcgcgcatagggcgcggaggggtggggcggctccgccgggtggactgatgagaagagcagtaagccgaggaggggcgccgggtggacggagcggaggcggcgcaggaaggtgctgtcggcgacgacgcggcggaaggaggcgcaggtggtggcggcgcgccctacatcggcgagggtgggcaggcggaggaaaatatcggcgaggaggtcatcgttgaggcgcaaaagcggggacggcggcaccaggacgttgttacgcttggcgccgggcagttccggcgaggccatcccgtattggcgtcgccggcgtcccgtgggccgtggcccactggccctgtgggcgggcgtgggtaggtgggagtgggatggagaattgtcaaataccagctcttggatacagtacagccagtagcagctcttgcaccttgaatggctccggactccggatacgaagttgaacgcaccttgaatggcttcggattggaagtattcttcttctctttgcaggacagcttcgtcacaatggcaagaagagggaatggtcgccaagacgaagaggacgacagtgatgccaaggaccgggcaaaggtgattaaagcatcttcggtggatggcaaggaccgagcgaagctcacgaacgttggaaagatatcaatgtcatgactgcttcggaagacatgtatagttgtctgtaaaaatgaccaaaataccatacatgaaatttatatacaatagagctaaccacattcattcatgtatcctagtacgatgttccagtattagtttaccaaacactagaatatcgagggaaggtgaattcctggtggctaaccacgactcggattaatacaacaaactagtatgtattgatggaataacattctctgcagcactgacccacaccgtcacccttgcggcactgcttcgatgatgaatgacacgcgtccaaaatcaacacctaatgatgttgggtaatcgagccattgatgacacggctaatcgagccggtcgttccttgaggcagaggtctggacgagcagctttgagatgtagagatagatacgtgtcattcatcaaagtggtgccgcacaggtgacggcgtgcgtcagggctacagagaattttattccgacactgctaccacggtttcaccttcaccacggctagtccgcaaaaaaatagtgtcaagcgagcatcgaacccatgcccctttctccaaaaatttgggactaactactagaccacataacttagtgtttagaaataaacaataattatatttgtagcataggtctctcctcatgctcccacttgtgccaacacacgggcacatagctagttatttattagatctagtgcattcagacataccactaatttaagtaattatccgtataaaatctaggttgcaaatctcgaaacccaactagccaaggcacacaacccccatttgccatgtactgtacgcttggaatggttcacctgagccaattaacccaaaacgtcgcttttgttcatttgagctggatgagggtggggaaatatatatggttgacgtgttagtacgtacgtagtcaggagaaacgtctttacctaggccacaccgtacccacatatagctaggggcacgatggcaggctaggtcacttcttttgtgtgtgcgtgtgtgtttgacccggatggtgcgttaggtgttgccagtctatcaaaccctggggcgcctagctttctaaaagcacgcagtttggatacagaccgtggttctgca

SEQ ID NO: 23617 - DNA, 1191 bp, Zea mays
taaccgtaaaatttttttttttttttcttggtactcctagctcagttcttcactacccaatcgttgaatgaatacaggttccgtcttgacatactaaatacagaaagaatgagaaaccaaggggcaaaatacaaactggaggatgaaccaagcacgagtggaaggaaagatctgcaccccgttgccatttcgtataataataactaggatgcaaacagcaaaagaaagaaaaatggagactagagcagaaatttcatcttcttcccccgagcgagccttttcccccacgtcggtctcaactcaacaacgcttccgttggctgcaaccttttcttgcatcttactacgcatcagccggcgcggacgagaagatgaggctcatcaggagccccaccatgagacctattagcccagcaaacgcggcgaacgtcaaggagaaacctgcatcgcctttgcggctcctgcgcctccgaagcacatccaattcacgttgcatttgctgattttgctgaagcacgttgtctctttcttctttcaaccgctgaattgtctggatctcttcaaggcttgcattcttcagcatcatcagatcatcagacgctgctttgaagctccggcttcctaaagatgatacgctagagtcatctgaacctccgcagctaggtaatgtgtagacaaccttgagcttcatttcctcgattaccttatcagcttccttgttgaacgtatcaggggggatctcatccatgtccgtactggcggccaccttcgtgctctgaatcaagaatttatccttgcattgcatgtctggtgggtaatctttctgtgcctgcagcgtaatcgttattgtgcaagaatcccatggctggacgatgctcgcgttcggccggacgaaatacttcctcggcgatgttgttttgaccttgaatgcgacatgatgctcgctgttgttcaccaccttgagattgcaatagcacggcttctccagctcaaacaagaaggtgagctcctcggggtaaaccgagatcagcgttccgctacctcccattgcaaccaccttgctttccaaaaactaattgcaagcaaaatagataaatcaacaaaaggcggcgatttggagaagtcgggaggggaggagaagccaggggcggaggaggaaagagagaaaccaatgggtctgcagtttgctttt

SEQ ID NO: 23618 - DNA, 2272 bp, Zea mays
  misc_feature (184)..(184): n is a, c, g, or t
tatcgatgttttgggtctcaattaaatccaaaccagttcaaaacatatccgataacagtcttttcctcctccttcctcggcctatgtcacttgcatccgtaggtcttcgagccgccgccggtctatgtccttgccaccgatagattcaggctcagttcatcccccaaccaaaccaaggaaccancgatagatgcatgcacctgtagctcctcactcatgctggtaaattcttcttctccttgtgccgtactactacaggtacaggcagcggggtgaccgaaggtgtgcggaggacgaagacgacgtggcacacggtttgggttctcgggtcgacgagcaccgcgacgaggagacaaatcccacgatgtagatcttgagacacgaaaacgaccggaagatggacctccacggtgaggtggacctcgccgtggcggtgagaggaggcgtacgtggacaaggtggtgcggtggccaatccaactcggaatgttggggctttgatagaggaggattcagcggtggtggtgcgcgcgacagtagggagcgaggaggtcggagcaggcgatggcgtggagcttgtcactccatcggtgccggtgagttctgcggagaggagctcctgacctggtcgctggacccgtggcgaagctgccactgtacactcgcagcacgtcggcgtcggtggacctgggctcgtcgtcggcgctgtcgttatggagctggccggtgcgatacgaggcgttcggcatcatatgtgccgctctggaacgccatggtgggtcatcgaagagcgtctgctaaactggcacacatgtcctcctccttttttttttgttgccctccttagcggttcaaccaggtctctttcagcccgtttgatgtaacaaagactcaaacagacatataactcttaatagacatactttatttgtttatataccagtttgacaaaggcacacagcgagacaagtttaaggaccgaaaatatactttactcaatcttcttttattactagataaatgcccgtgccttgctacggagtgaaaatacttaaaaatattgatagaaaagacatatagataactctatttcagaacataactattgtatttgtgtatgttcactaactcaatgctcccaattagaataaaccgaagtagcaccaaaggtgcaaagagccatccaattttgtcctgtagtgttgcatctagaataagccaattaatatgaacattgcgacaattacaaccgcatctgtcataaatggaagatattacaccaatcaatataggtaaagtaagttatactcctcatcagatcatgaaaaatagtacaccagattcaacaatgaaaacaatataaccatacagagaagggaaaaacacatgtatctcaagttttgattttgaaccttattccacttgctatagaagaactgcatacaacataaacaattattctgaatacatcagattgcaggagtaaggatcctctctccaggcagtgagggggttggccgcctcggcgacttcgatgacgacgtttggtggtgccaggcagctcgagcggccacgcgtcgaccatgatcttgacggcgtcgaagatgtcgagatcgtgcagccgcactgtagagacactggcggcgcggagcagctcggcaacctccgcctcgatgagatcgtcctacgtcctggtgtttcccttgatgatcacgtcgtggacgcggatgcccacgggtccgatgacagccgccgttgcacggactacatccgctctcgctctgccgccgacagaaatgttttcactgctgctgcaattaatcaggtagtttgcacttaattcaatggcaatggtttgagctctagtacaggtaggagaagaatgttctatcaaaacaataaagagacaaatcaacataggctttatataacttgaataaaaatgtaaaatgatcagatattcttggggaaatgcttggtgacacatacaaatatctagaaacaagttagatgcaaacaaattaatagctttataagcataggtccagtggaaatttagtgaatattatagggcatttgaaaagaaataaatgaacaaatgtgaaagaaagggactctgaggcacagaaaaaatgaattaagagtgaattcgctagcacattaattgttcatggaaaaggttataacagtagtccatgaactaaaatcataatgacactgtgaacacttagggatgagaaaaatgtcatccacacagtaaattaagtgaggac

SEQ ID NO: 23619 - DNA, 788 bp, Zea mays
gcggttcctacgcctccgaagcacatccaattcacgttgcatttgctgtttttgctgaagcatgttatctcttttttccttcacccgcggaattgtctggatctcttcgatgcttgcattcttcagcatcatcagatcgtcagacgctgctttgaagctccggcttcctaaagacgatacgctagagtcatctgaacctccaccactaggtaacgtgtaaacaaccctgagcttcatttcctcgattaccttgtcggtttccttgttgaacgtatcaggggggatctcatccatgtcggtgctggcagccaccttggtgctctgaatcaagaacttgtccttgcattgcatatctggtgggtactctttctgtgcctgcagcgtaatcgttattgtgcaagaatcccatggctggacgatactcgcgttcggccggacaaaatacttcctcggtgatgtcgttttgaccttgaatgcgacgtggtgctcgctgttgttcaccaccttgaggttgcaatagcacggcttctccagctcaaacaggaaggtgagctcctcggggtacaccgagatcagcgttccgctacctcccattgcagccgcctttccttccaagaactgagaggaagcaaaatagaaaaaaaaactaacaaaaaggcagcgatttggaggagaagtcgggaggggaggaagccagaggccgagcaggaaagggagtggctttgcagtttgccttgcttttcttggctccagcgacattgacggggcaacactcacttatggcccgg

SEQ ID NO: 23620 - DNA, 726 bp, Zea mays
catgtttttttgcaacgttgcactgttggcaggtgcgaagccttctcaacataccctaggacatacgacctgatacatggcaatggcatcttcagtttatatcagaacaagtgtgatgcagaagacattcttctggagatggataggattttacggccagagggtgcagtcatactgcgggacaatgccgatgtactgaacaaggttagaagtatggtggcaggaatgcggtggaagtccaagttactagatcatgaggatggcccgcacgttcccgagaagattctgatttcagtgaaagaatattgggttggcagcgaggaacagaacagctgataggtacagaaccatgttgatgctggatgccagcctctttccctgatgcgatcccctgatgctgttttgtcggttaatagattttgttcatactgcatacgtacagtactaaagacccttagatgatcgggacatacctggatttttgctgtgcatatatagtaatcagagcgttaagtgaactgttggcgatttgccaaggcatattgtagtgtaggcaaaagttcgttttaaaaacatgtaggtacgagacaacttactcgctactttgcccagagattaattatacagatgcacgcaagaagtttttcgtgatttcgtatatgaacattatctgttgataatgcatgagattatttcttcgaaaaaaaaaaaaaaaaaagcggcccc

SEQ ID NO: 23621 - DNA, 3788 bp, Zea mays
  misc_feature (1199)..(1199): n is a, c, g, or t
gagtttcgtgtctctgtaactgtattgtctgattgcaccctgacctgtttccaataatgtgcagtccctcagcttgtccagttaccgtcttggcatcttttaagctcgactgaattgtgttcaatatgcataaggttgatcgctggaacgagcaacggcaccttccctggacctctgtaatcccaccatgcaaaattactatgaactcacgatgttgtgccggcttctcttccttggtaactggtgccaatctaccatttttgaagctctctacagaataagagcatttttgcttatacagttcagaaaacgattcgtgattcaaatttggcttgcgatgcaatttttttgcactgtgacgcagcttgactaggcttacgatgcaaatttgatgcactgagtgagatcgtcaaagtagtcgtggctatagatatgcattatactcctcccgggagtttgacagggtcctttgtagggggctacaaatacttaggcaggacagcttaattttctccaaatacagctaagcttcatgaacttcaaaagtagagcggttcagctttagaattgtagaatttttaaagtgtttggattagagaccaaatttagcttcaaaacaataagactttgtgcttcaaaacaataagattttgtttggaaaattctcttttatacacttgaatgatgcaagagattgttttgtatatcaataaaaaaacagatctagattggtgagcttccccatacgagcggctcctccaccgctgtcaagcagagccaggccaccaccgggccgacgcgttagtcggccgacggcggctacgtcccgagactggctagcatgcgtcggaatacaccgcacggatcccctgtgccgccagttcatgcctggctaggccatgcaccgcccgtcaataggaatggaaacaaacatgaacaggtggaaaactctctgtctctcgttttcgttactatatttttttttatcaaaaatagaagtgggagtgagaaagctagtaacggatacggttgccgagcaaaaactattaagtacgaacgggaatataatggaaacgaacattaaccaggacgtttatatcgtttattggaatcacggggcgtgttcggcaggctgcaagccgacactgttgcagctgtttggactgctgcagctgcaatccatagagagaaaaatactntagaagccgcagccgcagccggattgcagccgctgcaggccgctgcgccccacccgaaacacaagttctactgtctttttgtctttctgtttttaagagcaacaacaaaatcattagttattaaaaaactacagcgattagaagatccactactgacacaaccagcctgcagcaagatgtctggtatgctcctcggatcccgttccagaatccaatactggcttcaagaatccaaccaaaatctattcaaggtggaacctttgttgcaagcccagctgaaaaatctcgtgttcagttcaattacgaggaattatatgtccaaagatgcaacctttgatggattcagtagttcggcatgggctgggagatcttgccctcctcgccaggggtggtgggagtccgccggtccgtggcgcggagccacagacacacggcggagaagctgagcacaaggctgagcagcccgctgccaaggccgatgccaacgatggcgagcacggagagcccccgcgtccgcatcggcggcagcgggtacccgtacaagcccttgttccctacgaaggagctggcgttgaacctcgccgtcccgacggctgccgtgccggcgccggagcggttggcgaggagcacggggatggggccagagaggcggttgtaggagacgtcgaaggtcgagagccggacgaggaggccgagttcctcggggatggggccggacagctggttgccatggagatctatgacgttgaggtaggcgcagctagcgagctcccgcgggatggcgccagagagcgcgttcgcggagaggttgagcacggcgaggttcagcagcgcggagagctccgtcgggatggcgccggacagcgcgttcgcggacaggtccagcgactggaggttggtgcagttggagagctccggcgggacggtgcccccgagcgagagatccgggagggctagcttgtacacgcgcccgttgttgcaggtcacgccttggaggtgcgagaagaagccgtcgcacggcgccgagatcgccgccttggtccagttgagccttccggaggaatcggagagggactggtggaggtgagtcaggcaacgctcgtcgttagggtcggcggcgcaaggaggcgctgtgaggaggaagagcacggcagcagcgatggcggcggcgtggtgatggtgacgggacatttggggacggaggtggtggtggggagctcactccgggagtggagattttgggggagcttgtcatctcttctctcctctgtcctctcctacttacctctcctcgcaaaaagaaagccgacatgtgggcctgtttaactcttcccgtgatcccgtcgcgcgcgccatcatttccacccgcccaatccagcccgtccaccgccgccgccgctccttccggccacctttcgttgtgctcctctgcttctcctgccaatcacatttcgctgtcatcctcggcttctcctagacgtgctgcacggccgcgtcgtgagcggcggctggaacaaggacaagctggcgcagcggccgcggtgggacgggaacggagcgcgaggaagcgtcggctgtggcggcggtgcgctggagcaggtgctgggcgtgctctgctgcgacggcgaaatattccaggccgcccgcggccagcgccccgctccgcgatgttttctggctccgtttcctcgacaagaagagcggagcaggtcaagcagcagcaagtacgtgaggactactgtggagcagcactatgggaagctggccctcaagctcaacttcctcaagcaaccattcagctaacgcaaacgaagaacttcttcaagctcctgtatgtccgccggccggcgctgacaagccaaggccgccaaagcctgctgcttcctctatcaggcgattgcctctatggtagtgattgcctaggggcatatcaaaaacatctgtacagaaacattgttgtgaacaaaagttaagaactgaatgatgtcccttgtgcaatattgaaacaagctccagatcgcatgagatacactcgactggttggtcagtgtggtactgaatgatgtgaaaatattttagcaggaattacctttttgttctagaaaggtagttcagtatggtattttagaattggttttattggaaattgttggaaatgatactcctccaataatttttggcgacttggaatcccttgattttgggaagaaattgttgggaactcttgagatgctctaattaattatcttctgtttggccgtattcagactggtcttgtaatggctccgttaagtaacaaagcattgtttgctgacaaccacgggaaccctttcccaacatttttcttaagacgtcttaacctgtctttttcaactgacgaccctttacaaattgtaacacccaaattctgaatttggaatagaaaatagaaagtaaaagagaagggaagaactaagaaaaatcctacataaaataaaataaaatcagaataaacatccttcacacttataatattaaattatactattcaaactgaggaccagttattcacaaaagtttgaatttaaacttgaactcaaatggattgaa

SEQ ID NO: 23622 - DNA, 3634 bp, Zea mays
  misc_feature (2658)..(2658): n is a, c, g, or t
  misc_feature (2738)..(2738): n is a, c, g, or t
ggttctgcaggttgctatttcaccaaggacaatttgatcaaacgcgtaagaaagtgtgcagtgcagcacaacacctcttctttgagtgcatgactgccaagtgcaagtatgtgtggagactttcggcgtacacttttgggtctaattgcagtccgggcaaactttggtcggtattggattcggattgacaatagttaaccccgtggcgaacaggtatatgccatggtcttacctatagtttattgggctatttgcagaacgagaaacgctgattgcttcgataacaaaataattaaagattatatgcatggcgtgttctttcatcaccgggcaagtctgcaaatggaaggcatgaaacagcaactgatcgaaatggggaagaagacatcattagtctttgttaaccctgctacacaggaaactactgtgttggcatcagacgacacaacgatggcaaaggagctggaagcagatgttcaagagtgttcgaaggagaagaacgaagtgcggctgcatcggcagaagcacgacaatgtccgagttactggtccagggtgggccatgtaagcgtgagttgggctgggccgttaaggaagtattataaagggacaatgtgcaaactgtaggggacatggaagaattaatgaatagaatatcaactcgttgccgtcacgagaccttcttcttccccacgtctccaatctttgctgcttccctcttccctgctctataggcttctagagggtgctaacagtcttccacaagatgatcgccagatggtctcttacgtggattaattgtgaagttgatgttatttgtggcctacgcgctggattgggcaggtgacctgtaatgcccactcatgtgctagcttgttgagggtgatcatgttacctagtagtgagtggtgacctgtaatgcttagacttggagaactgcatgtcttgacgaatacagcaacggctcaaaaagatgcatcattgaatgtttttataacaagactgaccacgaaaacaaacactttgtaccagcaagaaagaaaagaatgcaagatatattcgaaatgttaggttgacacatgatagactgacgtataaatagaattacggcaactatggtcactattctaaagaaccaaattcagagcacagactaccttgctgcaaccaacctatattaacaccacctcgtagtaatatattcccatcagaatatgacccagccaaatgtcagcaatatgtcaagggagacgccagaagaggcagccgacgaggaagagacggcgctgtccagcaaggagcagcagcggcagaccaagaaaggtgaaagccaacctgacttgcctgaagaccatgaagtggtgcagcaacatgaagaacaggagggcgacggcgacagaaaaccaaagccgtaagcgcggaaatgtgagagtaacgggccctgagtgggccatgtaatgtgctaagcgctgtgtcattgggccgagcccgtgtaagggtataagggtgactctgggaagaggattatggaaaaaccagaagaaactgaacatagacgaacaccaccgttgcctacatctctgcttcccttccagatctcatgctctcttcttccaccctctgcgtgtctaacaccaaggtgattcgcaattcgcatctgggttgctcgccaaaccaattccgagcatttttttttttttttttttcttactgacatctactagttataggtagaccgcatcaccaaatccacatgtgacagtgacatatcgaaccagagagtggaagctagaaaacctcagatgaagagcgctacaacactcagaaccggcgaaccgaagacctggggttgaccctcctcaccttggtggccatggaaacggcgccggacgcggcggaagccttcttcatctccttactgctcctgagcgaggacctcggccccaagtctccaccgcggcatgctgcgaagtcgacggctggcatagacctcctcacggactccgcgccgctggcggcgtaggccttcttggctacgcggcgtttggacagctcgacggcgacacaggggttctcggccatcgtctcggggtccactgccgcggacgcgaactcctcggaatagaaggggaagccctgcttgcgcttgagccgctcgttgcggcgcgccgagtagaggtcgtagagtctgccccgcacgaagagcgggccaccagacggcgtgcccgctgtcctggcaatcgcggcgaggttgagcgccactagctcgtcgtgggcgtccgcgccggccgggaggaggttctccttgtcgaaccccaccctcgccgagggggacgacggagccgcggcgaggaggaagttctccttgtcggccgccgcccttgccggaggaggcgacgacgcagccaggtcgagcttgacgcgacttggtggctggagcgcggcggtcacgcgcgcgcgcatagggctcggttcggcgcggatcggcgacgggagagcggagatggaggcgcgcatcgggctgggctcgaagcggaccggcgacgggatcgcgcagacggacgcgcgcatcggagccgccgccttcttcatcgatcctgcaggcggttgcgcggagcgcgccggatcgggagaactgaatcggcgcacgagggggggngggggggggggggcgattgggaatcagccggccatacctggaggcgtttgcacggaggaggctggcacgaggggcgggcngggcacccggggcgggcgcggagagacggcgagagcaggacggcggtccatgggtcggtcggtcggtcggctggccggggggaggagagattgcttctcggtctccggcgtccttctcgtttgctctcgggtttggaagacgaggcgaggaggcttttaagcggaggcgaagaggcggctcttccaacggtcgtcttgcgtcttgcagccccttttcaaaattggtcctgcgtgctgcttccgtcacgctcggctcggcccacgggctttggggccttccgatatgtgtggagtggcgcggtttatggcataataatcaccgcgatttacggtgtttatttgtggcatctccgcagctaaggtataatcgtaagttcgtaacgtattttttttgcatttatcagtgatttcttcaaatctcccttgaccagtgtagcagtactagctgttttatgcggaggtttggtgtgatggagaatatttctcgtatacacgtattcgtgtatttaataaaaaggtttttaatcttgttttgtttcatccgttctgaaataagtgggcatagtatttgtgccagtcaaactctcttagatttaactgtatttgtagaaaaatattatcaaaatgtttatctctaaatatgcttattatggaaatagattcaatgataatctatctaacaatattaattatatattataaattttgatgtttaatatatcatgctagagtaaggttagaacacaatgtttaatatagaaacctagagtttaatatagaaatactttacaaggtgaagagtggaactatctcaccgtctcttgtctatcttaattattaagaaacttgcccctgcctctgaatgcttatgaacatacggatgactggaggagaca

SEQ ID NO: 23623 - DNA, 1106 bp, Zea mays
tttttttttttttttttaggtagaccgcatcacaaaatccacatgtgacatatcgaaccagagagtggaagctagaaaaccaccaccttatggagatcacacacacctcagatgaagagcgctacaacactcagaaccggcgaaccgaagacctggggttgaccctcctcaccttggtggccatggaaacggcgccggacgcggcggaagccttcttcatctccttactgctcctgagcgaggacctcggccccaagtctccaccgcggcatgccgcgaagtcgacggctggcatagacctcctcacggactccgcgccgctggcggcgtaggccttcttggctacgcggcgtttggacagctcgacggcgacacaggggttctcggccatcgtctcggcgtcccctgccgcggacgcgaactcctcggaatagaaggggaagccctgcttgcgcttgagccgctcgttgcggcgcgccgagtagaggtcgtagagcctgccccgcacgaagagcgggccaccagacggcgtgcccgctgtcctggcaatcgcggcgaggttgagcgccactagctcgtcgtgggcgtccgcgccggccgggaggaggttctccttgtcgaaccccaccctcgccgagggggacgacggagccgcggcgaggaggaagttctccttgtcggccgccgcccttgccggaggaggcgacgacgcagccaggtcgagcttgacgcgacttggtggctggagcgcggcggtcacgcgcgcgcgcatagggctcggttcggcgcggatcggcgacgggagagcggagatggaggcgcgcatcgggctgggctcgaagcggaccggcgacgggatcgcgcagacggacgcgcgcatcggagccgccgccttcttcatcgatcctggaggcgtttgcacggaggaggctggcacgaggggcgggcggggcacccggggcgggcgcgggcggaggcggcgcggagagacggcgagagcaggacggcggtccatgggtcggtcggtcggtcggtcggtcggctggccggggggaggagagattgcttctcggtctccggcgcccacgcgtccgcggacgcggggg

SEQ ID NO: 23624 - DNA, 1235 bp, Zea mays
gccgggccccccctcgaggtcgacggtatcgataagcttttttttttttttttttggcaggtccaagacactttgtggaaacaaagtagcaggaaacaaagttggaagcaaatagagatagagatagatagagacagagagactatattgcaacagaaggaaacaagggtacaaaaaaataggcacgacaaataaaaatgagtaaccagctgctagtgttcccaaaactatgcacatatatctgaccgtagaatgatagaaacaactatctacgttaagaacataattttgaaggcgtcatgcatttctactatcttcttggcctgtcaattgctcacccttagataaaggaacaatgcagcaattctcgtaggtcttgacgtgatgcatttccaatatcttcttggcctgtcaattgcccaccctcagatacaggaatggtgcagcaattctcataggtctttccagaccttgtagtcagtatttgagctgttgggatttattggtgtatcctgacatcctaagaaaaaggttggtcgcacatccatattgatcaaggcatgtgcagtggatcttgcgctagcaacaatagcgacctcgtcagcagcaatcatggcttcgccatatccttcatcttttatgccagcattttccaacctgaattttgtctttgcgccccagatgacgaatgtttcattgcaagtgtggtgacgatggttgccacgtaaaccacctggttggatctgtccaacatgaagtagtaaacagaccagtgctccacctggaaggccagcgtcacgggcggcggcgacggggtccagtaaccacccgcgcccgtcgcgggcgatgggggtggggtagagctccgcggggaagcggacgagatttgcctggggctcgtgcacaacggaggggcggccgccgagcgacggtggcggcgaggggtggtggaagcggagcgagagccaggtgaggaggacgaagagtgagagaaggaaagggaaggacgccggccgcttcaggaagtggagcagcgacgacgccagagtgtgaggtggaagggcggcggcggtgctggggagaggcggcggctgcgtctggatgtgcagcgcgatggctcgcctcgggttcgccatcgacggtcgccgcacgcgaatcggaggtggcggtgctggcgagccgttcgtggggacgggtaacgggttgctgacttgccgccgccgcaatgggctgag

SEQ ID NO: 23625 - DNA, 2180 bp, Zea mays
ggaaccaccccccaggcttcgctccgctagagggcgaggacgccacaaaggacggcgaagtcatcgacgtttcagcagaagaatagctacagctgcgtgccatccgcatcaagaaccgcaacctccagaagcagaaaggtaccctcgaggccaagcgccaacgtgtctctgcgcaggccaaggtgcgccagatgatacgagacgaggagcagagggctcaggaactcgagcaagagattgcgctcatgcagcgcgaaggccaacatgatctgcagcacggcccgcccctccaacagcgcgcgccaatcggagacctattcattcctcagcgcggacccgtcatcccgcacgccgcagcattccaaggcatcaactaccttgatgagcggagtcccctggcgccgcaactgcaagtgtcaccatggcccgccaacttcagggcagggacctaccccaagtacaacggcagcaccgacccagcacagtacatcatgagctatcaagtcgttgtcgcatcatccggaggggacgacgccacgatggccaagtccttcatcatcgccctcgaaggtccggccctaacctggtacaccaggttgcccccgttgtccatcgactcctggagaagtctccgggacaaatttctgctcaacttccaagggtaccgcccagacaccgatgccttggccgaactgtcactctgcaagcaactggagaaagaaactctgcgggagtactaccgcaagttcctgactctcaagtcacaactgccttcggtcgacgaccaaattgccattcactacgccatcagtggccttcgggctagcgtcctttacagccactgcatcagggacccaccaaagaacctccaggagctctatcagctgtttgaaaaatatgccagatccgaagagctccaccagcgcaaggtcgagtcccagaggaaacccaaggaccctccgcagtccagccgaacgtggacaagactcttcgcagtcagactccggtcgggacagccgcagtcagcagcaggtgcataacattcgccagccggctccccgctggtgaggcccctcaccgacaagattatccccccagtttcacggcaatggcacgcgtggtcagggtcgaggacgggcacaacagccgtgcaaattttactgcctatttcacggtgaagactgcgcgcacccaacgagggactgcccggaaacgaaggccaccagggacaggatgtcccgagcacaacccactgacaacccaagagttgtcgccatacatatcaacaccacctcccacaaccatacaaccacggccccgctcagcatccacctaaccacgcatatcaacacaaccaggaggtacaaatcgtaccacctccgctctagcctccgcacccgcatcagccaaacatccaccaccccaaccacccccaagccccaaagcaagaagacttcgccgatcagccgtatcgcggagtcattcacatgagcactggggggtccagcgtcgacttcgacacgaagcgacagaagagggaccactaccgcagcatcaaccacgtcgccgtcaccggtccagtcgtgcagacaaagtggtcccatgtgccattgaccttcgacgcctgagacgtcgacctgcgcagcgcaccccacatcgacgccatggtcatcaactgcagcgtggcaggctgggacctgcacaaagtcttagtcgacaacggcagccaggcgagatatcattttcctccacgccttcgaccgcatgggcatcagccacagcttgcttaagccttcggacaacccactgtatggcttcggcggcaagggcacctttcctgtcggcaaaatagagctacccctctccttcggtgtagcacccaacgcacgaagtgagcaagtcacgttcgacatcgtcgacatggtgtacccgtacaacgccttaatgggtcggggctccatcaacaagtttgaggcagccattcacggactttacctgtgcatgaagatcccgggtccgcaaggcgcgatcacagtctacggcaaccagcaggccgcgcgcaacatagaaagagacttcgttcctagggcaaaggaacgtacactgcctcatggcgcagcgcgaggtccccgaggctaccagtccaaccgccaaagagaatgaaaaggcacaggggtacc

SEQ ID NO: 23626 - DNA, 1420 bp, Zea mays
ttttttttttttttctgaagcacatagggttggcattccttattaaaggatgatgatgatccgattgcagctacaaattattccttcttactccatacaggcctaccaatcatcctaatctcccagtcatcagcagtaacagatcgatgggatggaatggaacgctacattggtgtcgaagacagatgaaagaatgaaacctctatagcagcaaagcacagaacgaaccaatccacttccacacaatgcagcatcaccgatccatggatgaatatcaccatcacttgcccttctcctccttctcctgcgccgccttttcctccacctcctgcttgccgttggcgtcgtccatttccttgaggagcttgagcttgtccttttccttgtccttgtcggccctcagctcctcggcctccttgagccagaggtcggcgaactcgcagtccctgtagcgctcgaaccacggcccgccggaggtgtagtggatggccctggggcgcgtgtccgggtcggccgggtcgacccggttgtggcccacgaggaagttccaggcgaagggcacctccccgatctcgtcgtcgtcgagccaggcgaagcggtggaggaaggcacccgtctgggtgctgacggcctccggagtgagcgcggccacgttcttggggtggccgcagttgtagagcaccatggaggaccagttctcgcgcgggtacaccgtctggatggcgccgtccatcttggtggcctcggcgggctggtactcgtgcttcacgcaggctacggcaatgcggccggcgccggccgcgcggtcggcggcggccgcggcggcgaggaggtcggccaggtccgccaggtagaggaagtcgcagtcgacgaagagcgcccagccgcggtaccccgccaggtacggggtgaggaagcgcgtgaaggagaactcggtgctctccgtggggccgcgcgcccgggtgtacagccccgcggcgcgcagctccgcctgccggatcgggcgcacgtcaagcgggatcgatgagcgccggagcaggctgcggcggcacacctcgtacgcctcgtgctcccgcgggtcgtaccccacgaacacgcggaacggctcccccgctggtggcagcagcggcgttggatgcggcggcgccggcatggctggacgtgttgggggtggatctggtcggcggtggaatggaacggggcgctgggagggacgggacgggacgaggaggcagggagcgcccgggtcggcctcccccgctttaatggccgaggcacgggaggtggggtccaggctaaagatggcgaggagcgtgcgtgaggagggggggaatggggattcctcctcgctgccgggcggccgggctggttttcggtggaaaagttttcgattaggatgttctaggtaatggtctcgtgc

SEQ ID NO: 23627 - DNA, 1007 bp, Zea mays
cctctattttctttcttttttttttctttttttttttttttttttttttttttttatcacaagaacctgcacttggtcatcatgccaaattatctggacgacgattagttctagcaagctgcaaccgcaacagcgtgtgccaaggacagtgtcaataactcaaagatcgaatctgaatggaagtgcaaggttgatccatgcacggggaccagcccgggctagtacaagtcttcctccctgtgcgtctggatgacgcagtcggacgtcgggtacgcgacgcaggtgagcgcgtacccggcaccgacctgcgcctcgtcgaggaacgactggtctgcctggtcgacggagccctccaggagcttgccggcgcacgtggagcacgcgccggcgcggcaggagtagggcaggtcgagaccggcctcctcggccgcgtccaggatgtagctgtcctctggcacgtcgagcacgctctcctgcccttcggggccgaggagcttcaccttgtagacagcggcgacgcgcaggtctagcctctctctcaagctcggcgacgtcggcacgctccttgggaagcccaagtgaagcggccgttttgtgctgttgttcagcagaggggccttcttctgttcgatggtcctgaagctgcagagaactggggatgatgtgaaggttgccattgccatctttgggtgttcgatacctcgcaggcgcgcgggcactagggccagtctccggtgcaggcgaggcggcgagagatgggtgcggaagatttggaatggtcacgccggcttgggactacagtggaagccgctgctgctgaagcgcggaggctggcagctggctctctcggcttttaaccgtagcggcgcatggcacccgtggccggtggcccaccgcccacgccaatcgccatacctgcctgccggttgccgcggcgagcggcgtgctctggacggcgcttccctcgtctggtccgctcgtgaaatcgtatcccggccggcctcgag

SEQ ID NO: 23628 - DNA, 887 bp, Zea mays
tttttttttttttgttgggttttttttttttttttttttttttgttttttttaaaccaaagcaacctacacttgaacaataacgattaaagaatgcactactagttccagctacctgcaaggacaaaagcacaagtgcgaatcagtgtcaagaactcaagatcgaatccgaatgggagctatggaagtgcacagtcgttgatccggttacgcgtgggactgggctgcctagtacaggtcggcctccctgtgcgtctggatgacgcagtcagacgtcgggtacgcgacgcaggtgagcgcatacccggcaccgacctgcgcgtcgtccaggaacgactggtccgcctggtcgacggagccctccagcaccttgccggcgcacgtggagcacgcaccagcgcggcaggagtagggcaggtctataccggcctcctcggccgcgtccaggatgtagctgtcctctggcacttggatcacgctctcctgtccttcggggccgatgagcttcaccttgtagacggcggcgacgcgccagtctggcctcgctctgaagcacggcaacggcaatgttggcatgctccttgtcgttgggaagctcaggcgcagggacggctttctgctgttggtcagctgaggcgcgttcttctgttcgatggccatgaagttgcagaggagtggtgaggcgaaagttgccatcttggggtgttcgatacctcacacacgcaggttcgcgggcaatgggaccgattctccggtgcaggcgcgaggcggcgagggatgcgtgcggaagaaatggagaggtcacggcggcttgtgaattgggatgggatacggattagggtggaaattgaagcgcggagggccggctctatcgctctccccggccgg

SEQ ID NO: 23629 - DNA, 2505 bp, Zea mays
  misc_feature (2500)..(2500): n is a, c, g, or t
aaatatattgtgattacagatttcgatccttcactcagtcgactcagatcttccaaaaacgtcattcttttgcaaactagtaagtacatattttttggacagggtactaacatgtttagcagaagcacaaagtgtaggcgattaggtaggttgctccgtcagcactcgtccgtcgggctttccttctttccgttcttctctctcccacaggccaccgccaaatttagctttgaaatttaacaaagttaggtcagtgttcaacttcaaccagaaaagcactcaaattatcctaataaaggcgcagactttacagggtgtatctctttctttcccttttaaaacttaaaaacttttaattacatggcgcatcagctcaggcccgaaaccatctgttacaacaaaacattattccgactgtatgattgtatacaggcacctcgcattaccagcggccgttggcatggcggcgccacaaggagaccccgttcaccccacctcccaggtactcacccacctgggggtggtatccatttgtgttgaccccaaggctcaccgatggactggcagagccattcagccaaggcttagaagcactcacgtcagacaggccattagagtagatatccaacgagggaaactgccgttccctcaacccattgacagcattcatgtcataagcccccgacaatccaccatcgtacttgggtgaattgaaccgagcgggacttctaacagaagccatttccatgtctgacaagtttcctctcggtgaaaacggcaggccaaacacgttgtagtcttgacgaaacgactccggtatactgccgttgatctggtcctcctcaagcaagtcgtttatgatgtcaaggtgtggaaattcttctgccactggcccctgcggttgatgccatacatgactggcgggtgtctcggtttggaactgctgcctagcttgcagtcctgcatgcctgctgaacttttctgttcctctgctgcatgcttgctgataagtatcgtccctccgagactgctcatatgcttgactgttggtcatttgttggtaaggagcgtggtccctccagagatgcatatcaacattactgtcacctttccactgctgccagccgtcatgtgcttctaacttaccaggcccagacttgaatccatgcctagctgatgactgatcagatcttcctgcaggaggcatcatgactgtacttgatgcatatgctgatagaggccgtgaaggagcagtgtcttgatccagagaagacggctgatacgcaaggcttgcggaggtcatagacagaccagacttaccaattattgcattccggtaggtctgtggagtataagatggggcagaaaatgaaggatcatttactggccttctcccagctgcttcactcatagagcgggaaagcaatgtggaagtttgaatatgtgaagcagctggcccggttgatcttggtgtgggtaacacaggagcacttgaaggcctccatgctgcagcagcctctgaaagtgaggtggtggttgtgaccttcctagtagttgccccttgagcttcagaactagtagctggagatatatgtgactgttctgaagaaggcagagcagccttatcatcttgtgataaccttggggcggctggagtaaacttatcaatctgcagcgacctagaaggaaaaagcgcatctttagcacctgataatgattttggcagagctggagaggctttatcaactggtggagatttgggagcaattggagttgctttatcaatggctggagattttgggcgaactggagttgctttgtcaactgctgcggattgaggacgaactggagttgctttgtcaactgctggagattgagggcgaactagagtggctttgtcaactgctggagattgagaacgaactggagttgctttgtcaactgctggagatttgggacgatgtggagttgctttgtcaactgctggagatttgggacgggcctgagctactttgtttaccaacggagatttttgaggaactggagtagctttatcaaccgaaggtagctttgagggaactagcgttgctttatcagctgaaggcagcttaggaggaactggagcagctctattggttcgtggtgatttagaaggaagagaggcatctttatccatatcagctggatgtgatttggagcaaggagatgccatggtgactttcattttcaaacttgatccattaactttgtttgaaactgggtccatttttgttgtggtgggagaaggcacaggttcattgtttgcagtgactggtatgcctgaaacagaatcctccagaacagggttgaccacagatgcatccttctttggtgttccattcactttaagatcaacggtatcttctgatgaatgcaccgggatctctggaacatcaggtggcttatccacccggccggccgcgtcggaaggttactccttcgcttgttgcgtgccctagcnccggg

SEQ ID NO: 23630 - DNA, 2480 bp, Zea mays
ctagctgggagagagctatccgtgaaaaaaacttaaatatgtttagttaaaataaatatagattctatagaaacgtgatagtccgtaacatgaatgatatgaatctaagataaaagattattttgaactaaacagtaggaatctatatattttcataaatctgttatatctatttgaagattctagatttttggtattgaatttggttcaaaagaagaaccaaacaagtattatgatttgagattgactccaaacaaatatcgcttgagtgatgtaaaaagatatcatagctgcgtcatgatatttaactatagtatttaaaaaccatgatttttaaatactttacttgcacttattttgcaccatcgctataaaattttaaaggctagtttaaaaactcaaatcttcttggaattgaagggagccacctgaatcccctcgagtcctaaaaggatttgagtttctaaagtacccctcatatggttcctttctcccaccggccaccgctaaatttagctttgaaatttaaaaacgttatagaacagagtttaaccagagaagcaatcaaattaaccaaatcacggggcagattttgcagcatgtatcgctttctttcccttttaaaacttaaaacttttaattacatggcacatcagctcaggcccgaaaccatttgttacaacaaacattattccatctgtatgattgtatacaggcacctcgcattaccagcgcccgttagcatggcggcgccacaaggagactccgttcaccccatttcccagactggggtagtccgcaacctgggggtggtatccatttgtgttaaccccaaggctcatcaccgatggactgggagagccattcagccaaggctttgatgcactcacgtcagacaggccattagagtaactatccaacgagggaaactgccgttccctcaacccattgaccgcatttatgtcataagcccccgagaatccaccgtcatactcatacttggttgaattgaaccgagcaggacttctaacagaagccattcccatatctgacacgtttcctcttggtgaaaatggcaggccaaacacattgtaatcttgatgaaatgactctggtatactgccgttgatctggtcctcctcaagcaaatcgtttatgatgtcaaggtgtggaaactcttctgccacttgcccctgttgttggtgccagacatggctggcgggtgtctcggtttggaactgcctagcttgcagtcctgcgtgcctgctgaacttttctgttcctctgctgcatgtttgctgataagtatcgtccctccgagattggtcatacgcttgacccctggtcatttgttgataggtagtgtgatccctccagagatgcatatcaacattattatcacctttccactgctgccagctgtcatgtgcttctagcttaccagacccagacttgaatccatgcctagctgatgattgatcagatcttccagcaggaggcatcatgactgctgtgcttgatgcatatgctgatagaggctgtgaaggagcagtatcttgacccagagaataggactgatatgcaaggctttgcagaggtagtagccagaccagtcttaccaattattgcatttcggtaggtctggggagtataagatggggcagaaaaggaaggatcatttactgaccttctcccagctgcctcactcatcgagcgggaaagcaacgtggaagtttgaatatgtgaagcaactggtgcagttgatcttggtgtgggtaacacaggagcacttgaaggcctcgatgctgcagcaacctccaaaactgagctggctgtgaccttcctagaagtagttgccccttgggcttcagaattagtagctggagatatatgtggctgttctgaagaaggcagagcagctttatcaacttgcgataatcttgggggggggctggaatgaacctatcaatttgcagcgaccttgaaggaacaggcacatctttagcacctgatagtgattttggtggagctggagaaatgctctagcaaaatgcaaaaacagaacatagttacagaaatgaatcggttgacattaactaagaatctgagcattccttatgtaagctggaaaataagaaccagtcaacacatccaatcgaggtatcatgattcaagattttacattgacacaggtttcaggattaaggctatccttgcatttaggctatcatgaaacctatcaccattgacacatgtgatttatttctaaaaaatgaaaaacaaagcaatgactgggtgaagctcaacaggagccacgctcaaatatagatcaaatcaaaagagattggcaagctaggctgaccatgcaccacgattaatctgctcaaaactgaggtttcaagtattagctctgcattatgtcttgggactaagaattatcttttagtaagagaagggttccatagaagcagaggaaatat

SEQ ID NO: 23631 - DNA, 705 bp, Zea mays
agtccatggttgcaacattcaagcagtcggcacggggtctcagtccgctgtttgagttctgcagaaagaaggtccttcctgatgacatccgtcgagcattgcttgttattgtcaagtgttgcatgaagcgagattatttagcagcaatggaccaatatatcaagctggcaatcgggaatgcaccatggcccattggagttacaatggttggcatccacgagcgttctgcccgagaaaagatctacacaaacagcgtcgcccacatcatgaatgacgagaccactcgcaagtatcttcagtcaatcaagaggctcatgacgctttgccagcggcgttaccctgcactgccctcaaaatcagtggagttcaacagcctggcaaatgggagtgacctgcaggcgcttctatcggaagagaatggttcaggtaaagcttccgaggaaaggctccggttgatgccagcatcaaaagagtgatgccttcgcagactagattggattacaagtagagcttgagatacttgtgtaatatatacaatcaatcctgcctgtttttttttcttttctgtttgtgctgaagagaaaagcaacagagttatgtatgctaattaaatcgctttaccgcgacatctaatcgggcaaagtttttattaatatattccggagaaccactttttactattaaaaaaaaaaaaaaacaggccaa

SEQ ID NO: 23632 - DNA, 864 bp, Zea mays
attacggtcagtgaaggacgggggagagcagcgctaccgttccgtcgagggaggctgtcgcgaggaggcgcccgcagggggagaaccgcaagcaggagaccgcccggctgtggggcgtcgcctccctcacctgcctatacggccgatatggcggcgccggcgccggctgctgcgacatggtcggtaacagacttgcacgctttattagtctgcccacaacacgatccaagttgggtcgagtcctcctctatttgggggaacgcgtacacggccggtatccgcagcaccggcacggtgcaccgcctctcggagaatcgaagccgaactggacggcgggcgtaatggatctgctgaagcgggaactggagaagaagcggaaggcggcgacggccgacttcgggggcaagagcttcgtgcggcggtcggagctggagcagaagcagctccagaagcgccgcgaagagcaccgccaggtcctcgccaaggccggcacgtcggcggtctccgcgaattccgccgcagctgctaccggttccgaccccagcaacctcgacgccgcagctcagacggcggcggcgaaccctaaccctagctcctccgccgccgcctcctcctcggcgccctccgtcccgcccgccctcgcgccaaagaagaccgcgcaggaggaggcgctgctctccgaggagcgtcgcatcgatgagctcgacctcccacggcacgaggtggtgcggcgctgttaacactactcccaggataggccggatgggtgagagcgaatcgagagttcgtgggcggacgcgtgggcggacgcgtgggcggacgcgtgggcggacgcgtgggcggacgcgtgggcggacgcgtgtg

SEQ ID NO: 23633 - DNA, 4827 bp, Zea mays
cttgatgatggttatctatatctaacgggccggcccctcccatataagtctgcccggaccgccgcaggaacggtcaaatacgctacacggcaggtatccgcagcaccggcacgccgcaccgcctctcggagaatcgaagccgaactgggcggcgggcgtaatggatctgctgaagcgggaactggagaagaagcggaaggcggcgacggccgacttcgggggcaagagcttcgtgcggcggtcggagctggagcagaagcagctccagaagcgccgcgacgagcaccgccagctcctcgccaaggccggcacgtcggcgccctccgcgaattccgccgcagctgctaccggttccgaccccagcaacctcgacgccgcagctcagacggcggcggcgaaccctaaccctagctcctccgccgccgcctcctcctcggcgccctccgtcccgcccgccctcgcgccgaagaagaccgcgcaggaggaggcgctgctctccgaggagcgtcgcatcgacgagctcgacctcccacggcacgaggtggtgcggcgcctccgcgtgctgcgcgagcccgtcacgctgttcggggaggacgacgacgcccgcctcgcgcgcttcaagctcgtgctcaagtccggcgtcatcgacgacattgacgacatcgacatgaccgagggacagaccaacgacttcctccgcgacatgatcgagatgcgtaagcggcagaaggccgggagggacacctacgccaagggcaagagcaagcgtgtaggtggggggtgatggtggcgacgggggtgctgctggagacagtgcagatgatggggatgccaaggggagcggcgatgatgctgacgcagacaaggactccaagaggatgaggaccaagtttgaggagctttgcaatcaagacaagattttggtgttctttaagaagctgcttaatgagtggaaccaggaattggatgagatgactgagctagagaagcggacagcaaaggggaagtccatggttgcaacattcaagcagtgtgcacggtatctcagcccgctgtttgagttctgcagaaagaaggtattgattcttatgcaatttccatctgttggttgcttaaattgtgctattaatttgattgcacttcaaattgacacaatcattcaaaactctaatcagtaaactgagtagttagtctgtaccatggcaaacatttacgatagacatgtaacgtgttacttttattctgaataccatgctttcttgaaagaccatttcgttctacatttgatgttatgttgtctgctacccattgtatattgtgcaagtataataaacactacttctgtatacctccctctcatgcatgctagtatcatattctggttgtcatatatattttatgataaaaaaaacttgactttgggggagggggggaggcggagggagagacagcccccgggcatcttttgtgttcttagttttgcatttgttctgtactagtgcagattctaattctggcatactatgtccccaagtttgtttttaaatggaattacctagtgtgtaggattgcaattcagctgagcaatcaactaaattctagttcgtcactgagattcagatttgatataactaatgttgtctcacgaatcacgatagggcatagcaagcttcttggaaatatcatcccgctttctgcttgagggaaacactgatgctcatctgaatattgattatgcttataccgttcacaactaatgtcattacagcctttcttcaagtttcttggtgcttcactgattctgatgcatgtatggctggatccatttttaggtacttcctgatgatatccgtcgagcgttgcttgttattgtcgagtgttgcatgaagcgagattatttagcagcaatggaccaatatatcaagctggcaatcgggaatgcaccatggcccattggagttacaatggttggcatccacgagcgttctgcccgagaaaagatctacacaaacagcgtcgcccacatcatgaatgacgagaccactcgcaagtatcttcagtcaatcaagaggctcatgacgctttcccagcggcgttaccctgcactgccctcaaaatcagtggagttcaacagcctggcaaatgggagtgacctgcaggcgcttctatcggaagagaatggttcgggtaaagcttccgaggaaaggctccggttgatgccagcattgaaagagtgatgccttcgcagactagattggattacaagtagagcttgagatgcttgtgtaatatatacaatcaatcctgcctgtttttttttcttttcctgtttgtgctgaagagaaaagcaacagagttatgtatgctaattaaatcgctttaccgctacatctggtcaggcaaagtttttattaatatatctgccaattccggagaaccattttttactatttatcatcaagcagcagtcatgcttactgtattaatcaggtttggtgctatcctagttgtgtcagtaccgcaactgataagatctggaaaccatgctgcatttatcgcatgattgtaatttcagtcaccacaccacgtgccaaaggtttatgtacaacattgaaatccatggatttatctcatctgaagctaacaacgtggatcaggtcgcaggtaatctgtttccctctctttgcagcgtgcaaatctggaaaccgcgtgcagcagcagcagatccatcagcctcccgtcttctggatcctaggtaagtgagcccactgcagtgaaggaaccaatatgatagcttgctaacaatgtgaagttttgatggataatggtttgatgaacaatatgaatggataatggttcgatgaacaaataatccaaaaactagttgaggcagatcagaatagtctggggagcttgcagtccgctgaagaacgcctacattcttagaagcagcgctgaaggcctccttgtgggtgatgcccgggtctcttgccttaatcctctgtatctcctccctgagtaacaatcagatgagcgcatattaaagatctcgtcgtctctaccagagtagcagctaaaaacatgctgaaatttcaatcacaatatatatataaccagctgttggttttatagtcaacaacgctaacagttcttatgcatttgacctgtatgagtgtatacccgaagcatgcgtgtacacgatccgtatgtctcgtaaactattgtacgcaaaatgctgactatgagtgtgtttggtttgaaaaataaagtaattcatcttcttctcacttctcatttttttatttggtttgtggaatagaatgggttgatctatcatcaccccattcctcataagctaataattagtatatatatgaggagtgagttgattacaccaaaattaatggaatgaacttataatgcatcacctcatgaagcatagagtgactccacaaaccaaacaaaggcattcttacttgatgaagcaattgtaggccgacggcgtccgttgcttcctaagtggagctgcgaaatgtttcaaaagcacatgcttgcttaagtacgaacgatgagaagtgccaaaatatcagtggaggcattgttaaaaccgcgcgtgtgatcacctacgtttgttaaccgcagggaaggcggcatggttgtcggcaacggtagcagcctccgttgtctccccccggtcctctccgctgctctcgtcggagtccctgggcggcggatcaacgccgccggcctcctgtttcatcgaacgggacgcgtcgtcgtttgcccaatgagcgaggacgcgcgctaatgcaaagggagggcagggcagggcacggtgggaacctgcatcaggggaagcagctcgacggacgccggcgccggcgcctcgtcgggcggcagcgcgacggagaggatgccgcagcagcttccgcactgcacggccaccgtcttcagcagctgcaggctgccgccgatcggcacgcccacctgcattgcatgcgtaggcaggcaggcaggcaatcgtgcgcgccgtacgtgagaccgtgtgtgggcattggcggtttccggagcatgcagtgcatacaggtcgttgttaagttaccagcaggatggtggcgcagaatttgcactgcacgtagccgaggcgctccgggagggcggcgccgaagcaagggtggcgtggcgacgacgacgacgacatggccgtccgtccgccgttgagctccacagcgcgaagcagcaaagagcggggtggtggtgagtggtgactggtgagttggtgacaggacagacagtgtagggtgtcaccatgggggtggtgttcaatagattttgtaggcggcagccgggaacgacgacgataaactaaagacgcagcctggcctgtaatccaacattacgtttgcgaaaccgggcaagttacgtgcgcgcgcatcgcatgtgctcgcggcatgtgagtggcagcgcttccaatcaatgaagtgatcggaacttcccatgcaagtgccccggacaggcagccatgcccatctctgcgtatttcgggtacaggccccgccctggccccggcccctgtttctagaggccacaagagggcctcagcctttcaggggaaactttttaatctggcgaaccagacgctgggcatgtgagaatcggcgccttatcgcagtcgcagtcggcctgcgcactgttctgctctcatcagaaatccatgctgctgcgagagtcagccactgagccaccacactgactgccataaaggtcttgcacggcaattttgctccatggcaggtttgttaaaaaaaaaaaaaaaaaacaagggga

SEQ ID NO: 23634 - DNA, 760 bp, Zea mays
ggaaaaaataaaaaaagctagagaagcggacagcaaaggggaagtccatggttgcaacattcaagcagtgtgcacggtatctcagcccgctgtttgagttctgcagaaagaaggtacttcctgatgatatccgtcgagcgttgcttgttattgtcgagtgttgcatgaagcgagattatttagcagcaatggaccaatatatcaagttggcaatcgggaatgcaccatggcccattggagtgactatggttggcatccacgagcgttctgcccgagagaagatctacacaaacagcgtcgcccacatcatgaatgacgagaccactcgcaagtaccttcagtcaatcaagaggctcatgacgctttgccagcggcgttaccctgcactgccctcaaaatcagtggagttcaacagcctggcaaatgggagtgacctgcaggcgcttctatcggaagagaatggttcgggtaaagcttccgaggaaaggctccggttgatgccagcatcgaaagagtgatgccttcgcagactagattggattacaagtagagcttgagatgcttgtgtaatatatacaatacaatcaattctgcctgtttttttttcttttctgtttgtgctgaagagaaaagcaacagaattgtgtatgctaattaaatcgctttaccgctacatgtggtcgggcaaagtttttattaatatatcagtcaattctggagaaaaaaaaaaaaaaaaatgcggccaagcagcagccatgtt

SEQ ID NO: 23635 - DNA, 1803 bp, Zea mays
  misc_feature (1732)..(1732): n is a, c, g, or t
tttttcctcgtcgccggcaagtcgagtcgagtcctcttctatttgggggaacggtcaaatacgcgtacacggccggtatccgcagcgccggcacggcgcacctcctctcggagaatcgaagccgaactgggcggcgggcgtaatggatctgctgaagcgggaactggagaagaagcggaaggcggcgacggccgacttcgggggcaagagcttcgtgcggcgctcggagctggagcagaagcagctccagaagcgccgcgacgagcaccgccagctcctcgccaagtccggcacgtcggcgccctccgcgaattccgccgcagctgctaccggttccgaccccagcagcctcgacgccgcagctcagacggcggcggcgaaccctaaccctagctcctccgccgccgccacctcctcggcgccctccgtcccgcccgccctcgcgccgaagaagaccgcgcaggaggaggcgctgctctccgaggagcgtcgcatcgacgagctcgacctcccacggcacgaggtggtgcggcgcctccgcgtgctgcgcgagcccgtcacgctgttcggggaggacgacgacgcccgcctcgcgcgcttcaagctcgtgctcaagtccggcgtcatcgacgacattgacgacatcgacatgaccgagggacagaccaacgacttcctccgcgacatgatcgagatgcgcaagcggcagaagtccgggagggacacctacgccaagggcaagagcaagcgtgtaggtgggggtgatggtggcgacgggggtgctgctggagacagtgcagatgatggggatgccaaggggagcggcgatgatgctgacgcagacaaggactccaagaggatgaggaccaagtttgaggagctttgcaatgaagacaagattttggtgttctttaagaagctgcttaatgagtggaaccaggaattggatgagatgactgagctagagaagcggacagcaaaggggaagtccatggttgcaacattcaagcagtgtgcacggtatctcagcccgctgtttgagttctgcagaaagaaggtacttcctgatgatatccgtcgagcgttgcttgttattgtcgagtgttgcatgaagcgagattatttagcagcaatggaccaatatatcaagttggcaatcgggaatgcaccttggcccattggagtgactatggttggcatccacgagcgttctgcccgagagaagatctacacaaacagcgtcgcccacatcatgaatgacgagaccactcgcaagtaccttcagtcaatcaagaggctcatgacgctttgccagcggcgttaccctgcactgccctcaaaatcagtggagttcaacagcctggcaaatgggagtgacctacaggcgcttctatcggaagagaatggttcgggtaaagcttctgaggaaaggctccggttgatgccagcatcgaaagagtgatgccttcgcagactagattggattacaagtagagcttgagatgcttgtgtaatatatacaatcaattctgcctgtttttttttcttttctgtttgtgctgaagagaaaagcaacgaattgtgtatgctaattaaatcgctttaccgctacatgtggtcgggcaaagtctatactatacttaaagcaccagtttcaacggcaaaaaaaaaaaaaaaaaaaaaaaaaaaaaaaaaaaaaaaaaaaaaaaaaaaaaaaaaaaaaaaaaatttnaaaaaaaaaaaaaaaaggggccccccaacccccatttttttcccctttaaggagggtaaaatgcccccttg

SEQ ID NO: 23636 - DNA, 834 bp, Zea mays
gcacgagaccattacctagaacatcctaattgaaaaatggcatgcaaaccgtctcctcacttcctcagtcctcatcctcactcgcagagtcgcatgccaagaatgatgtgccgagtggcactcgccgccgtcctcctgtgcgcggccgcggcggcggccttggggggcaagcgggcgcccatcccggacgacctgcgcgacgtgatagacgacgaggaggacgacgagtggcgccgttatggcgcgcccccgtcgcgaggcccgggccgtggcgacggcccaccgcctgacctttcaaggatggatccagccgccctccaggacgagctcctccgcggccaaaccggcccgtcgttcggcttcgtgaagctccgcccgggcaccgcccgctcacaggaggatgtggtggggatcgcgacgaggtggagcaatgtgctgcggacgggatcggtggacgccaaattcgtggcggttaattttggaacgctcatgttcaccatggagagagggcgagacatactcgagctgaaggagtttatcctgagtcaggacgaggcctacgagttcaaggttggcgatcgggttttccgcaggcctggagacccacccctggaccaagttcttgataagccacagaaaaagaagcgtcataagtctagagacgaactgtagattcatttgctaactaatctgatctacatgtcctgttctttttgttcgctccttcgttctttctctttcgtctacttcagttttgcttccatagcagttttaccttgcgcaatctgacaaaaatcacaggcagtgatcctccttgcaaaaaaaaaaaaaaaa

SEQ ID NO: 23637 - DNA, 957 bp, Zea mays
ctcctaagggcgattggttccctcgaggccggccgggatcttccaaattttactcgcctcctgtacctctctcccgtgtgaccatcacaacaaaaataaaatcaataatagagagagaagaggtagcaacaccggctgcttaatctcttcttttccctcctctttatctccagcgcatcgtaaagggaggagcggagcggcgaattcttgtggtttcccaagatgtcttctccaagcaagcgccgggagatggacctcatgaagctgatgatgagcgactacaaggtggatatggtgaacgatgggatgcaggagttctttgttgaatttcgtgggcctaacgaaagcatttatcaaggaggtatatggagggttagagtagaactgccagatgcgtatccttacaaatccccatcgattggtttcatcaataagatatatcacccaaatgtcgatgaaatgtctggttcagtctgtttggatgtcatcaaccagacatggagcccaatgtttgatcttgttaatgtgttcgaggtcttccttccacaacttctgttatatcctaatccttctgatccattaaatggagatgcagctgcgttgatgatgcgtgatcgccctgcttatgaacaaaaggtgaaagagtactgtgaaaaatacgccaaaccagaggatgctggtgtcagcccagaagacgagtccagtgacgaagagctgagtgaagaggaaaatgactcgggtgatgaggagataatgggcaaaccagacacatagtcgagttggaacctagatctgtaatctgcacacgatgtttattgcagcaagtgcaattaaatagtccatggatgttcccgtgcagtctgaatgccatgtaaataaactgcaatttcatgttcgctaatcttatttccatctccagttgatcaattgaatttccagcatttttggttcttaatc

SEQ ID NO: 23638 - DNA, 1354 bp, Zea mays
cgtcaacttgtctcttggatcggtgcctttcctccgtgatttactcactcatctcatgccaccctctcaaagtttcaaccgtgtgcccatcgcaataaaaataaaatcaataatagagagaggaggtagcaacaccgactgcttaatctcttccttttcctcttcctatctccagcgcatcccaagaggcggaaagggaggagcgtggagcggcgaattattgtttgtttccccaagatgtcttctccaagcaagcgccgggagatggacctcatgaagctgatgatgagcgactacaaggtggagatggtgaacgatgggatgcaggagttctttgttgaatttcgtgggcctaacgaaagcatttatcaaggaggtgtatggaaggttagagtagaattgccagacgcatatccttacaaatccccatcgatcggtttcatcaataagatatatcacccaaatgtcgatgaaatgtctggttcagtctgtttggatgtcatcaaccagacttggagcccaatgtttgatcttgtcaatgtgttcgaggtcttccttccacaacttctgttatatcctaatccttctgatccattaaatggagatgcagctgcgttgatgatgcgtgatcgccctgcttacgaacaaaaagtgaaagagtactgtgaaaaatacgccaaaccaggggatgctggtgtcaccccagaagagcagtccagtgacgaagagctgagtgaagatgaagacgactcgggtgatgaggagataatgggcaaaccagacccatagtcaagttggcacctactatacctgtaatctgcacacgatgtttactgcagcaactgcaattaaacaccccatgaacatccgcgtgcagtctgagtgccatgtaaataaactgcaatttcaccaattggatttccagcataactatgtcttcgaatcatgagtgtagtgtaggttcgtgcgtttgaattggctgaaggtttcaatatttgtgcaatcattagcagaactgcagaagcaagttcctcaatacagtaattcagatgatgttggcgtagaccttttgaagctagtgcatagctaatgcgccggccaagatattgaaggggatgcattctgctgatgcatgaactgagcctggagaatctcttcaaccgtgtggagattagtgcttcgtcattgtttgcattaccaacatgtcttccatgcaactcggggatcagaagccacgtggctactttgtgaacctcaaatcccctttgagattagagggcaagcaaaccgtctcctcactcacatggcaagaatggcgtgccgagtggcgctcttcgccaccgtcctcctgtgc

SEQ ID NO: 23639 - DNA, 2331 bp, Zea mays
  misc_feature (11)..(44): n is a, c, g, or t
  misc_feature (51)..(55): n is a, c, g, or t
  misc_feature (65)..(76): n is a, c, g, or t
aacaccggctnnnnnnnnnnnnnnnnnnnnnnnnnnnnnnnnnngcgcatnnnnnccgcatcgtnnnnnnnnnnnnggagcggcgaattcttgtttggtttcccaagatgtcttctccaagcaagcgccgggagatggacctcatgaagcttgcaatgagcgactacaaggtggatatggtgaacgatgggatgcaggagttctttgttgaatttcgtgggcctaacgaaagtacggattattaacgtgtatggaaggttagagtagaactgccagatgcgtatccttacaaatccccatcgattggtttcatcaataagatatatcacccaaatgtcgatgaaatgtctggttcagtctgtttggatgtcatcaaccagacatggagcccaatgtttgatcttgtcaatgtgttcgaggtcttccttccacaacttctgttatatcctaatccttctgatccattaaatggagatgcagctgcgttgatgatgcgtgatcgccctgcttacgaacaaaaagtgaaagagtactgtgaaaaatacgccaaaccaggggatgctggtgtcaccccagaagagcagtccagtgacgaagagctgagtgaagatgaagacgactcgggtgatgaggagataatgggcaaaccagacccatagtcaagttggcacctactatacctgtaatctgcactcgatgtttattgcagcaactgcaattaaacaccccatgaacgtccgcgtgcagtctgagtgccatgtaaataaactgcagtttcaccaattggatttccagcataactatgtcttcgaatcatgagtgtagtgtaggttcgtgcgtttgaattggctgaaggtttcaatatttgtgcaatcattagcagaactgcagaagcaagttcctcaatacagtaattcagatgatgttggcgtagaccttttgaagctagtgcatagctaatgcgcgatttaagatactgaaggggatgcattctgctgatgcatgaactgagcctggagaatctcttcaaccgtgtggagattagtgcttcgtcattgtttgcattgtgaggatatagtcctcattgttataatatgaaaaagtaactggcgcacttagggttggccttggtaatacataactaataatagtaacgcatgcaatgcagaccaacatgtcttccatgcaactcggggatcagaagccacgtggctactttgtgaacctcaaatcctctttgagattagaggtgattgagatagaaatgaactaatttattctctaatcccctttaatcccgaagtggattcgagtttccatactagcccggaaggtttctggtttggttagccacgcttggttcgttgggggtgcccagggcaagcaaaccgtctcctcactcacatggcaagaatggcgtgccgagtggcgctcttcgccaccgtcctcctgtgcgcggccgcgggggcggccctgggggcgaagcgggcgcccatcccggacgacctgcgcgacgtgatagacgaggaggaggacgacgagtggcgccaatatcgcgttccctcgtcgcggggcccgggccgtggcgacgggccgccgcctgacctttcacggatggatccggccgccctccaggccgagctcctccgcgggcaaaccggcccgtcgttcggcttcgtgaagctccgccccggcaccacccgctcacgggagcatgtggtggggatcgcgaggaggtggagcaatgtgctgcggacgggatcggtggacgccagattcacggcggttaatttcgtaacgctcatgttcaccatggagagagggcgagacattctagagctgaaggagtttgtcctgagtcaggctgaggcctacgagttgaggatcggcgatcaagttttccgcaggcctggagacccacccttggaccaagttctccgtaagccacggaagaagaagcgccgcaagtctagagacgagctgtagattcatttgctaatcttgttctacatctcatgttcgttcgttcgttctttctctttcgtctacttcagttttgctctcatagcagtttttaccttgcgctgtgtgtcagaatcacaggtagtagtggtcctccatgcctaatggtctgtattcttctttttcttcttcttttgaaagcagagaactgcccattttattataaatttatgcaggggggaagagttaataaggcctaggccaaaaggttaaagaaaaacaagtgtacgcgcatcaggcgcgcggaaagacagtaattattgccaaacgtgttgcctcctgctacgcaccacaaaaaaaaaaaaaaaa

SEQ ID NO: 23640 - DNA, 1768 bp, Zea mays
aatggcaatctatctcgatttgcagtgaatatttttgccctccgggccagggtttggcagtagaaaagatgacctgaacaatgtatcaccacacatatgtaccaaaatatacctagaggcagcggcagcacacacaagtgtcaccgttgaggtatcaagctgaacatccatccatccttcaaaacaccggacagaacaagaaaaaaaatcgctacataaatggtggaaagaattgctattagcagctcaatgtgaaatcctcagctctaatgcaccacgccgcatatgatgttgtgcaggactaccttcagatgaggagggaagcacatagcatcagcaatgcgatgaggatcgagacatcggttcgcattctgagggcggcatgcgaaggagatgcagccgtggtggtgttactgactggaggtagggctggttctgcaacgtcagcgtccgtcaagagcggcattggcgccgctgctggtggctgtgcatctggggccatggttaaaaggaggctacctggttgcggaggctgcataaatagtggtgcgctgtttcccatgctcgtgcaggagttcaatttgtatctgtgagcagtcccagggaaatcagtgatgatcccgtccaccttagcaccttgcacataagcattaatctgtgaagtggcgtctgcgaagaagtcattcggctgagatgcaaactcattcatgagcacatagacgtaaacttggaggcccgcagactgaagggacgtgacaagcttattggtctggtttgtcaaataataatgggtctgtggtaaaacagatgtggtgctaacagagacggcattagcaaacttcttaatgtctgcaagggatgaaggtgcggcatctctgacaccttcttcaatcatgtagacaaggctgtacttggtttcctgcttgaacttctttagcaccgagctgttggttgactgaatcataacattctgggcagtctgtttgctataaccagagtcatcaagtgctttgaccactgcgtctaccactccaaatccaagcttctctgccatgaatgcagcatgctcaacagttatcatgattcctgacaaatcctttccctttgcaaacgtcaaaaagtctgataatctcatgaaatttcctgcattcttgtttctgggatttctgtacagtttataggtgctcattgggttcgatatcatgggctgtaggttcttagaaatatcatcccaagtaaggttgaaggtgaagactccaggaccagccttcagatcgttgatggtagttacttgcgaagtaaatgatgattttccaacagtagtgacatccattaggtcaacagaactcatgcatatcagtatgccatctttggtcacttgaacaggacagtcaatgacatctgcaccatcagcaactgccttttcataagcttggtcggtgcagtctgggtagtcaccgctagcaccattatgagagataaccagaggtttagcatggtcgatcttgctgttgttcaggttactaaagcaaccaactgcctctgaaggagtaatcgggaaatcagtcaacacaccatcgacagagaaggcactgttccccggccggcctcgagggtcccctaatggatcaaagctgtagttatagctgatagtaaagtcatttgcaaaatcagcagcatagatttctagccccgctttgtgagcatcatcaacaactgaagtataaggcagtaggtaattatctggtgtaacccggccggcctcgag

SEQ ID NO: 23641 - DNA, 1876 bp, Zea mays
gtaggtgggggataaggagtagaagtaagagagtgttgtaagaggattagttatggagtacaaaaggcacggggtcatatggcgagaaaaagaaataggatagacgatgaatccggtgtcgtgccagaagctttttcattgcagaaggtcgaaaaggttgacgatttcatgaggttggccgggtttttttttttgggattgtgtacagattatagggatcattgggttggatatcatgggcttaaggtttttagaaatatcattccaaggtaaggtggaaggtgaagactccagacccagccttcagactgttgatggtagttacttgcgaagcaaattgtgattttgcaacagtagtaacatccattaggtcaacagagctcatgcatatcagtatgccatctttagtcacttgaacaggacagtcaatgacatccgcaccatcggcaactgccttttcataagcttggtcagtgcagtctgggtagtcaccactagcaccattatgcgagataactagaggtttagcatgatcaatcttgctggtgttcaggttactaaagcaaccaactgcctctgaaggagtaatcgggaaatcagtcaatacaccatcaacagagaaggcaccgttatcaatgaagaaaagatattccgctaatggatcaaagctgtagttatagctgatggttaagtcattggcaaaatcagcggcatagatttctagtcctgcttggtgagcatcatcacccactgaagtataaggcagcaggtaattatctggtgtaccaggccagatatagcttttgggaacaagtattccagaggcaaaagtcttgacaaatgtcagatttttcagcattgagccatatgtctggtttgttgatggctcaatagagcgttcgtcgagaaatcggaacacaagctttgtcttcttgctaactcttccagatatactggtgaggaagttcacttcaggcgatgagatgtaatcgacaatgaattgtttcgataaggacaggatatagcttctcatgctaagcttaaactggctgtagaaactgtcgtgctggacatttaaccaaacagcaggtgccttatataaggtgaaaatattttcaacaggatttatttggaacaaaccatcatatgcaggggtacgagataggaccgattgcttcaaagatacgttttgcagcagaacagtgcttgtatagtctacggagaaccagcccgctgtagatacaccattaaccttgtaggtcttcttcccttgtgggaaaacactggctattattgtgcagttatccatgtttatgctcggtaggcagataccagcaccatccttcgtcagccgaacatcacaccacacggtggtgtcaggggaactagctatgccaacaaactgataagcatagtcactggaatcgggaaatagtccggagaacccgcccttagcaacgactgctggagccttgccgctcagggtcttccaggtagagccattctgggcgacggcggagccgaccgagagcagcagcaggaggagcaggtgagttgaaccaagaagggagcaggcgcggctgctcctccccattgcgggcatccgccacctacgcgaccaccggcggacgcagctcgaggaactggggctccaagaacgacccctggaagggggagcagaggaagaggtggccacgacgaggagacgagacagggaggaggggggcaaggcaatgcgcatccggccggccgcgttggcgttggatttttaagacccagcgagagagagacaaaagcaccgggtggcggggcgatactgctgctgctgagctgtgtctgtgtgtgataccggaggcccggccggccggcctcgagg

SEQ ID NO: 23642 - DNA, 2406 bp, Zea mays
gctcggtaccctctgaaaaacagtttacgcatgatcagagtatatttttagggtgtcttcaatagcgtacccttacccttcttatctattatcgtgttttctattccaaacttcactctgtgggcccttttcttcttttctttttagtattttgcataactatatgtagatctattggagacagcctcttaccgaatcatagaacaccctgacaggattgaggtgtatccaagacagaccctaaactgtatgtttgtagggaatattttgccctccacaggcaggttggcagtagaaacggtgacatggacaatgtatcaccacacgtatgtaccaaaatgtacctagagacagctggcagcacgctcaagtgccacctttgaggtatcaagctgaacatccatccatcctccaaaacaccggacagaacaagaaaaaaatagctacataaaggtggtggaaagaattgctattagcagctcaatgtgaaaatcctcagctctaatgcgccacgccgcgtatgatgttgagcaggactatcttcagatgaggagggaagcacatagcatcagcaatgtggcgatgctcaagacatgggttcgcattctgagggcggcatgcgaaggcgatgcagccgtggtggtgttgctgaccggaggtagggctggttctgcgacgtcagcgtccgtcaagagcggcattggcgctgctgctggtggctgtgcatctgggagaatggttgaaaggaggccacctggttgcggaggctgcatgaatagtggcatgttctttcccatgctcgtgcaggagttcagtttgtatctgtgagcagtcccagggaaatcagtgatgacaccatccaccttagcactttgcacataagcattgatctgtgaagtggcgtctgcgaagaagtcatttggctgggaagcaaactcattcatgagcacgtaaacgtaaacttggaggccggcagacttaagggtcggaacaagcttattggtctggttcgtcaaatagtaatgggtttccgggaaaacagatgtggtgccaacagaaacagcatcagcaaacttcttaatgtccgcaagggaggaaggtgcggcatctcggacactttcttcgatcatgtagacaaggttgtacttggtttcctgcttgaacttcaccagaactgagctgttggttgactgaatcataacattctgggcagtctgtttgctataaccagagtcatcaagtgctttgatcactgcatctaccacaccaaacccaagctcctctgccatgaatgcagcatgctcaacagttatcatgattcctgacaaatcctttccgtttgcaaaggtcaaaaagtctgacaatctcatgaagtttcctgcgttcttgtttctaggatttctgtacagattataggtgctcattgggttcgatatcatgggctttaggttcttagaaatatcatcccaagtaaggttgaaggtgaagactccagacccagccttcagactgttgatggtagttacttgcgaagcaaattgtgattttgcaacagtagtaacatccattaggtcaacagagctcatgcatatcagtatgccatctttagtcacttgaacaggacagtcaatgacatccgcaccatcggcaactgccttttcataagcttggtcagtgcagtctgggtagtcaccactagcaccattatgcgagataactagaggtttagcatgatcaatcttgctggtgttcaggttactaaagcaaccaactgcctctgaaggagtaatcgggaaatcagtcaatacaccatcaacagagaaggcaccgttatcaatgaagaaaagatattccgctaatggatcaaagctgtagttatagctgatggttaagtcatttgcaaaatcagcagcatagatttctagtcctgctttgtgagcatcatcaaccactgaagtataaggcagcaggtaattatctggtgtaacaggccagatatagcttttgggaacaagtattccagaggcaaaagtcttgacaaatgtcagatttttcagcattgagccatatgtctggtttgttgatggctcaatagagcgttcgtcgagaaatcggaacacaagctttgtcttcttgctaactcttccagatatactggtgaggaagttcacttcaggcgatgagatgtaatcgacaatgaattgtttcgataaggacaggatatagcttctcatgctaagcttaaactggctgtagaaactgtcgtgctggacatttaaccaaacagcaggtgccttatataaggtgaaaatattcccggcccgccttctttggtgccacccatcttatgcaggggtacgagataggaccgattgcttcacccggccggctcggaggtacccaatg

SEQ ID NO: 23643 - DNA, 1537 bp, Zea mays
ctgcagtttggcaacggtctggacggttctgcaatgaacttgaaatcatagtagtgctgtgacccaacgagtctagatgtcacaacgagcataacgagtctggttgacaatcaactagtacaagtaaaggccgacccggccccatatgcttgaacggttgctgtaatgcctcgaataagtgctcactcctaaaccataaatcgtataaattctaaattataagacgtatattacgcacctagattacctattatatctcaatactagatacactaaaaaataatgtatatctagaaaaagccaaaacatcaatataaaatttaaggcatctttaaaaaaagaaaaacattttataataataagtacgtaataagtgaggtacaaagtttacagtatcagtgctgggaaggtgtcatgtactgtgccatccacttctcttctctttccacttcgtcgcagtgcaatgaaatgtatggattattcagagtattaaaaacggtgcttccaaacatataatacgtgatatatattagaaatcatgacccatacaggttacaacagggcctggacaaaatcacatattgctggatgtggggaaatcggtctgctaatcacagtgattgtgtgtgatacgtgtatacattatcaagtgagatgtcatgtgccgtaacacctcaatgatctgaccttgttcagctatcttctatgacctcactctggcaagcctttcccttatctggtctagctcaccgtcatcaacagcctctgctatagcagttctctccgcaggtacacttgttgaaggctgcttcatcttctccttttccttcctgacagcatccgggagctcagaggcggtctccccagcgattgcagtgaggaccttgtcaacctcctcttcaatttcctcctccatgtcctcgctgtccagagttgaatctaaagcatcgttgaccatttcttccatcacaccagcctttgtcatctctttgctgaattcctgcattgtggctgcaacctccggggctttcatgaggctgttgacaagtttcatcacttcagtgctcttggacaagtggcctactgtcctagcagtagcaacgatttcgccaaggtgcatggagatggagttgagctgggccttgttctcgtacaggcggttgactgccttcctcgagcgcaccacctccttggccagcgccttggcggatcccatgtcgttgcgcttggcggcctccctgatggccttctccaccttcttctcctccctctgcacatctcggatctgccggtcgatgttgcggccctcgttgcggaggcggcgctgccactcgcgcagctgctgctgcggcgtcggcttcggcttcagaaggctcttcaccgtctccatcttccccactccgttctcgctctcccggcccgcaatgcgcagcggccgcaccgcgtggggacgacgcggtcgctgcgattctgctgcaagccccagccgtgccgaattccgcagcccggggatcccagttcagagcggccgcccccg

SEQ ID NO: 23644 - DNA, 1043 bp, Zea mays
tttttccaaacatataatacggtgatatatatttagaaatcattgacccatacatggttacaacatgggcctaggacaaaatcacatattagctggatgtaagggaaatcaggtctgctaatcacagtgattgtgtgtgatacgtgtatacattatcaagtgagatgtcatgtgccgtaacacctcaatgatctgaccttgttcagctatcttctatgacctcactctggcaagcctttcccttatctggtctagctcaccgtcatcaacagcctctgctatagcagttctctccgcaggtacacttgttgaaggctgcttcatcttctccttttccttcctgacagcatccgggagctcagaggcggtctccccagcgattgcagtgaggaccttgtcaacctcctcttcaatttcctcctccatgtcctcgctgtccagagttgaatctaaagcatcgttgaccatttcttccatcacaccagcctttgtcatctctttgctgaattcctgcattgtggctgcaacctccggggctttcatgaggctgttgacaagtttcatcacttcagtgctcttggacaagtggcctactgtcctagcagtagcaacgatttcgccaaggtgcatggagatggagttgagctgggccttgttctcgtacaggcggttgactgccttcctcgagcgcaccacctccttggccagcgccttggcggatcccatgtcgttgcgcttggcggcctccctgatggccttctccaccttcttctcctccctctgcacatctgcagcacatcgaggtcgagggcgacagcctggccgtcgttagtccacactcggcgagggtgagtctgggcccggagaatgggagaagcgggctgcctcgcctcggatctgccggtcgatgttgcggccctcgttgcggaggcggcgctgccactcgcgcagctgctgctgcggcgtcggcttcggcttcagaaggctcttcaccgtctccatcttccccactccgttctcgctctcccggcccgcaatgcgca

SEQ ID NO: 23645 - DNA, 4212 bp, Zea mays
  misc_feature (1229)..(1229): n is a, c, g, or t
  misc_feature (1863)..(1863): n is a, c, g, or t
  misc_feature (3033)..(3033): n is a, c, g, or t
  misc_feature (3472)..(3472): n is a, c, g, or t
cagctggtacgaacagtcgccgctcctgcgagtcctcgagatctcatttttattttctgcatattattggtttcgtgaacttaatcggtggagggaagtgtccccccccctccccctatgttttcgcatgcgttgctagagattcttgttgccttttcagtggaccctgtccttgctggtcatgtatttgatccctccaattgtctttgctatgtagatttaattagtcttggagttaaaagttgaaactatagcaaaacgaggaatgccagtttacagatggctacctgtgcacgctttaggccttactttgaagttattgttggcattttgcgaagtttcataattcataacgcagaggacaggtttggaaaggaactgttagataagctatgatcatatcaagtgaaaactttactgtttcaggttctgttatatactgtattgacttgagctgtacggcaacaggctttgtttaccttactgttatatagctcgtgttcttgatgctactgccggctgttagtaagactgatgggcaatgcagattagcttggttatatatgaatattgtggttgcagattgaacgattcctccttgttaagatatacgaggcttgtaatttctcagtagataactgtggtggcgatagtccattggtttatttcacgtattttgctgtctatctttttttccccaggacaaccaaaaggtgtgtgtgtttcaccaggtggacggttccctgccttttcatctgaaggcaagcctcctggaagagcacccaaggggcgcagagatctagcactgtgtaggatattccgtcagaaaacatgttgcgatgtgatgcagacatttcctgctctggtctcagtgagaaaccttgcattggctggtgaaggcagtcaagaatgtattcatttgtgggaattgcttgagtgctcaatatgcgatccacgagtgggtatcaggcctggacctcctgttgtatgtgcatcattctgtgatatggtcttcaaagcttgttcagagtcgtacttctctatagatacgaaaacacaggtaaaccctctgattaatggacataattgagattgagacaagcgggtactgatacctcaaacatgtactggcacacaagtacatgtgctgctgctagattaagcttgatagttccatggttagattataattatacactaaacagtcatgttctagcccatgtctgttntgtacattctggatagctgttgattctgctgaagttcctttgtgctaagagatttttagcttcatctactgatttttgttttgttgattacgatttcacgttttggttctgatctgaatatgctccttactggtttgtcaggccttgtctccttgtggtttagatgacatcctttgtggcaaaacacataaatgggtctctaacggcacagagttgtgccgtcttgctggtttctctgttcaaatttctgagaccagctctggtggagttggtcacactttctgctatggtgggaaagcaagtttggattccatctctgattcatggacttcttcaaaagaccgtccaacattaagtggtgtggcttcatgggacgttcaagattttcagagatgggcacgagaaatgcctatcggtgaaagagtttcgtgggcgattggaggaatggttctcacagctggccttatttttatcaggtattgcatattgcttttctctttcactttatatatgcatagataggtaaaaccctaactcaatcaggtactaaagtatcagcataaataattcttgtagatctgagtatgttttatacatttggaatagatactgcataggctatttacagatgatngatctacaagaaaaggagcaaaaaaaaaactttgattctgtccttttttttcagtgtaatcttgcaactatctggcatgatgtcttaaattcttgctgagatggcacattggaagcttgcacttcataccccttcttttcaattgaacttcaaactatcgtttatctatgcagcaaaagaaagagctacagccatcaccagaagcaagctgctattgctcgcaatatgagattgagaaggctggattctagagccaacccacaacaaacaaagcggagctaggaaggcataggcaacttagtgttactcatagaggattcttggacttgtgcttctacttttgtggatcggtataatcaacaactgtgaacaatagattgtactgtgtgtgtgtccatcttgttgcttagatgcaccagctacgacctccttgtcatccttgtgtggaagaagagttctataagttgtcactgagtattcctggaatgcagaacttatgggctgtgaaaaaaaaaaaaaaaaaatatttcgaaatgccttttttgatgccatcgatatccggcgacatgcctacatgatttgtgatctgtgagttcatctaaggcagtagagcatatgtatatgtatatctatggaaagaccatttctcacgaagcacgtctattttcttaaccaacttaatctagactcattatattctattatatattcatttttcctttccaagacagtttgtaatatcagagtgcctcacagatgcgtaaatgtttgccagcgatctggcatgatttgaaactgaaagggaaaaaactatttgttcattcatttatcttagtttcattttcaagtctggaccgaatcaagaacacagaaagtggatgtgatattgaattagaacctatttagaacagaatacagtaaagaaacagatcttgttcactgttttgatatgtgaaagatgttcgtttacacatgaatattaagcaacgaaggttcgtttgcacatgaatagtggtagtcattttcacctagaaacacattatgcatagagaagtctattgggcactgacacacggcagcgctatcagaggactcaaacactcagtagcaggtgagagtttaggtgcacaacgaaacaaactgcggaaagctctagcttcttgttatgcntgtcattcagaggtaggtggtccaaagtacgtccctacctccggctaccaactatattcgaggggtatcttatgtaacggagtaattacagtgatgcctgtatagtaatccgcataaaccagacaacacacccacacactatactgatgggtgggcacttggcgatgtcttctggtgcatcgggggagttcatggtcgacttgtagcctctaccccgagagccttcgcgtcaatgctccccttggtcgcgactggctgggcgagtcttttagtcgatgtggggcgaaggcctcggctatcgatgacttgttgtggttgtccgtcagatcgaagacccctttgcttgtgatcctacatatggtcagtacaaggcaaaatgtatggtcttcgctctgtaatcgaagccgtgttcggtcttcggctgcccagccatcctgangcctccgtatgacgtagtccctctgtggcattctgtcagagcgagtgatgccttcgctgatggccccttcgctcatgatctgcgaaagcgttagggcagaaacacgaccttcgttcggttggttgagggtatgtttggcctccgtccaacagtagcctccggagggagtggttcatcttggtgggccattcccgaagtcttgatttagaggtggacgaacgctgcctcgaccaaccggtgaaccgcttcgaggcaaccgcctcgaggggaccgcttgatgtgacagatggaaagccgaggcgacactatttgcttggtgtcgcgggtataaaatgatcgtgcgacctcgctgatggaccaccacactgctttcgcaaccactatccctcgcaaaaatcattggatcgccgccgcctgtgactgtcgtttttgccgccgatgacgagatcggcgacgagctcgttgacgaccccggtacgcgccttgcctccctctaccagcggtggtgcagctccatcgccgccgccgccacacgctggtcgggagggcgctggaaaagtgacggctcatcgtccgctagggttgcgcgcgttgatgggctgggccaagagaattatgagttggactgttctaaggttacttcacgaaaggtgaaggagatggatagcttaggatacttccctgctggccaagggcgggctgctggagcggatatcgtgccgaggccggaggcgaggaaa

SEQ ID NO: 23646 - DNA, 1500 bp, Zea mays
tggccgttttctttgggtccctcgaggccggccgggggcccattcgctcgaaccgggggagcctgttgacttctacggtctatctcgaagtcacagacgccgcgtcgccgcgaagcgcatccattcgtcgccgcagcacgccggcggccggcgggcaggctgcttcgatgggctctcctacgcgggttcggaggacgaccggtttcactctcctcctggtgcttctgttcctctcgccgcccgtgtcagctggacaaccaaaaggtgtgtgtgtttcaccaggtggacggttccctgccttttcatctgaaggcaagcctcctggaagagcacccaaggggcgcagagatctagcactgtgtaggatattccgtcagaaaacatgttgcgatgtgatgcagacatttcctgctctggtctcagtgagaaaccttgcattggctggtgaaggcagtcaagaatgtattcatttgtgggaattgcttgagtgctcaatatgcgatccacgagtgggtatcaggcctggacctcctgttgtatgtgcatcattctgtgatatggtcttcaaagcttgttcagagtcgtacttctctatagatacgaaaacacaggccttgtctccttgtggtttagatgacatcctttgtggcaaaacacataaatgggtctctaacggcacggagttgtgccgtcttgctggtttctctgttcaaatttctgagaccagctctggtggagttggtcacactttctgctatggtgggaaagcaagtttggattccatctctgattcatggacttcttcaaaagaccgtccaacattaagtggtgtggcttcatgggacgttcaagattttcagagatgggcacgagaaatgcctatcggtgaaagagtttcgtgggcgattggaggaatggttctcacagctggccttatttttatcagcaaaagaaagagctacagccatcaccagaagcaagctgctattgctcgcaatatgagattgagaaggctggattctagagccaacccacaacaaacaaagcggagctaggaaggcataggcaacttagtgttactcatagaggattcttggacttgtgcttctacttttgtggatcggtataatcaacaactgtgaacaatagattgtactgtgtgtgtgtccatcttgttgcttagatgcaccagctacgacctccttgtcatccttgtgtggaagaagagttctataagttgtcactgagtattcctggaatgcagaacttatgggctctgaagagatcatgtacatattatttggaaatgacttttttgatgccctcgatatcgggcgacatgcctacatgatttgtgatctgtgagttcatctaaggcggtggagcatatgtatatgtatatctatggaaagaccatttctcacgaagcacgtctattttgttaaccaacttaatccagactcattatattctattatgtattcatttttcctttccaag

SEQ ID NO: 23647 - DNA, 1478 bp, Zea mays
taaatattaaacccggcacaagacggacatgaccgcgagcacgttacattttaccataaaccccagataaatacctgcattcttgttcaccgtaactcagaatctgcacagtactatatctcagcattaccagtaacaaataaatcaaatgttctagttatactgccatagaggatacactacgcatagtcatctgtcactcaaggttaatgtaacatgggatgggagatcaaaattcacctgctagtacagtgaagaatgtcacacactaccaacaccgtcatgaaagcttgctcattgaaaaatagggtgtgaaggtatggactgcattggggttgctggggagtcaagatggaggaacgagcctcggcggtgtcattgtttcactcttttcatgccgccgttactgaagggactaggaggagcaccacctggatgtggactctcctctcggagtggcgaatttagcattgcaagttctcgcagttgctgtctcttgtagtagtcttgtgattcgtccactggtttcaacagctcttcaaggatctcttgtgcctttgcaagtcttgcatcaatcacattagcaggtaactcagcttcaatcaagatatggaggggttcactcaagtgttcatagccaggtcttcccttgagttgttcctccttgccagaatctttaattgagcctttccctctgatgaaaacacgacagcctgtggaggcttcaatcctctttaaagagtttccccttggtccaagaagacggccgataaaattgaaattagggtatgcttctgtcggtacttccaaccgcaaaatcttcttgacaatataagaagaggggctctgtgggggtccttgccaacccatagctccttgcggaacacctactctctctgaatgcatcccattccatggactaaaaccgtttccacaaaagtttgtcatggggggtgccggatgcatctggttggggcttgcggctggaaacctctcaaagtcgccagcaacaccatgttggcgccgtatattcgacacccgcactatttcttgattcagcagcctgctgcagattgggagcacctgcatgaagggccccagcttctggtgctcctgcagcagctccgccaggtactgactgcctacgtccggcggcccggggggcctcacctgcggcgagatagccctcgcgggggagaagcatgcgtccgtaccgtgcaggccgtccatggcggcgcgcggcggccaggtggggatggggccgcgcccgggtgcaaatcgggggaagccgctacgggaggaggaagaagaggagaggatggagagggtatgtttttatctcggtgtgtatcgttttcttttctcggtgcgggtggcaatacccttttgagggaaaatctcggcaaaaccctccgcgcggcacgacgtgttgcgtcccggcgtatctctgaggcctctgcctctcctgaccctgcgct

SEQ ID NO: 23648 - DNA, 1388 bp, Zea mays
  misc_feature (1360)..(1360): n is a, c, g, or t
tttttttaccagtaacaaataaatcaaatgttctaattatacagtcatagaggatacactacgcatagtcatctgtcactcaaggttaatgtcacatgggatgggagatcaaaattcacctgctagtacattaaaggatgtcacacactaccaacaccatcatgaaagctttgctcatggaaaataggatgtgaaggcatggactaagtggggttgccggaggatcaagatggaggaatgggtgtcattgtttcactcttttcatgccgccgttaggctatctccagtagatcccctatttcaaacttctctcttcaaacagtgataaacagtgtcatctacaattctgtgtcccctgttttattcggcctaccggagacagtcttactgaagggacttggaggagcaccgcctgaacgtggactctcctctcggagtggcgaattcaacatggcaagttctcggagttgctgtctcttgtagtagtcttgtgactcgtccactggtttcaacaactcttcaaggatctcttgtgcctttgcaagtcttgcatcaatcacattagcaggtaactcagcttcaatcaagatatggaggggttcactcaagtgttcatagccaggtcttcccttgagttgttcctccttgccagaatctttaattgagcctttccctctgatgaatacacgacagcctgtacaggcttcaatcctctttaaagaatttccccttggtccaagaagacgaccgataaaattgaaattagggtatgtttctgtcggtacttccaaccgcaaaatcttcttgacgatataagaagcagggctctgtgggggtccttgccaacccatagctccttgcggaacacctactctctctgaatgcatcccattccatggactaaaaccgtttccacaaaagttcggcatggggggtgacggatgtatctggttggggcttgcggctgcaaacttctcaaagtccacagcagcaccatgctggcgccgtatattcaacacccgcattatttcttgattcagcagcctgctgcagattgggagcacctgcatgaagggtcccagcttctggtgctcctgcagcagctccgccaggtactgactgcccacgtccggcggccccgggagcctcacctgcggcgagacggccctcgcgggggagaagcaggcgtccgtaccgtgcaggccgtccatggacgcgcgcggcggccgggtgggggatgggcccgccccggatgccaatcgggggaagccgcgacgggaggaggaagaggagggtggaggggcggatggagagggtgtgtctgagtgtttctatcgcggcgtgtatcgttttcttttcncggacgcgtgggcggacgcgtgggcgga

SEQ ID NO: 23649 - DNA, 2143 bp, Zea mays
ttttttttttcagaaacagttatttttttttttttttttccgcatgaagcaaatattagacaaacatgtcgtgtgccgctcaatagcaacaatatgcttaatccaaggaacatcatggctaatgttagctagtagtacaaggttatatcataccgtgcaacgattttacaagccaatatactacaccaatttattcacggaaacatggtgggccgttatatttcgaaaaaccgcggactcttcaaaattatacctcgctactgggtatcctttgctcccaacaaaaaaaaaaaagtaccagaaacccccaaaggagatgtgcttgcttacttccatgtggacaaatcacgaatttactctcgagattcacccgttgctttagccctgatctcaagatctctgatacggtcacataacacagaactcgactgctcactttccttgtccaccataggagaattgacttcaggactcaccgcaggactcgactgctcacattccttgtctgctataggagaatcgactccaggacttagcacagaactcgactgctcagtttccttatctgtgataggagaatcgactccaggacttggctctggtccgcccgataggtttaagggctggacttctgcagttgtgggctgagattccaagcgaggaagatttaagaagagtcttacagccggattccggagaacagcgccgtaaacaagtgagaaaaagtttgatgtgacccagtaaaagaaaattgcctttggaaagcctattgtaaatggaacaaacaaaactccaaaaaaccgggagaactttttcattggttttaacatatgattcccttccatgccatcttgcatattaagctctactgtagccaaaaaggtcagtgatgttaacactgggaggattaataaattatcaggagttgtcaaatcagtaaaccaatacacaccacctcctttcatagaagggactttctcaaccatatttgatatagcaaagaaaaagctcataaatataggtccctgtatgaatagacccttcaatggtgtcaatggagtcactccatgtctaaggaatagctcccccagtttctgtttccccacttccattgaccttggatcagttgaatttcgcatctcttcattgatggcttcaatttctggtctcatctcatttaacttcatcatggacttcatctggttgatcagcagcgggacagtcgccagccggatcatcaacgtcgtcagcgcaatagtcgcccaccagttgaggccggtgaaggattgaacggcgtccagcaggtgctgcagcgccgcgacgggtggaaatgattcggccgcggcggcagcgacctccccggggtacggcaacggcggcgtggagacggacgcggcagctgacgccaccccatcggagagcagctccgacacaggggccgcggcggcggagtccgccaagacctccgagtcgggggccggggcggaggagtagcggtgggccgcgaggtggagagcgaaagggagggggaagggggccagggcccgggatctcgacggccgaggaagcgcggaggggaacggtggtgcggattgctgcgacgattggggccgaggctgcggcacgggggagggggagggagcggggtcggagtgctcgtggtgggaaggaacgaggtgcgagatagaggggtagaggcggccggagaagtggtgtgacaggctggtggcgaggctcctccgcgcggagaaagccatggcggcgggggggagatcgcgaggcggtggtgagatcgggaggcacggagtggtgtggcggtgtgagggtctcgtgcggttcaacgaacctgagttgagacggagagaatgtccggcccaatatgctgctggcatctcggccctacacaaccaatttagggacgactcgagcaatatgggcctccagaaaaaagttcaaggcctccggatattcatccccgataaaaaaaacactcaaggcctctcggcccgtcgtctctccattgaagaacggcgtcctcatcctcaaccccgcgtcgaaggcagcatgaattgatcgtcgtcgtcgctcacagttcacagcacagggccatgcccatgcagtgcactgcttcggggaaccctgc

SEQ ID NO: 23650 - DNA, 1101 bp, Zea mays
aaaagtgaattagcttaattgatatatgcctaaattactattattagaatggaattcaattccagtgatccaaacggggcgtaagattattaaggttacactagggagctttgaagtgaagaagctttgaagtctctatatatgcaatcctcaatatacataagattattatataaggttacactagggagaacagaaggatgaccatatgtatgacacctgtggtgtgcattcagtcatttttgtccgtgtgaatctcctgcaggatgaccacaagcgccgagatgaacacgtagtcgacgttcgggaacacggtgaggctgaagtagtcctttcccagcaacatgctcgtggcgctgtgctcgcggtgcattttagcgatcaaggcgttggagttgttgccgccgaggtagaaagagcaggacctctccttgaagctgcccttcatgatgaagtcgcaggcctcgtgcgaggtgttggaggccaggtagatgagcatctcggtcttgaacggctggatgatggaggatttcttggcggtgaagagcaggtcgctcgatctcgtgctgtcccctctgtacgcttcccacgtgttgtgcatgctgattaccttctcgcgcaggcagaggagggggttgccggcggcgtcgaggaggcggcggcggttgtggatgctgatcaaggcacccttgaccgtgaccacgacggcgccgttggtgtcggtgatggtgaagtcgccctcccggaggctcaccttcttctccttcaccgccagctgcaccacgtagggcgcgcagaaatgcggggccaccaccgccaccggggatacgatgcctccgctgggctccggcggcggcggcgccggcatggacggaggtgctgccatctattaccaagtaccaagggtcgtcttcttgctgatacacaacgctcctatgctatgctacacgcaacacgccaagaaggaatgcacagtattactgccagccaccgcgcaaagtgagctgatccacaccacaaacgtaggctactctattttaaacagagaaccacaaaagtttactctgagcctcagaaaagatctaccgatcgagaaggatt

SEQ ID NO: 23651 - DNA, 3627 bp, Zea mays
  misc_feature (327)..(327): n is a, c, g, or t
  misc_feature (3199)..(3200): n is a, c, g, or t
  misc_feature (3408)..(3408): n is a, c, g, or t
  misc_feature (3452)..(3452): n is a, c, g, or t
  misc_feature (3514)..(3514): n is a, c, g, or t
tactaacttagaaatccgtcaaaagcaagatattatgtacgagacaattacactatcggaattcggctctttgtcaagtgcccagctctctttcgagaacaattaatcggacacccagcaaaatatgctttgctgagtgacattctcgacaaacaaagacattcggtatagacatcctttgccaagcacaaaactctcggcatactttaactctcggtaaagaagactttatcaagtgtcaagctctcggtgaaactcgatgctcgacaaagggatatttgtagtacacatacatgactttaaccatccaaaaccattatccaatcnagcttgtgatgcaatcgttgtataatcaaagtatcaaaagttatattttttttcaaaaaattatagatacatttaattatctattctactgttatattaaattttaagttctaatttatcctatgataagatatattaaagagagagacaacaatgaaatgcatcttagcatctataattttttttcaggtttctttataatttgttagtttgattacatgacgattatatggtaataaattcgattaccaaaacagttttgaaccatgtaaacacattagtaatagaggtcagtagtgtatacatgaagaaacaaaactaaaaaaatgtgattcttgaaccagcctaattcacagtttattatatcaaaagaagttgtccagatgaagctttgtcctataccaaggatgcacaatatctagataaagtctactgtctacaaggaatgcactagtttaaaagttaaacaaaaccaggccatgattagtctgtcttgagcagctattttatcagatcctctatttcaaattttgcccagtaaaacagtgtaatctacaatcagaacccctatgttacaggatttgctacggacagtcttatatcactacgaggatacatactttcctaccatttattatcttttgcatgctatcctaactaaaaagaaaatcacatgcccgtaggaaaaaaactattttataataacactagctactagatcagagttgatttcctaattgtagaagttctccacctagttatacagtaacaaacaagtgacctgcgctggtagtgttcttcctttttttaagggtaaagttgttttaattttttatatatagaacttgttattcaattcagatatagtatctctctctatatatataataaaatctatttatctacaaaagccaaaatgaattataagataaagagagtacaaaataaaaaaacatttttccaatgtatactaaggagctaggtaccattaggcagtagctcaacaagtagatgaaaacgatgaagcccccggctcataaactggacaacatttttcaggaaacattaactgaacaagaatttatttgatacatgaatccataacaatgaaatgacagataatatatgcataatacaatatagatgacgcatattgctactcttcgatacttttcaactttatcagtaaacataatcctcacattgggggttgttgcgtaggaaaaggaagactggaataaagaggtgtgcatgcatgtgacgctagaaggactgcctcagctaactggccaatacgatgccatggcatgctagcagtagcaggggtagctctagcttggcaccagccgcacctggaacctctcatagatactagctagtatatgcaatgcccaagagagatttgtggcagtcaaagaatctttagcaggctgctggtcttactcaagctcgtgattcgtgaatacggttgggctttagtttaatgtgttgcatttgcatgcagtataatagagtactagtatcatgtaatgaatctttagctttgcttcttcttttcctgacaaaactaaaatacacgtattaaggcaaagctaaactcacaacttcttagaactagagcacacgtttcgatcataagaagagatcagggaaaggtacatatatgggatcgaagctagaagatgcacatatatgtgtatttcatgttgttcttctgatctaaatactattagatcatatctctctagaaaacagctagctgggatagttatgggccgtatatattcggatcatgaatcaatcatgaaacacgcccgctctttgcgtctttcgctcagctcaaagaagaaatccacatatctaatgaaatagtattacatgaaccaaactccggatcaaagagtggtgtcaaaacaaatcaatcaaagacagacgagtattgatgtctgcacaaaccatatgtagcgacagatcgaccaagaacatgtaggaataacatatagcgtagcatgcatgacatactcttgcacaagtacgtagatcctagctaggaaaagaagacggatttcttcggaccaaggcgcttgattcccccaaagccatggcggcgcagcgttacagagaagctgataaagaggagctggaaggaggaggaggaggaggaggagggaggactgcaccgatctgatgatggcttcttgactcgaatgatagaagtgctagatcgaagagatcaaccacgccatcatcatgctccatcatgcatctctctctctctctctagctttctgtcacctcccccggccctctctctcctccgccggcccctcctacaccgccgcccctccgcttgatttcttcacggactatagcttctccggcctcttcctcttggaagtaggtggaggcgactcttgagaggcggtgaggcaatcatggcggccgagggcccgaggagcttggggcagcatgattgcatcttggaagaagtagggggatgagaggcggaacagcaggctcctcccgcatcacatggtgtgctatgatggaggcacatctcactagtagccggccgcgcgcacatctcccttggtggtctattgggctcgcgcgacctgcttgctggtcttctttctaggggtctcgggtctcctctcgatccggcagtggattatgatggactttggccaatctccgaagctagctctagggcatttgtatttttacggccagcctttggccctaggagacactaaaagcaaaacagcggtgagaaaccaataaagattggtactgatttatatatatatatatatatatatatatatatatatatatatatatatatatatatatatatatatatatatanntatagtattaggagccctgggcttccattaatgcagggagcccctgccagtttagttgtgccgggcgcgggtcgacgtggcaggtggtccgagtaccgcgcacatgcaccgattgaaggtggggcgtacgtgcgcaccccctattaccatttatgcatccgtttcattcaaattacgtatgcataaacaagtaactgacacggtgtgngcgcatgctccgcgcgggtattccggcttcgtggtcacgacccncgatgtagttggccgcgtttatacttgcatattatgactccaaccgtttcataaatttacangtcgatgcggcttggtcgggtgtggtgtagtatttgggatttatgattgtatacttcgatgttgacaactacatatcattttgggatttattatattacgcactttgccgtgg

SEQ ID NO: 23652 - DNA, 771 bp, Zea mays
caaaatattacatgaatcaaactctgaatcaaacagtgatggaaacaaatcaatcaagacgaacgaatcttgctctgtctgcataaaccatatatagagacagaataagaacatgcagggataacatacatactttgcacaagtacgtagatcctagctagctaggaaagaagggtttcggaccaagacgcttgattccccaaagccatggcgggcgcagtgttacaaagaagctgaagaggagctggaaggaggagggagaactgcaccgatctgatgatggcttcttgactcgaatgatcacagaagtactggatcgaatagatcaaccacgccatcatcatgccatgcaccatgcatctctgtctctctctctctctctctctagctttttctgccacctccccttctctctcctcctcctccggcccctcgtacaccggccgccgcccctccgcttaatttcctcatggactatagcttctccggcctcttcctcttggaagtaggtggaggagactcctgagaggcggtgaggcaatcatggtgaccgaggggcccgaggagtctggggcagcatgattgcatcttggaagtagggggatgagaggcagaagaggctcctcgcatcacatggtgtggtatgatggaggcacatctcactatcttggtttattgggctcgcgcgacctgcttgctggtcttctttctaggggtctcctctccggctttccgacggcagtgcattatggtggactttggccaatctcc

SEQ ID NO: 23653 - DNA, 751 bp, Zea mays
tttttttttttgtcttgctgatctctgaacgaggttcctcagctatagaaaaagctcaaagaagaaatccacataactaacaaaatattacatgaatcaaactctgaatcaaagagtgatggaaacaaatcaatcaagacgaacgaatcttgctctgtctgcataaaccatatatagagacagaataagaacatgcagggataacatacatactcttgcacgtacaagtacgtagttcctagctaggaaagaaggatttcggaccaagacgcttgattccccaaagccatggcgggcgcagtgttacaaagaagctgaggaggagctggaaggaggagggagaactgcaccgatctgatgatggcttcttgactcgaatgatcacagaagtactggatcgaatagatcaaccacgccatcatcatgccatgcaccatgcatctctgtctctctctctctctagctttttctgccacctccccttctctctcctcctcctccggcccctcgttcaccggccgccgcccctccgcttaatttcctcatggactatagcttctccggcctcttcctcttggaagtaggtggaggcgactcctgagaggcggtgaggcaatcatggtggccgagggcccgaggagtctggggcagcatgattgcatcttggaagtagggggatgagaggcagaagaggctcctcgcatcacatggtgtggtatgatggagacacatctcactatcttggtttatt

SEQ ID NO: 23654 - DNA, 3268 bp, Zea mays
  misc_feature (268)..(268): n is a, c, g, or t
gagccaaatgtcagcatcagaaagaattctttagtttgattccaatctttctatcttgtagcaaattaacaaaaaacaagtaggatctttgtacatgagacaaatgttttaatcaaacacatttagtaataaaggtcaataatagtgtatacatatggagaaaaacaaacaaaaatgttatgcttcaaccacagctcgttctaccaaaagtagttgtccagatgaatctcctccatatcgtatccgtacaacaggggtgcacaacatntctaggtaaaagttaaagaaccagaccaaatcactacgactacgaggatacatattttccagccatttagtattttgcatcctattctaaacaaagaaaatcacattctagctagtagaaaaaagtattttataatgacactagatccaagttgatttcctaactgctagaagttcttcatcctgaaacaaaataagtgacctgctagctggtattgttcttcagtacaaaataaaaaacactttcccattgtttactaacaagctcggtaccagtaggggcagtgtgccccaagtcgataaaaacgatgaagccccggctcttaaactggacaaatattcctttaggaaacattaaccgagacaattacttgagattatacacgaatccttaataacgaaatgacacacatagtatgcgagattatacatgagttggtcataatgaattgaaatgacaggtaatataatgtaaatcacgcatatttatactctgcaagggttttctctttaattttagctgtaaacataatatcctcacattgggggttgttgcataggaaaagagatcgattagaacggaagcaagtatatgataaaagtctataagctagctaaatgttgaggtagatgagagagatcataaatgaactgtgagcttacacctgccttagctacaagaactaagaaactctatgagagagataagtaggatcctacattaataatgaaactaacactgcatagacagaggtgcgtgcatgtatcatgtgacgctagaagggctgcctctcagctaactgggccaatacgatagcatgacaatctagcagcagcagagctagctttagcttggcaccagagctgcacctgcacctctcacagtacagatactaatagtatgcaatgcccaagagagatttgtagcagtcaaagaatcttgtttagcaggctgttggtctttctcaagctcgtgattcgtgaatacggttgggctttagttaatatgttgcatgcatgcagtatagctatagcactagcatgcatgtatttattgaatctaattaattagcttcacttcttctctactagcatgcacgtaatgaatctaattaggttcgccttcttcttctcctcacaaaaacaagacacacatactaaggtaaagctaaacttacaactgcttagaaataaagcacgttccataagaatagatcaagggaaggtatatatggatcgaagctagaagatgcagatatatatatatatatttcatgttgttcatctgatctaacactatgtgatcagcttatctctctagaagacagctgggacagttatggccatatatattcggatcatagaccaatcatgcaacacattgcgtcaaactgatctctgaacgaggttcctcagctatagaaaaagctcaaagaagaaatccacataactaacaaaatattacatgaatcaaactctgaatcaaagagtgatggaaacaaatcaatcaagacgaacgaatcttgctctgtctgcataaaccatatatagagacagaataagaacatgcagggataacatacatactcttgcacaagtacgtagatcctagctaggaaagaaggatttcggaccaagacgcttgattccccaaagccatggcgggcgcagtgttacaaagaagctgaagaggagctggaaggaggagggagaactgcaccgatctgatgatggcttcttgactcgaatgacagaagtagtactggatcgaatagatcaaccacgccatcatcatgccatgcaccatgcatctctgtctctctctctctctctctctctctctctagctttttctgccacctccccttctctctcctcctcctccggcccctcgtacaccggccgccgcccctccgcttaatttcctcatggactatagcttctccggcctcttcctcttggaagtaggtggaggagactcctgagaggcggtgaggcaatcatggtgaccgaggggcccgaggagtctggggcagcatgattgcatcttggaagtagggggatgagaggcagaagaggctcctcgcatcacatggtgtggtatgatggaggcacatctcactatcttggtttattgggctcgcgcgacctgcttgctggtcttctttctaggggtctcctctccggctttccgacggcagtgcattatggtggactttggccaatctccgaattgaagctagctagggcatttccatttctatggccagcctttggccttaccttggagttggagccaataaaagcaaaacagcaacgagaaaccgataacatactggtatactctataacaaatgattctttgtatcacgttattccatccatatatacatcgattaaaagttgggatacattagattatcttcgatcgacactgttacttgtcacatctcctatttcaaactttacctcttatttcaaacttcactctaaaatattatcttcttgttagtaaaacaaaaggcatactccctccatctttgaataaataaatttatatagatatgttaaattcaacatggaatgtaacaagatgtgtcaagcactagtagaaaaaggctcaaagactgcggtgcggtatatttttataggcggattcggttatcaaccgtctgtgctatttttagtgacggattattaagaaaaccatcactagaaatcgtatttctagaggtggttccttatgaaaaccgtctgtagaaatccatgatttctagtggcggttttcttaagaaactgccactagcaatcatttttatctttaatttttcgagtttttcaaacgacctcgtatgataaaaccatcaaaataaaagttgtaaatctctaaaagttataaaactttgtagttgacaacttttttatttgaaatcattttggctctcaaaaattgttctaaatttgtcaaatttaaaattcaaattttgcaaacgacctcgga

SEQ ID NO: 23655 - DNA, 2654 bp, Zea mays
gcatatggtgggtacggaggcgacgaggtcaggttttatgggtccttcgttgtctgtgtcatgcctcctcgcaagtcctgatctcggttgctttggactgattcgtgaaaaatggcagagatgtaagacttggaccgtaggttaattaaaaatataaggtgggttttgcaaaaatgacgactgttggaccgtaaaacgggtaatttatatggcagacaagaaaagatgtgccattccacaagtttggccatctgcccatctatactcgagcgtgaggactgaggacaaaagcaccgctcccacttacacatgggccccgccaattatgaacatacagacttccccgctttcccatccctgcggcccttatccccagcccaaaatggacgccaccaccgccgtggctgcgaggcgcctcctcctcctcccgctccgcgcccagccgccagcaccgcggggcgcagcgccggccacggcgaacccctggtgtcgatccgttccgcggagacgacgagtccgtgccgccccggcgcgcgcgtcgctggaccgcgccgcggtcctcctcgacaccgcggccgcggtggccaacggcgggacaggttactcgcaggcgagctactacacgtctctgggactcttcgttctctccgttccggggctgtggtccctcatcaagcgctccgtcaagtccaaggtcccggacccatccctgcgccccctctcccttcttccgtcccgtcgtccttgttgtcggctgcttgcttccatctttgctctctcctgcacgcgcgctcgtacgttgctgctccggtcccagcgagcacacgtgcacgcacgagtgccgtgtgagcagggcgcgcaccgcacgcgcgcctgggtgcgctgtgttcgtgccacacttgctcgtccgcgtacagtaattcggagtagatgcacctgtgcccgtgcctacagaatcgggtaattctggctcctggatgagctgtcccaatgagcgtacacacgggtttgagagcttctgtgattagctttgaagcaggtttcgttcttccttcttttcgagaagagacgggtagtgcactagctagtgctgtgtgatgtgggtgggtagtggagtggacttgcggtgtcggcaaaagatgatacccttcttttcttattcgatttgcatggtccatgatgccaccaccacgtctggtagggactgcactgcattgggtaattaaattaattttattagtcgtcctcttgatgcaaaagttgttttttttaatcacagcacatcagtctcatagtgagtagactattcagaggtccgtttatgtgggtttcttgaacctatttttaaatcttggccaaattcagcagcactgtttgtcatgtatgaatgccaaatctgtggatgcagattgtgcaaaagacatttgtcaaagacgaagggcagtcgatggcgccaaatcaggtggctggagagatcctgtcgttcttcactcgcaataacttcaccgtctcagaccgcggggaggtcatcacgtaagttgcgtgctagctgtagctggcttcgtgtgtcctgcagcgaggctacatatgctttcttctcttcaaaaacaaaactctacttagcttagctttagctatgttgtttgcttcctgattctactgccaagctaacactcttaagttccgcatcaacccccatatattgcacacacagtaattgggtgttatccaaacacccaaatctgttttcatcgtgataggacttgtattttaaatgccgtttattgtctgatctattgattagtagctgtacggtagtagtgtagccacttagcacaagctcatgaatttttcttccacatgggatgggaataccttgtaccctgagctgaggtatatcgtgcttctgaaccagattcgagggcacaatgataccaaacagaggccaggcggcgctgctaaccttctgcacctgcattagcctcgggagtgtcgggcttgttctatctatcgctgtcccagaaggtggcaacaactggttctggctcatgaccctgagccccttggcgtatgtctctctgctactcaactcccagcaattcagaatgaattcttccagtacaaatgcagtaactgacccttcatgatgaggtcccaggggagcgtactactggacgaaagcgtcaaggaaagaagagatcaaggtcaagatgatcctatccgatgacgggaacgtgtccgagatccttgtgcagggcgatgacgtccaggttgagcagatgaggaaggacctcaagttcagcgagaaggggatggtctatgtgaagggcatctttgagacatgactgggagtttcatactctatctgtgagtgaacaatcgagtggagacgagtctttgctgcaacggaaactgcgtaagcgtaacccaggtgaggaaatgcaaattggacgggcaaatctgtaccttggcttaaaggaaaaaaagaagtgatcttcatacgggatttgattattgtaagtgttgcccgtatgaggatagttaatgtatgaactcaaactaatgactttataaaaagctgatgagaaacacctttttgagcatgaaaaaaaaaaaaacacgcgtggggcggacgctcgcgatctagaactagt

SEQ ID NO: 23656 - DNA, 1087 bp, Zea mays
ccccagcccaaaatgaacgccaccaccgccgtggctgcgaggcgcctcctcctcccgctccgcgcccagccgccagcaccgcggggcgcagcgccggcctcggcgcacccctggtgtcgatccgttccgcggagacgacgagtccgtgccgccccggcgcgcgcgtcgctggaccgcgccgcggtcctcctcgacaccgcggccgcggtggccaacggcgggacaggttactcgcaggcgagctactacacgtctctgggactcttcgttctctccgttccggggctgtggtccctcatcaagcgctccgtcaagtccaagattgtgcaaaagacatttgtgaaagacgatggacagtcgatggcgccaaatcaggtggctggagagatcctgtcgttcttcactcgcaataacttcaccgtctcagaccgcggggaggtcatcacattcgagggcacaatgataccaaacagaggccaggcggcgctgctaaccttctgcacctgcattagcctcgggagtgtcgggcttgttctatctatcgctgtcccagaaggtggcaacaactggttctggctcatgaccctgagccccttggcgggagcgtactactggacgaaagcgtcaaggaaagaagagatcaaggtcaagatgatcctatccgatgacgggaacgtgtccgagatccttgtgcagggcgatgacgtccaggttgagcagatgaggaaggacctcaagttcagcgagaaggggatggtctatgtgaagggcatctttgagacatgactgggagtttcatactctatctgtgagtgaacaatcgagtggagacgagtctttgctgcaacggaaactgcgtaagcgtaacccaggtgaggaaatgcaaattggacgggcaaatctgtaccttggcttaaaggaaaaaaagaagtgatcttcatacgggatttgattattgtaagtgttgcccgtatgaggatagttaatgtatgaactcaaactaatgactttataaaaagctgatgagaaacacctttttgagcacaaaaaaaaaaaaaaaaaaaaagtcgacgcggccgcgaattcg

SEQ ID NO: 23657 - DNA, 1891 bp, Zea mays
atccaaactttactatataaataatatacgatgtaaaacaatattttttatggctatatacacgcttgctcatcacgtgcataacctacacaagtccaggagcacagaattttttgtgccatcactatcgctgtcccccatctttgctacagacagcatcaagtcttctgttttcagcttcagaaaatgtgcagctatactcctgtactgtggcaatcgtgatttcaagccgccgctttttgttgcgtgtggggcggcggtgaatatgcgtgaacatgataggagccacgtacctttacttgcaggagcacagcgtttctgcctacgagcaacagttctgtccccctgaaactacaaattcaagcaaaaacctaccgtgaagtttctgcaacattcagtcttccttcgatgacatctctaacgaaactgttcaaagaacaccgagaagatccaccttcctgaactgcgcggcgtgaagcctctctcagctccgcagcccttcttctcatctctaggctatcatcgtcagtcaaatccataagcttcgttacagtatcgcagatcgcggcccttccgacaacaccatcctcccttctccgttccctcaagtcgacgccgatcttccactcatcagccacgagatggccaatcaccagctgatcccaagcaacgggaaaggcaagcatcggcactccagcgaacacggcctccagggtcgagttccacccacaatggctcaggaagccaccgacggaggggtggcacaggaccttcagttggtcacaccacggcaccaccaagcccttgccaccagcagagatctgctcaagggtggcggtgctagctctgtcccgggccacccagaagaacctaaccgtgctttcatgcaaccccagggcgacctcttccagctgagacgaaggcatcgagacatgggtgccaaatgagacgtacagtaccgagcttcttggctgggcatccagccaaccgaagtagtcttcttcatggtgaaactcgcccgaatcaccttccagtggcatatatggaattgaagggccaactgcatatatagggcatggaaccacttgcgatgttccatcgatggcgccggtttcgagctcgtagaaggaggtgaagaggacacactgtgccttgcgcaggttggagaacacctgcgctagccgtttcattggcagcaccatggagcggagggtcttcatatcagaacattttaccggcgcgagggctgggaacgggagatattgatccagggacctgcagcttaggccttcttccccttgatgaccatccaccggcggccaacggtccaggtgccagagcgccaagaagaacgtggccggttgcgtccacagcgagcacaccggtatcccccgcgcagatccaaccccaacgccccaagccaggaaggtgtcggccacgatggcgtccggcttccgctccagggacagccggtccagcagccgctcgacgggcgccaccatcttgatatgcacggcctcgacgaagcctgcgaagtcggcgccgcggaccctctcggaggggatgacgttggggatggtggcgaggcggacgcggtcggggagcgtgccgggcacccccgctgcggccagcagcgcgtgccactcctctgtgacgacgacggtcacgctcaaggcagcgtccgcggcggcgagcaggcggcacacgacgagcatggggttgacgtgacctcggccggggtacggcactgcgaccacgtgccgagctgccgccgctgtggccattgtttttgctacgcgcagactgcagagcgagctgggctgaagactattacctcctgtacatagacgagatttgactggagcgattatagaggagatcccggccggcc

SEQ ID NO: 23658 - DNA, 1227 bp, Zea mays
ggccgctttttttttttttgtttttttgttttttttttttttttttttttttttttttgctcatcaaacaagtttttatttcagactgcaaactgtagtaagcagcaacagcatgacatcagtcttgcggccagaacgcatgcatccaacaacccagtatactacagagtacagacagcctacacaggccacaccgccacagacacgacgggaacacagccacagcccacaggcccacagctattccagcacacactagacaacacacgcaccgcaaatcctactacctctactagcgacacttgttggcggcggcggcgcacgggcgggcgcggcgcgcccagcccagcccagccctccgagctctagtggcagaagatgaccttgagctcgcgcggcgcggcgcactcgtgggtgagcgaggggctgtcgtgcgcgtaggtgaaggcctgcgggcactctcgcttgaagaactccgagtacttggaggcgcggcaggtgtgcgggctgttgtacatgttgcggcagcacagctcgtcggtgcggaaggcctcgcagccgctcttgcacgcgaggacgctgccggccggggagcgcagctgcagctcgccggggcaggtctcggtgaggttcttgcggcaggcgaggacggggcagttgccgcggccctcgtgcggggtcacggacaggcccacgttgaagccgtccaccacgctcacgccgtacgaggtctggtcgttgccgtggtggaggttcacctgcgccagcgtcgcgggcgccgcgccgccgagcccgccgcactggagccgcccgccgcagtcgcccgtggcgcagtggagctgcgcgccggcgcccgcgcagcccgtgcgcgcccagatgcggccggaccaggggtgggccggcgccgggaaggacttgtgggagagcggcgggaggaagaagccgccgccctccaggacgtcgtgcccggagttggcctggatgcccggccacaccgggtaggggcagttgttcaccacggtcagggtcattggggcgtagtcggcggccaccaggaggccgcagctcaggaacgaggtggcgagcaggaggagcggcttgggagaagccatgggttgggttctttgttcttgagtgagctggttgtggttgggacgcgagtccgctcccaccccgcctccgagcttacgtacgcgtgcatgcgacgtcatagctcttctatagtgt

SEQ ID NO: 23659 - DNA, 3732 bp, Zea mays
gaacaactacatgatgatgcaaacaatgtggtactactaatttacaatctgtttgatttttttttgaccaagtttgaccgacttgtcttattctttttttgtgaaaattggttaaaaaaaatttaaggtcatacttaaagtatattatatgctaaattataccacggtaaacattaataataattatgattttttaataagacgagttgattaaatttaaggtaaaaaatcaaataaattataaattgcaacctagtaagatagagaggattctaaagtccagtggcgacgagggtgagtcattcgaataactcgcagcttataaagcaagacatgggcttctcgtcagttagtgcaaagctgaaaatcagttgccttcagtctgtttagccgtcccaaaatgagtccatttgagacaggcacgcagcacaacatcaatgggccgtggcttggtggttgtattctgtttcagtgtttcgttccttttgagacatggtacatataagcaaaaagtatacactagataatccaataactaaagtacgaatgcccctaatctaataggtgtacaaatatacttccctcgattacattgaacttcaagctcaatttgaaaacttttactgaacattttttatgctattttgtatgaagctcggatgccgtgtgtcctcacacttatcgcatgaaatgctcacgcgtctgtctgtatttcaaaacgcaagttgagagcgtcgagaaggaaggccactccatttgtagctttaattgtttagctaaggatatatccttaacagcttctctatcttatcctctattttgagcttaactctccaaaatatgccatctaccgtagaaatctcttattttcacgatgtagtgaaagacaacctaagagatctcttaataaccccaatgctttcatattggattggagcaccgtgccctccacaatacctttcacaaggcgctcctctcccacacaggcgcacagctgacagtgtccatttgcttatgatggtgtactgcgcgttcttatccacttcacagggaccacccacgttggcggtttcactttcagttcacctatagcggcgctactaccctacagcgagtcagcgagtccttcgtgcagtcacgcgctccggcctttcaccgcttccgaggctctgcctcctaaagctttgctctattctcagccacagggagcatgaaccaagctcatgcaccggcttcatcaatcatcaatctcgcatgtccgttgggaataatgcacgcaacggttgtaaatcttgagcggttttggtgtcaaaaataaatttgatttgttctagacatgttaaccctaccccatataagaccgaggcaccgagcacgacttctttcacagtttaactctcatcccttccactatgtttattgtgtagcatgatttgaaaaaaaaaaaatagaaacaaactatttttttggcaatgaaaaggtttcgatattctcttcgtcaatcccctctgtaacaacttaaccgacatgtaactaattcatgtatgagcctttatgttggcaatgaaaaggtgggatatctcacaccctccccccgcgaatatctaaaaaaaaagaagcaaactatattaaaattttaaatttttcctagttaaatcatgtttctcggtgaaaagaagcgaaatccgatccggatgcgacggtttctaaggagaaatagcgaaatccgggaatttaaatttgaaaatttaaactgctcaagattgatgggtttttggtgatccctgcacagaacgtgcatacaccaaatacctaatcaacgttctcgctgcaccgttttgtacccacttgagctcaattctgtgctgtgagcctgtgacatagattcggagcagcggcgccaaaacggagagaaacaacccgattccatgatctaaaggcagaggtaaagctgccaaaaagtggaacgcgaaagggacaaggcggcactggtctctattagaagtttgacacaatttcatgttagattctagtttaatctagaaattccatcgcaaatgtaaccgatcgaagtatatagcaagtgggccgcctttttttttttttttttacagtgctcatcaaacaagtttttatttcagactgcaaactgtagtaagcagcaacagcatgacatcagtcttgcggccagaacgcatgcatccaacaacccagtatactacagagtacagacagcctacacaggccacaccgccacagacacgacgggaacacagccacagcccacaggcccacagctattccaggcatcctactacctctactagcgacacttgttggcggcggcggcgcacgggcgggcgcggcgcgcccagcccagcccagccctccgagctctagtggcagaagatgaccttgagctcgcgcggcgcggcgcactcgtgggtgagcgaggggctgtcgtgcgcgtaggtgaaggcctgcgggcactctcgcttgaagaactccgagtacttggaggcgcggcaggtgtgcgggctgttgtacatgttgcggcagcacagctcgtcggtgcggaaggcctcgcagccgctcttgcacgcgaggacgctgccggccggggagcgcagctgcagctcgccggggcaggtctcggtgaggttcttgcggcaggcgaggacggggcagttgccgcggccctcgtgcggggtcacggacaggcccacgttgaagccgtccaccacgctcacgccgtacgaggtctggtcgttgccgtggtggaggttcacctgcgccagcgtcgcgggcgccgcgccgccgagcccgccgcactggagccgcccgccgcagtcgcccgtggcgcagtggagctgcgcgccggcgcccgcgcagcccgtgcgcgcccagatgcggccggaccaggggtgggccggcgccgggaaggacttgtgggagagcggcgggaggaagaagccgccgccctccaggacgtcgtgcccggagttggcctggatgcccggccacaccgggtaggggcagttgttcaccacggtcagggtcattggggcgtagtcggcggccaccaggaggccgcagctcaggaacgaggtggcgagcaggaggagcggcttgggagaagccatgggttgggttctttgttcttgagtgagctggttgtggtttgtggacgcgagtccgtgacaagtgaagcgagggtcgtgggccgtgggtttaggtgggttagttttataggacgtggggtgggtgtcgtgggttttgtaattttgtttggctgaaggctttggcgaactggtgcggccgtgtccgtgtctcgatgcgtcgactccctttgcattttttatgcagtgaacaaaggacaaacctctcgcttcatcttccgtcgagaccttgctcttcaccgcagtaatacataacaacgacaagatataattccattcagaactcaagatgtacgcgaacactttgtccgcatgggaaaaaaatatctggcgattgattcagtcacggctattccatgcttggtttcaaggcacggaggttgccttcatcccgtttggtttatgccctgggatcccacccgacaggtccaggtaaactcttgaggtccgagcgtccgaaagaggtcgcctggctgggtgcgacgctgatgcagttcctttatttcatagtgtcccatttgattatgcatatttcacagatttgatcttatcc

SEQ ID NO: 23660 - DNA, 1139 bp, Zea mays
cgaaataatttatttattttgtttttttttttttgctcatcaaacaagtttttatttcagactgcaaactgtagtaagcagcaacagcatgacatcagtcttgcggccagaacgcatacatccaacaacccagtatactacagacagcctacacaggccacagacacgacgggaacacagccacagctattccagcacacactagacaacacacgcaccgcaaatcctactacctctactagcgacacttgttgacggcggcggcgccctccgagctccgagctctagtggcagaagatgaccttgagctcgcgcggcgcggcgcactcgtgggtgagcgaggggctgtcgtgcgcgtaggtgaaggcctgcgggcactctcgcttgaagaactccgagtacttggaggcgcggcaggtgtgcgggctgttgtacatgttgcggcagcacagctcgtcggtgcggaaggcctcgcagccgctcttgcacgcgaggacgctgccggccggggagcgcagctgcagctcgccggggcaggtctcggtgaggttcttgcggcaggcgaggacggggcagttgccgcggccctcgtgcggggtcacggacaggcccacgttgaagccgtccaccacgctcacgccgtacgaggtctggtcgttgccgtggtggaggttcacctgcgccagcgtcgcgggcgccgcgccgccgagcccgccgcactggagccgcccgccgcagtcgcccgtggcgcagtggagctgcgcgccggcgcccgcgcagcccgtgcgcgcccagatgcggccggaccaggggtgggccggcgccgggaaggacttgtgggagagcggcgggaggaagaagccgccgccctccaggacgtcgtgcccggagttggcctggatgcccggccacaccgggtaggggcagttgttcaccacggtcagggtcattggggcgtaagtcggcggccaccaggaggccgcagctcaggaacgaggtggcgagcaggaggagcggcttgggagaagccatgggttgggttctttgttcttgagtgagctggttgtggtttgtggacgcgagtccgtgacaagtgaagcgagggtcgtggaccgtggttttaggtgggttagttttat

SEQ ID NO: 23661 - DNA, 3924 bp, Zea mays
  misc_feature (3121)..(3121): n is a, c, g, or t
ctggccgggagcaaagctgctcatcaccgatggcgctaacacaagcaagcaagcaagtcactgagtagctagcagtatataccaccataaaaacaacacacacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtcgtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggaggaggtgcgcggcgcgctcgacagggtgcgccgcgccgccgccgcgcgggagcccctcgacatgagcgagctcctgcactccttcgtcaacaacctcgtctgccgcgccgtctcgggcaagttctccatggaggaaggccgcaacaggctgttccgggagctcaccgacatcaacgcgggcctcctcggagggttccacatccaggactacttccctagcctgggccggatcgagctcgtcaggaaggtggcgtgcgccaagaccaggcgcgtcaggaagcgctgggacgacctcctcgacaagctcatcgacgaccatgcggccaggatggcaacccatcaggacgaggacgacgataaggacttcatatacgtattgctgtctcttcagaaggagtatggcctcaccagagaccatatcaaggctatcttgatagacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccggccggaggatgtgccccggggtccactcggcgtccgcgaccatcgaggcgatgctgtccaacctcatgtaccggttcgactggcagctgccggcggggatgaaggcggaggacgtggacatgaccgaggtgtttgggatcacggtctcgaggaaggagaagctgctcctagtcccacaggctgcgtgaggatgatgatgatactagtgcaatgcgatacagggttttaaattagtaacaccaaaggctgtgttactggaccttaattaataattaataaatgtgctactactatatagccaggcttcacagtgacacatacttctattgcccatgctacatatatgtgttcttatttacatccccaataagtgttattgtgttgtatcacatttacctatatatatcaaatggaacatttctccaagtgctacaataacgaagattgttagggcatttacagcaccattaaatatatgtatcttgagcggtctcatgggaggtaagcgaaaaaaaattagaagaccgtttgttcgcgaagaactgtctcttacacaattttcaagcataatagacacttcagcgtagttgagctgtatttagagttaatacatttatgatttagagacattttgttgtccaataaagcctcttagttgtttgttatgtttggaggactgttccagtgtctaagcattatacatgcccttataaggtactttttttagaactctagtgacactttccatgacacacatgcatggtttacctattgcagtttttaacacatactacgagcaacaaatattcaaagacggaggtaatacaaatttttttaaaaagtaattattatacacctgcacatgtgtcaatgtttgtacagaggtaaatatacataataatataatgagtacaagaccatactattaaaaatatggacagataaaaatctactatttttactacattcaaactgcaggcatgcaagagccattctatatacaaatccaaccatttaccatcccatccagcagagagatcaatctactctagctagatcaaccaatgtcataaatcatatgtaagatctgtatagcctgaaaattcaacaaatgtcataaatgcaatgtcgtcctcatcacagcatgtaccacgcgcggcggaaatattttttaaaaaaaatactagtatttagttatatgacgtggtaaaacttaaagagctcaccagctctgtaggattcaaacagagcatgagcccaactcccatccaatatgaccaaggcgggacaacgttttattgaatccagccttatcttcttggtctcatcctgttggagttaagttggcccatgacgaccacaagggtcattttagttcaatatatatatatgctatttgacactattttctgtttttttctttttacttgttcagattcttaggtaattctcaaacattttgcaaatcaggaatgagagttacctactatatagtaaaaagaatatgaancaagagtgggtaaaactacaaaaatacaacagagtaacatgatggctcgggcaacgaaagaaatatgatgagctagcaactaaaaacaaaatagactagctgaaacaatgataggtagcctagagagaggtaaatatcgcgtttaaaataaaattcgaacttgctgttacaaacgagtgtggcattattgccgcttggcgcacgtcgctgggctggtcagcgacactactactcgatcagaggcattattattgctctctacgcgctacgcgtggcaatgtcgctcgatgcacaatgcttaacaacaactacacctacaaacattacttgtagatgtgtttggtgatgtccagtgacaagtccactaattacctacaatcaaaaacatgcacaaccaagaagatcgagtggaaaactagtaatacaattcaaaagagagacaacacacgatttatcctgtagttcaactcgccatcaaggcttatctttgtccactttattaaggaaagaacataaaggctttgaactatttttttcacttactcctcttttctaacaaaccactgacatgaactagggtcattttagttcaatatatgttatttgccactattttccttttttcttttacttctttaaattctcagctaaaaactaaggacgccaccttaaaaaaaaaccgtttaatatatgttatctgatgcgcagaatccaaaagcccaaataaggtccctatagtcgctcactggacacgctcttacaaatcctagccgtagtagtgagatttttaaaatatttgaggc

SEQ ID NO: 23662 - DNA, 805 bp, Zea mays
cctcgagggccggccgggcccgggggaccctcgaggccggccgggccgggagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggagagagagtgccc

SEQ ID NO: 23663 - DNA, 2214 bp, Zea mays
cattgggtacctcgaggccggccgggtgaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggaggaggtgcgcggcgcgctcgacagggtgcgccgcgccgccgccgcgcgggaggccctggacatgagcgagctcctgcactccttcgtcaacaacctcgtctgccgcgccgtctcgggcaagttctccatggaggaaggccgcaacaggctgttccgggagctcaccgacatcaacgcgggactcctcggagggttccacatccaggactacttccctagcctgggccggatcgagctcgtcaggaaggtggcgtgcgccaagaccaggcgcgtcaggaagcgctgggacgacctcctcgacaagctcatcgacgaccatgcggccaggatggcaacccatcaggacgaggacgacgataaggacttcatatacgtcttgctgtctcttcagaaggagtatggcctcaccagagaccatatcaaggctatcttgatagtaagtaaatagtccattatttatttatatatatacatcatatatatatctttgtggttcgaggccgccggaaccaatgaccaccattatatcgcaggacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccgggcggaggatgtgccccggtgtccactcggcgtccgcgaccatcgaggcgatgctgtccaacctcatgtaccggttcgactggcagctgccggcggggatgaaggcggaggacgtggacatgaccgaggtgtttgggatcacggtctcgaggaaggagaagctgctcctagtcccacaggctgcgtgatggtgatgatgatactagtgcaatgcaaaatacagggttttagtaacaccaaaggctgtgttactggaccttaattaataattaataaatgcgctactactatagccaggcttcacagtaacacatacttctattgcccatgctacatatatgtgttcttatttacatccccaataagtgttattgtgttgtatcacatttacctatatatatatcaaatggaacatttcttcaagtgctaaaaaaaaaaaaaaaaaaaaaaaaagaaaaatccgaggggggagaaacgggg

SEQ ID NO: 23664 - DNA, 756 bp, Zea mays
ccggccgggccgggagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacaaaacagaacccggagagcggccccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccccgg

SEQ ID NO: 23665 - DNA, 1452 bp, Zea mays
ttgggcccccccgggactcgatcatctcccatcacttcctagctagtccttcttactcaacacattattcgatcttgagtggaagcaagcaggcagacatggcggcggctactgcaccaaagacgatgccgtcgtccgttttcgccgccgcactgctgctcctagccgcggcggcgtgccaggccagcccttactaccctctggagctagggtactaccgttacacttgtccccaggccgaggctatcgtcaaggccagcatggagaaggccatcgcccagaaccctggcaatggcgccgccgtcatccgcatgctcttccatgactgcttcgtcgagggctgcgacgcttccgtgcttctcgacccgaccccgttcagcccgacgccggagaagctggccgcgcccaacaacccgagcctgcgcgggttcgagctgatcgacgccatcaaggacgccctcgaggccgcgtgccccggggtcgtctcctgcgccgacatcatcgccttcgcggcgcgcgacgcgtcctgcttcctgagccagggcaaggtctccttcgacatgccgtcgggccgcctcgacggcaccttctccaacgcctccgagtcggtcaagttcctcgtcccgcccacgtccaacctcagcgacctcgcctccagcttcgccgtcaagggcatgtcgctggaggacctggtcgtcctctccggcgcgcacaccgtcggccgctcccactgctcctccttcgtctccgaccgcctcgacgtcccctccgacatcaaccctgcgctggccgccttcctcaggacccgctgcccggccaacacgacgaccagcgacgaccccaccgtgatgcaggacgtggtcacgcccaacgccatggacaaccagtactacaagaatgtgctctcgcacaccgtgctcttcacctccgacgccgcgctcctcacgtcgccggagacggccaagttggtgctggacaacgccaagatccccgggtggtgggaggacaagttcgagaaggccatggtgaagatggccagcctcgaagtcaagactgggcaccaaggacaggtcaggaagaactgcagggcgatcaatcactactagctaacagctggttgttgatcagcttgcaccactgcaatgtggaagaccttcagaaaagaaaaactgcacagtacgggtgatggatggtgaaggatcaatcggttcagttgtgttggtgtttaatttgttcatgacctgcaagcgtgtggttgttgtatgatatggcaactgttgttattatctttccatttgcctttgatttgttgaaaacctggagaggtttgtatctgttattattctttggtttgtgtttctatatttggattatcaataaagttgaatatataagttcagtctttttttaaaaaaaaaaaaaaaaaaaaaacacacaaaaaaaaaaaaaaaa

SEQ ID NO: 23666 - DNA, 2314 bp, Zea mays
atccagcaaatctgtagttacgcatcatatatatactcatcacttggcacgaacgaatttgttatggctacagttttaaggtgacttgctcgatgcatatttgactttaggatcagtttggactacagttcacacattcgtacgttgagcagcctctgtccagggttagtgaagtgctgttgtctaacaaacgaataacatataaaaaccactcctcattttccttttttccccccttgcaccacccggaaaaaaggtaattattagcgagtaaacgattgtaaaccatgcaaaacacgcccatatacaatgacgtatatatggtcaacgatagttgcattgcacccccctcccctccgccttccagctataaatatcgtctcgctcctcacttgagcaccacctcgatcatctcccatcacttcctagctagtccttcttactcaacacattattcgatcttgagtggaagcaagcaggcagacatggcggcggctactgcaccaaagacgatgccgtcgtccgttttcgccgccgcactgctgctcctagccgcggcggcgtgccaggccagcccttactaccctctggagctagggtactaccgttacacttgtccccaggctgaggctatcgtcaaggccagcatggagaaggccatcgcccagaaccctggcaatggcgccgccgtcatccgcatgctcttccatgactgcttcgtcgaggtatttactttattttatatgagtcagtctgtgtctgtgtctgtgcctgtgtacacaacacgtccccaagctgtgtccttctatacatatatagggctgcgacgcttccgtgcttctcgacccgaccccgttcagcccgacgccggagaagctggccgcgcccaacaacccgagcctgcgcgggttcgagctgatcgacgccatcaaggacgccctcgaggccgcgtgccccggggtcgtctcctgcgccgacatcatcgccttcgcggcgcgcgacgcgtcctgcttcctgagccagggcaaggtctccttcgacatgccgtcgggccgcctcgacggcaccttctccaacgcctccgagtcggtcaagttcctcgtcccgcccacgtccaacctcagcgacctcgcctccagcttcgccgtcaagggcatgtcgctggaggacctggtcgtcctctccggcgcgcacaccgtcggccgctcccactgctcctccttcgtctccgaccgcctcgacgtcccctccgacatcaaccctgcgctggccgccttcctcaggacccgctgcccggccaacacgacgaccagcgacgaccccaccgtgatgcaggacgtggtcacgcccaacgccatggacaaccagtactacaagaacgtgctctcgcacaccgtgctcttcacctccgacgccgcgctcctcacgtcgccggagacggccaagttggtgctggacaacgccaagatccccgggtggtgggaggacaagttcgagaaggccatggtcaagatggccagcctcgaagtcaagactgggcaccaaggacaggtcaggaagaactgcagggcgatcaatcactactagcaaacagctggttgttgatcagcttgcaccactgcaatgtggaagaccttcagaaaaagaaaaactgcacagtacgggtgatggatggtgaaggatcaatcggttcagttgtgttggtgtttaatttgttcatgacctgcaagcgtgtggtttgttgtatgatatggcaactgttgttattatctttccatttgcctttgatttgttgaaaacctggagaggtttgtatctgttattattctttggtttgtgtttctatatttggattatcaaataaagttgaatatataagttcagttcttttatatatctcgtcccaaaaacctttgcacatgggtagactattttcttaataattacatctccagtctcataacaactccaacaattcccttatccccctctctcttaaattttgttacagaaatttttcttttggattagtttgacatctcgatttttccaagggaaaatgaactaatataccttaggaaaatgaatatctcttgaaaaatgatgttgtcaaactagcccttaaaggcttatttggctgcactccaaccaactctatttcacgcggtttgtgaggggtagttaattttctacatcaaaccctcccaactcatgccaacaagggtggattggagtacaactgaacaaaacctaatataggagatatagtgatgtctattatcacaacacgaatgctattttaactgaaactttt

SEQ ID NO: 23667 - DNA, 1439 bp, Zea mays
cgaggcccgccgggaccctccaggtcggccgggaaaaacaaaagctttcgtgccatttgccgtccggtccgaccgccttctccgcgagcgctaggagcaataaacggcaggcaccattctcggactcggaggcaacgcccagacgcgcaagcggaaggaagggggagcgcaacacgcgcggtcgccgggagagagagagagagaaagggcgagctagcgagcgagatccccctctcccgctgccggatccgatctgacctgacctcgtcgccgcctgccgtgggagggagaagaggaagaggaggcggaggcggcggagatggcaccggtgtcagcgctcgccaagtacaagctcgtcttcctgggggaccagtccgtcggcaagacgagcatcatcacccgcttcatgtacgacaagttcgataacacctaccaggctacgattggtattgatttcctgtcaaagacaatgtaccttgaagatagaactgtgagactccaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcaatagaggaaggggagggcaaggcgaaggaccttggagtcatgtttattgaaaccagtgctaaggctgggtttaacattaaggcgctgttccgtaaaattgctgctgcacttcctggaatggagacgctctcatcagcgaagcaggaagacatggttgatgtgaacttgaggtccggcaatgcaaactcgtcccagtctcaggctcaggctgggggatgcagttgttagttgcagtctctgacacttgcttgctcatgatctttgggactctgagcatcagaaggcgttatcactgatgcttctctcgggaagaagagttgattgcctctcgccagtgaacacaccatagtctttacccggtgaatggaccgtttgcattggaacgatacgttttatgagttttctgttatttcctcagtggcctaagctagcaacagtgtatagttgggttgacactcaaacttctaccattcgagttgggtattagaactagttattattggttcatgttgaacttatatatatttccatccttttgcagttagtttgagtcatatttgctgtgtaccaaacatgtattgcaaatttggaatttttgtaagctataataaggccagcacggcaatatccccacatgataaccccgaaatttgtatcgtttcaaagtccaaaaaaaaaaaaaccttttctagggggggggggggggggggggggggggggt

SEQ ID NO: 23668 - DNA, 1285 bp, Zea mays
aaacggcccagacgcgcaagcggaagaaagggggagcgcaacattcgcggccgcggggagggagagagacaaggggggcggtcacacacacgcggaccgcgcgagctagcgagcgagcgagatccccctctcgcgctgctggatccgatctgacctgaccttacctcgtcgccgccagccgtgagagagagaagaggaagaggaggaggaggcggagatggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagaggggcagtgatgttatcattgtgcttgttgggaacaaaactgaccttgttgacaagaggcaagtctcgatagaggaaggagaaggcaaggcaaaggaccttggtgtcatgtttattgaaaccagtgctaaagctgggtttaacattaaggcgctgttccgtaaaattgctgctgcccttcctggtatggagacactctcatcagcgaagcaggaagacatggttgatgtgaacttgaggtctggcaatgcaaactcgtcccagtctcaggctcaggctgggggatgcagttgttagttgcagtctctgacacttgctgctcatgatctctgagaccctgagcatcagaacgcgttaccactgatgcttctctcgggaaggagagttgatcggcattgaacacgcacacgctatagtttttacccggtgaatggaccatttgcattggaacgatacgtttgagttctctagtgttatttccagtggcctaagctagcaacagtgtatagttgggttggcactgcaaacttctaccgttcgagttgggtattagagctagttattggttcatgttgaacttatattattttctatcttgctgcagttatgtttgctatgtgtaccaaacatgtattggaatttttgtaagctataatatggccagcacagcagtagcctcacatgaaaaacaataaatcagaatcgttcaaaccgtgggcccctaaatttatatcgttc

SEQ ID NO: 23669 - DNA, 2020 bp, Zea mays
atttacagatttaatgcaggagacttacaaactaaacaagaactttacaagccatgatcatattgaaattttccttgacaaacattgaagaaatgtttagttttctttgggggggcatataaccattcaaggaatatgcatttcactgccggagtacggctctttgtcgagtacattttgtcgggtattcggggaaataacactctcgacaacgataacgtttactgagcgtgaaacactcggtatagacggatactcggcaaaaccatctttgccaagggcttaatgcgtatattagcgggagaccacagacgttttcgtttatttcataagttgtgccagtactgtacatgtcagatacaatactagcatatgagattggaccaacagatcatttatcttgacgccattctttggttgacgacacagcctcaatagcagagcctagaggccatgcagcttcgacgtagtactctccgtgcttcaccttgtccaccactgtgatctccttggtcctctccacaccaaagccatctactagcaaagtatactggtaggcaaggtccatgcacaggtagggcacatcgacatcgttgacgtttgggtattcgatcttggcttcttcaacactcatctggcaagccttctccgcggaagctccgaatgcgccaggggtagtgttcccgcttggtgcgttgccatctacgatgccgacctctgaggccacgaagtagaagctggatgcaacatagatgctgccttggcctgctccgccgccgccattccatatgccattgaaggtgcagttcttcatttcacatggcgcgttcaggttcagtgctctgccgatctcttccctgcacttgccatagactgctccttccggcgcggcagtcgcgtcatattgctcctcattgtaggtgtattgaccaatgaatccacgtaacctgctgctgctgaatggtccatcctttgccttcaaaatctctgctcgtgatgcaaaagcaccatagtgcaagtaactgtgagtatagatgttgtaatcttttcctttaagatactctcttgtaacataggggtcttccccatgaggcggcgccggagcacttgcagcggcatttgcagaaacggcataggccatttgcactgatccaccgcccatgtcaagcacagctactgtctgtgagtagtcccctcccaatttatccaacagataattcagagcaacctaataaacaacccatgctcagagcactcaaacacatatatagtgttaggggtacatatattaaaatgaggtgaccaaaaatagcatttcctgaaaggtcttttttgtttgtttgtttatgcttgataattaagtcatacccataggtatgatccttcttgagatccctcaatgacattgatccactcgggcttgtactgaaatttgctcttagtgtggataaggttcctgactgcttcgagaatctgctctgattgctcctctccgataagtctcaacccagcagtcgctccgagtctaagcggggtccttttcgtcagctgtttagggacggcgctcttggccttgtcaagaagaggcagcatggaatttgcagcctcttggggatgtccagcgtatgagctcagcccgggcttcaccttggcgaacacctcgatgccgtcgtcgccgatctcgaggagttcgagcttcctgtcgaacctgaagacgtgtacacgggtccctgtgctgccggcgtcgaagatcacggcgtacctcccagtcccagcccccgggggtgaactctcacgcgccgacgcctcgtcgacgacggtgccagctttccggccgagcacggagtctgcaaggaccgcactgctggggtaggacgacgacgaggccatcagctgctgcagaaggagcagcgccgccgcgatgccgacgacgaagtgaggcattattgctgcccagcaggatatgccttgctgatgcagtggcaaactggcaaccagtgaggcgtgtgcagatagtcgc

SEQ ID NO: 23670 - DNA, 3363 bp, Zea mays
  misc_feature (727)..(727): n is a, c, g, or t
  misc_feature (731)..(740): n is a, c, g, or t
  misc_feature (799)..(862): n is a, c, g, or t
  misc_feature (922)..(957): n is a, c, g, or t
  misc_feature (980)..(984): n is a, c, g, or t
  misc_feature (3319)..(3353): n is a, c, g, or t
tgacaagggatttaattttttaattaatattttttaaccggataataattttttccactatttttaatcatattcggcacgagggagagttctagtctcgagttttttttttttttttttttatcataaaatctgtggagaaggctttattattagctcataatacttttgatgcatcaataggcctctcccacctcacattagtctcaacattgacttcatattatacaaccctaagaaggttgatcggctgcaacaattgaaatctaaagactacgtcaagcgcttccctcttgtgatatcatcagtttgctggaaccttgtagcttccgcactggaagccatgctcaaatggcctcttacactgctcagcaacatacacaaccttctccatgcacacaaccttctcagtttctttggtgaccttggagcacaagcaagaaacgtttgccttcttgatgacaccacagcaagcatccgaaggagggacctttggattagctgggaacatcacgtatgtcttgcagtcacttatcaggctttggaggtcattctcacagtctccatcagcatgagagcctatggcaaacatagctgctacaaaggagagggctaagaacaggctcaacagttttgccatgtttactagttcttgggggacgcctattgaaaggttactaaaagatatgtgttgtgttgtccccgccccgcgcgggccccaccccgnctannnnnnnnnnggacgagcttccgccccgccccgatcgatcccgccgccatgtcgtcggcggccgtgtcnnnnnnnnnnnnnnnnnnnnnnnnnnnnnnnnnnnnnnnnnnnnnnnnnnnnnnnnnnnnnnnnagggtcggctcctcgccgttccacaccggcgccagcctgagtttcgcgttctgggcgccnnnnnnnnnnnnnnnnnnnnnnnnnnnnnnnnnnnnggtgcgcgctgaggctgaggccnnnnncaaggacgcgccgccggagaggagcggcgacgccccctggttgccccgcgctcggcgcaatgcggtctccaaaccgagggatcctcttcagccggtcggccggtacggctccgcgacgggaaacacggccaggaccggcgccgcgtcctgccagaacgccgcattggcggacgttgagatcaagtccatcgtcgccgcgccgccgacgagcatagtgaagttcccagcgccgggctacaggatgatccttccctctggggacatagcgccggagactgtcctcccagccccgaagccactgcatgaatcgcctgcggttgacggagattcaaatggaattgcacctcctacagttgagccattagtacaggaggccacttgggatttcaagaaatacatcggttttgacgagcctgtcgaagcgaaggatgattccagggttggtgcagatgatgctggttcttttgaacattatggggacaatgattctgggcctttggccggggagaatgttatgaacgtgatcgtggtggctgctgaatgttctccatggtgcaaaacaggtggtcttggagatgttgtgggagctttacccaaggctttagcgagaagaggacatcgtgttatggttgtggtaccaaggtatggggactatgtggaagcctttgatatgggaatccggaaatactacaaagctgcaggacaggacctagaagtgaactatttccatgcatttattgatggagtcgactttgtgttcattgatgcccctcttttccggcaccgtcaagatgacatatatgggggaagtaggcaggaaatcatgaagcgcatgattttgttttgcaaggttgctgttgaggttccttggcacgttccatgcggtggtgtgtgctacggagatggaaatttggtgttcattgccaatgattggcacactgcactcctgcctgtttatctgaaggcatattacagagaccatgggttaatgcagtacactcgctccgtcctcgtcatacataacatcgcccaccagggccgtggtcctgtagatgaattcccgtacatggacttgcctgaacactaccttcaacatttcgagctgtacgatcccgtcggtggcgagcacgccaacatctttgccgcgggtctgaagatggcagaccgggtggtgactgtcagccgcggctacctgtgggagctgaagacagtggaaggcggctggggcctccacgacatcatccgttctaacgactggaagatcaatggcatcgtgaacggcatcgaccaccaggagtggaaccccaaggtggacgtgcacctgcggtcggacggctacaccaactactccctcgagacactcgacgctggaaagcggcagtgcaaggcggccctgcagcgggagctgggcctggaagtgcgcgacgacgtgccgctgctcggcttcatcgggcgtctggatggacagaagggcgtggacatcatcggggacgcgatgccgtggatcgcggggcaggacgtgcagctggtgatgctgggcaccgggcgcgccgacctggaacgaatgctgcagcacttggagcgggagcatcccaacaaggtgcgcgggtgggtcgggttctcggtgcctatggcgcatcgcatcacggcgggcgccgacgtgctggtgatgccctcccgcttcgagccctgcgggctgaaccagctctacgcgatggcatacggcaccgtccctgtggtgcacgccgtgggcgggctcagggacaccgtggcgccgttcgacccgttcagcgacgccgggctcgggtggacttttgaccgcgccgaggccaacaagctgatcgaggcgctcaggcactgcctcgacacgtaccggaactacgaggagagctggaagagtctccaggcgcgcggcatgtcgcaggacctcagctgggaccacgcggctgagctctacgaggacgtccttgtcaaggccaagtaccagtggtgaaccctccgccctccgcatcaatatcttcggtttgatcccattgtacatcgcgcgtttgacggtctcggtgaagaacttcatatgcagtgacgcgccgctggggtcggtagcagtactatgggattgcattgagctgtgtcactatgtgctttcgacaggacagtagtgaaggttgtatgcaagtttattttttttttcattactgatatttggaatgtcaacacaataaatgaagctactatgtgtttcgtaagtataatgttacttatttaggtgatacttcattcaagttcagcgcggccgctcttgttagatcaaattacagcagtgaaggttgtatgnnnnnnnnnnnnnnnnnnnnnnnnnnnnnnnnnnnaatgtcaaca

SEQ ID NO: 23671 - DNA, 1974 bp, Zea mays
  misc_feature (1963)..(1963): n is a, c, g, or t
  misc_feature (1972)..(1972): n is a, c, g, or t
aaggagctccagtaatattttgtgctctgttttttgattattatcttcgcataacagtttcactaaataataggtacttcatcataatagacaacccaaaactatttgtaatgctacatttcctatatatcctcgaaaacaaattcgcaacttagatcaccctcatctcaagcatgaaacatgcaatatacccgctccatgctatgacgtggccatctctagcagaccgtgtaaacgatcgtgcaaagtactgttttgcacttattatagagtggagtttgaaatggtgagacagagtgtgatagggagtctgctggagatagttcttaaatataataacaagcacatctgacactccgagctaggcatatgaaagcatagatcaacactgtgaagccacaatgatagataactgatgagcccatgaagccacatcaatagatgaatgatgagcccatttgcattttgtactttgttttggaagagaaatcaaactagccatcctcaccgccagacaatggatcttgttccagcatatctactagagcacatatggccaaaactttgccaccagcaatgctgcaagttcactaatgacacaaatacaactaaggcaaccgttataccttttctatctcctgaaatggatgttgacaacagttggctgcatataagtctgctgaatcgaaagtgcaagcgggaaaaatgggtgaaacaagaaggacgagattctttttgctctgctgtcagaagcaccagaatctgaacctggcttgatcttaaatttgacaacattttgcctcactgacataaattttattggatgctctgtgcaatgccgatgccgatcaattgctgaaatcagcttctcatcatacctaaaaagagacaggtcgaagtacggtgaaggactttgtgattggcaagtgtaaggtaatgacgtcatcatctttttcacaaactgtgaggagctacttgctttgttttttataacccgaagttgatccaaagcatgaatatcattggaatgagaggagataaattttccatgtgatgaagcttgtgggtttgcatgaaaatgatcataaaattgttcaaacaaggcatagatatcctccgaagaattctgatgaagtgaaacgatatctgttgtctccatgttgtacacggcaaagaatgctaggttttggtcagtactccgagaaacccctccatccacactaccaaacttgacaaataggtgatggcgatccaaaaactgtaccttccatatgataagatcaacataatcttggaagtgaaaatagaacttcttctttagatgttggaccctcaaagtctgatctggaacctcattccacgtcttgcaaaaaatatatgacaacaaccgttgctttatgccaggaagaaaagaacccccataaccagtctgaatatgtgagtgaagaaatagctcatcatcttcccgacagaatgcaccaatgttgcgtacctcaacaaggttgcctgaatctcgtatctgtaggatatgtattgtttggtatcgcaaagaaacaatacaaagcaggtcctcatacatgtaagcaccaatactatgtgccagattgataaaatcattgcagaaagccttttcatccaggatcacaccatcttctagcctcacaagatggaaagttattttctcaatcaatggcaccccatgtattgcaccctcagtggcagttgattcgttactttgtgcagtagatgttgcaaataaaccaaatcgatggctcgccatgtacaggaaaaagtccttgcaaatatactcattgctagatgcaagaggaattgaataaagctgcttaaagaagctgtcaaacttctttgcctttggcggaagctcatgagtttcacattcttcattgcatgaatatgtgaaccagattggacggtatacaatcaaatcttgatggtttcggcntaaaagccnac

SEQ ID NO: 23672 - DNA, 2577 bp, Zea mays
ctgtaaacagtattttgcatttatagtaatgcatttacaatacaaaacagtgtttgttttcaaacccgactctgtaaacagtacatttacaacgtagaacagtcagggttttgcacgctgagatggcctctagtgtcccacaacaaaaaccaaatatttcctccgagcgaggaaaaaattacctgcagagaatccattggctgcccaccatcaggagtaacaagacttgcaccaaaaatgggtatactctagtctacaagtagaaagttatagaagaacaaaaaaatatcaaaccagtaagcttgtaatatttcatcttacagcaatgtctgtatatgtacaggagcaagttccgttattttcttttgccaacatcgatggcaacaatgacacttctgtaactaagacgtcgccgatgaagcaggaaaagaaaatgtctagcaaaaatgctagcaaagcctcttcaagccttccgtgccagcctccccaagttattccgctccatttaacctcatgttagtgactaaagatagatgaatagccatggccaagcaagcataacaaaaatgctagcaaagcctcttcaattatgtgaaaagaacaggtggtggttgcttgaagctggggctggaagcacctgctttatttgacgatgttaacatcttatccttagcagtggcattgcctacaacctgttcagaagaatccggctgctggttgctttcgctatggatgggtcgggcccaaatttttatcagcccctcgcggcatatagtgaggattgattcactagtgaattccaggccggataggggatctacatgtacccggtgtgcaacgagaggtgagagctttggcacatctcgcatccgtggagaaggctgtagaacaccggctggagggcacgcattatcccactgtgcagatgggcttccactactgaatgtcggtgagccaccagacggatggcgtagagggacagcaatctcttccaatgccagatcccagagaagcagttgggtatcctgtccaattgacccaaagcgatacatgacattttcttccgtttcatcagaatttggtggggaccaatacggatcaaaagaaactgcactaacccatgaattatgcccttcaccccatgcaactatctttctatcatccatgctccatacttgcacaagatcatcttcaccacctgataacaaatatttgccatccgcactccaagagcaacacaacagtgcaccgtagtaacttttcccaccaaatattagttgttctttagcaaagtcaaatactcttaaatggccatcacgcccaacagttgccaagtaagcaccatccggtgaaaaggaaatgtcattgattgcaccttgacagatgtgccaccttgcaattggattgctcttactcgactttgcatgtgaaatcagcacctgactttgatcctttacagttggaaatgtccaatcagtatttccatccttgcatttgtcatacacgtacagattcccatcagcatgactaacaacaaaaattccttcacgctctggaacccatgcaacacaagtgctccgactgctggcagcgccaccttgacttggatctttgtctttatctttgtctctattaacaaaatgctgatatgaaacgggcttctttccaggatcttgcagctgctgcctcagtgacattgaatagacatctcctgagaacaccccaacaagcagatcgtgcccatccttggcctctgggtcaaatgcatggcaaagcgggtttgagctactgaagtggatggactttattggatctttgtcatgtgagttgagatcactgatgaagagtgtatctgcagtattaaatatgatgtacgcgccctttccatcatagtttgccatgccttgcgatccacttgcactagtcgacacaccaattcctccacccatgcggctgcttcctgagacagccctgctggtaccattgctcccgaagctaagtgcccggctcccattcccagtgccgagaagtcttgcagctgcagaccgcatcccactaccagcacttggtgttgaaggcgtggaaccctggcctgctggcttctccttcaaatatgccactgtcatctgggagacggtcttgccgctgtggctgtagtgcacgacggcgggggagtgcgtcttctcatactgcagcttgtgccgcccctcgggggtcttgaagtaggtcttcagcccgccagaccccgcgccggccccgccggccgaccccgccgccgacgccatgctcccccacgggcgatcgcggaccgccgcaatgctcactcgccgaccccgcgcgcgtgcgcagacagacgaggccgcgtgagcagtcaccggctcatgcccccgccggtgacgcgaggggtagggccatggaggcgagggatgaggtggtcggattggggatgagacggggtggatgcgggagagccggagagcagaacgaagccttgcccggacgcggacgtgcggagaaagaaaaaaaaacgagttgattattttttgcggactcttcgtgtgtccatagaaaaattct

SEQ ID NO: 23673 - DNA, 2661 bp, Zea mays
atggggtcacaagagggaatccactcatcataggcctgtttcctgcacatcatgcacatggttatgcaaaacattatagactatattgtttgtagagtgaagcatgaaatagatgatgagatagaagatagaacaggtaatctactggagatatttcctgcattgcctaaacagacgatgaaaaagtgagggtgacgttttttttttttttttgtttttttttaagaaatgaattctgaattgctgtataacgtataaacttaagtagcgtttacagcagttagtgtgccccgacaaaaaccaaatattgcctgactgaggaaaaaatactgttctcacgcgggaatctatcggctgcccacctgactgcaccaaagaaacaaataatatcaaaccagtaagcttgtaatatttcatcttatggcaatgtctgtatatgtacaggagcaagttctgttattttctttcgccaacattgatggcaacaatgacacttctgtaactagaaacgttgccgatgaagcaggataagaaatggctaacaaaaatgctagcaaagcctcttcaatcctttactgcaagccttcccaagctactctgctccgtttaacctcaagttagtaacaaaagatagatgaatggccatggccaagcgagcatgataaaaatgctagcaaagcctcttcaatcatgtgaaaagaacagatggcggttgcttgaagctggagctgaaagcacctgctttatttgacgatgttaacatcttatccttagcagtggcactgcctataacctgttcagaagaatctggctgctggttgttttcactatggatgggtcgtgcccaaattttgattagcccctcacggcatatagtgacaattgattcactggtgaattccaagccagataggggatctacatgtacccggtgtgcaacgagaggtgagagcttcggcacatctcgcatccgtggagagggttggagaacaccggttggagggcatgcattatcccagtgtgcagaagggcttccactactgaatgtcggtgacccaccggaaggatggcgtagagggacagcaatctcgtccaatgccagatcccagagaagcagttgggtatcctgtccaactgacccaaagcgatacatgacattttcttcagtttcatctgaatttggttgggaccaacacggatcaaaagaaactgcactaacccatgaattatgcccttcaccccatgcaactatctttctgtcatccatgctacatacttgcacaagatcatcttcaccacccgataacaaatatttgccatccgcactccaagagcaacacaacagtgcaccatagtaacttttcccaccaaatattagttgttctttcgtgaagtcaaatactcttaaataaccatctcgcccaacagttgccaagtaagcaccatccggtgaaaaggaaatgccattgattgcaccttgacagatgtgccaccttgcaattggattgcccttactcgactttgcatgtgaaattagcacctggctttgatccttaacagttggaaatgtccaatcagtatttccatccttgaatttgtcatacacatacagattcccatcagcatgactaacaacaaaaattccttcacgctccggaacccatgcaacacaggtgcactgactgctggcagcgccaccttgacttggatctttatctttgtctttgtctttattaacaaaatgctggtatgaaacaggcttctttccaggatcttgcaactgatgcctcagtgacattgaatagacatctcctgagaacaccccaatgagcagatcatgtccatccttggcctctgggtcaaatgcatggcaaagcgggtttgagctgctgaagtggatggactttattggatctttgtcatgtgagttgagatcactgatgaagagcgtatccgcagtattgaatatgatgtatgagccctttccatcgtagttcgccatgccttgcgatccacttgcactagttgacacaccaatacctccacccatgcggctgcttcctgagacagccctgctggtaccattgctcccgaagctaagtgtccggctaccattcccagtgccaagcagtctcgcagctgcagaccgcatcccactaccagcacttggtgttgaaggcgtggaaccctggcctgctggcttctccttcaaatatgccaccgtcatctgggcgacggtcttgccgttgtggttgtagtgcacgacggcgggggagtgcgtcttctcgtactgcagcttgtgccgcccctcgggggtcttgaagtaagtcttcaacccaccggcccccgcgcttgccccgccgcccgatcccgccacagacgccatggccccccgcgggcgatcggaccaccgcaatgctcactcactgacctcgcgcgtgcgcagacagacgagaccaggtaagcgatcaccggttcatgcccccgccggtgacaggaggggtagggttttggaggcgaggggaggcgttgctcggattggggatgagacggcggtggatgcgggagagaacggagtctcggactcggaggagcaatcggagagaaacgagttgattattgcgaactgtgtcgatagagaaatccatatggcatcgggac

SEQ ID NO: 23674 - DNA, 3798 bp, Zea mays
  misc_feature (2606)..(2606): n is a, c, g, or t
gactcttaacgagattcgtgtagtgtgtccctcgataatcttttgtgtctcaccaatcatagtccctcgttcgccactgcgtatgtcatccttgctattgtaccaataattagaaaacgcggcagcctaataaataataaattagtttaatttgaagcacgtggacatggtcaggtttttttttttttgaagcgtttgatctgaacactttgtcgattgaagcggcgttcccataaaattgatagagccaagaagttggtcaccagtacctaacaacgcgcgacatttgaaaaagaactccaactgcatgtggacgtcaagtggtcaacgtactcgatttttagaaagacacttgccaatttggaaaaaaaaactgttggtctggacttttccacaagtagtggtgcttggtgtgaatgtgggtggacgttcagccatgcatcttcatacagagctgcgagaaaataattatagaataacgactttcccatcaagcaattactcggcacctacctgctcgcgaggatttgcgaacgtgtgcaccatttccgctgcatataaatagctacgaggcggctcgtatttttcatgcaccagtcgactctccatattcgccacatcttcttacgtagctctctctctctctctcgctacaacgagtagagtagagtagaaggggtgcggctaatcggagcactagttcatcctcagtccattcattcatcagtacacccagccttttccggcacacgcatctatggccccgccatcacacttctacaacaacaatggcgccccgcaggacgccgccagctacctccatgcgggaccaggaaatgtacctccacaggactcctgcttgctcgacgcagacgagttccgccggcagggccaccaagtcatcgacttcatcgccgactactacggccgcatggacgactaccccgtgcaccccagtgtcaacccggcctccctgcgccgccagctccccgacaaggcgccgtcgcgtccggagtcgtccgacgcgttcggtgccgcgctgcgggacgtccgtgacctcatcctgccaggcatgacgcactggcagagcgcccgccacttcgcgcacttcccggcgtccagcaacaccgtcggcgccctcggcgaggccctcacggccggcatcaactccgtcccgttcacgtgggccgcctcgccggccgccacggagctcgagatggtcgtcgtggactggctcggcaaggcgctccacctgcccgagagcctaatgttctgcggcggcggcggaggcacgcttctcggcaccacgtgcgaggccatcctctgcgccctcgtcgccgcgagggaccgcaagctcgtggacatcggcagcgggaggatcggagacctcgtcgtctactgttccgaccagacgcactttgccttccgcaaggcagcgcatattgccgggatccaccgcgacaactgccgcgagatcgccacgtaccgtgacgacatgttcgcgctctcgccagccgagctgcaggccgccatgcaggcggacgtggacgccgggctggtcccgctcttcctgtgcgcgacggtcggaaccactcagacgacggccgtcgaccctatcagagggctctgcgccgtcgcagcgacacacggtgtctgggtgcacgtggatgcggcctacgcgggctcggcgctcgtctgcccagagttccggcacctgatcgacggcgccgaagccgtggactccttcagcatgaatgctcacaagtggctgctggccaacaacgactgctgcgctctgtgggtgaagaagccagctctgctcgtcgcggctctcggcacggagcaggagtacatcctcaaagacgcggcctctgaggggcacgacgtcgtggactacaaggactggtccgtgacgctgacccgccggttccgcgcgctcaagctatggctcgtgctccgctgctatggcgtcgagggcctgcgcgaccacatccgcggccatgtgcgcatggccgcgtcgttcgaggacatggtcaaggccgacccacgcttccaagtcgtggcaaagaggcaattcgcactcgtttgctttaggctccgggcgcccgaggagttgggcggccccaaggcggccaacgcgctcaaccgaaggctcctagaggaggtgaatgcggcttgctccgggccctacatgagctccgctaatgtcggtggcgtctacatgctcagatgcgctatcgggagcacgcttacggaggagcgacacgtccgcgaggcatggacggttgtgcagaacgtagcttcttccctcctcgctaaaatggagatgcatgaagattattgacatcgcctttgcctaataagctcaactcattccactttgttgttgtttattaatttattctattattaagcatcaagttgtgtaacctattatatatacattacggcatgcattatacgactattaagtgagattttccttctgagtgaaagatggttataacatttttaaaataatattacaatgtcacactttgttggcatcccaagctacactcaaaatacattatgatgacaagaaactaaccatcgtcaactctatntatgaaaaatggtatacaaaaaatcaacaagtacttacatatcttctttcatcgtgacaaaagatgtgatgccacatgtgaggacaagcgccacccgcgacggtggcatggaacaccatacacggaatattttcccctactactagatcatgcttcaccaatacaagaattgtcctcaccgatttgaagcaagaagacgagtccatctcataatatgtgagcaaagccccgagtgcttgttgataagataatcttgatgaagaacccacctcttctattctctctggtctcggcgagaagttcagatatattgtgatagctttgccgaccaagtcagagctgctccaggtaggagatttatatcttgcataggagcaaaaggaaggcacttctctatggcagtgacatgagtttatccatgaactcgacatatagtggttgttgggggcagcatggacacgacaatggcatttcttgcgatcgccgagcaaatcacgaggatgtggattcaacaatagttcgatgtatccataatctcaagctctcactattgcacaggcagatcacgaggacgtggattcgatgtatccataatctcaagctcgcgacaataactccaacaaaaataacattgataccaggtccaagtgtcaactatgctacaagagaggatatattgttcttaactgttggcacatgtttaatgaggactttgtcctagatgagcattatgtcagatctactatattttggtatactgacatatgtgctatagataatatcacatgagaacctgagaagctaggggtctaagataaatacaaaggggctaacataatctacatgacaactagcacagttatgaagattagccatattaaacactcaactgttaaaattccaagtgataatatttccttaaacaaaactatttatattcttaacactagtagaagtcttatttttattcattgcccatctaaaggtagttctgcgtatcttgaatttcatcttgttattattttatcaaggatccgactacgaggaaaattcttcttaaaggatagtgtcatcaaggactctatcctcttccatccacatcatccaccaaactagttttctatgcgataaaaccaagtttcgtcaagtggaaatagatatttggtcatgcttatgttccctatagttgaaa

SEQ ID NO: 23675 - DNA, 2814 bp, Zea mays
aaaaattacactcaaaaaagtcgtttcttctcccgttggtgaaacatgattggaaatgcaagacacgtgtgctcagtttttcaagtagtactaaatgggaggttttcaaaaatgaaatttcctaaattagatggaaaatgcgaacaagacatgtagtattaaaaaagaaagttgcctcaacatttatctctagtctccttttttttatatgtgcagaatatttattattttttacaacacggagagctacatattactccctccatcccaaattataactcgtttgacttttttttgccatcttttagcctattcaatttttttggaaaaaataaaatattcaaagccgcatttaaaatatattatatcctaaacaatatcacatcaaagataaacaataattatgaattttttgaataagacaacggttaaacttaggataaaaagtcaaacagattataaattagaacggaggaagtattattttaagaagagaaaaaaagggagaaaagccaacaagcagaacacacaagacacaaggtaataccataggtgcgcattcaatattgcataaacacaacaaaataccgaagctaatacctaaattggcctgcaattaagtgtgatctaatttgatatatcatagaactaaccatgctgtcctgtaaacagctttctcactgatatatcatggaactaaccatgttgtcctgtaaacagctttctcaaagcattacgaaaggacattaaagcatcatcagactagatcacctaaagacatgtaatccaactttgcaccacctaattctagtagatttacccacactgctagtttgccaaacacttggatgatcaagctcttgttgaacatgcagagaagtcccccagaaacaacaacctcagtgtttggtggcaagaaccgatgactccaagaaacagggtatgtaaggggtaataaccacatagcccttttcaagagtgcagagaccacgcagttcctgagtatccatgttatatgatacaagtttctggttccagtgctgaacaaggatgaacgaattgtgatctggatgaatggccataatatcgaagtctttgattgggtgactcagtaattcaaagaactgcaaagagctcacattgtgctttaggatccatgcttgtgtatcatagtcctcaagaacccagatagacatccgcgtgaagcgcacttcagagccttgatctaattgcgcattcacaccgatgcagtgtagatggtcttgcggtcgcccagtaaaaacaattgcttcccacatccttaccatgccagccgataatcctacaagtttccccttccccatccactgcaattatcacattctcttgtttctgaagatctaaggcaagaaaatgcagcagaccatcgaccaaagcccagccacacatgactccaatcacggattcaccccacagctcccattcaccgccctcttcacctcgcccccacttgcttgacctgtcactccatgccttggtttcagacgagtaagagtgtaccgtttccacctccttcaccgccctattctcccagatctggaccaagtggaagtgcgaggagacagcagggttaatcatcagaaaggtgtgcgcgtatctttccccagcatccatgtccctttcaaatggaggtggaggaggacaagagccggagctggcgggcacagtcatcaattccttggtcgcagggtttgtcacgatgtacccgaacttgtcctcccgggtgcacccaaagagcaggagcccgttgcaagaatccaagaggaccatgcgctccacgccaggcagcactgccgtgatgaaggagaaggaagggtcgaccggaggcacgcgttctccgctccccgacaggctggtgaattggccgtagctgtgaggccctccgacgacgccttggaagaagccttccagggtctggggcagcttcttgccgttgagggggtcggtgatgatgttgcaccaagatttgcacacgcacgtgcaacggcggaggtctttgacgggcacgcgcgagaagatctccaccatcagctcgttgtggaggtccgccaccgccctcctctttgcgcagtccatgccgcgggagcggggaagggacgcgctgcaagctgtgagttgggaaggtgatgttcgggatggatgagcacgaaagacggggagtgcgaaatgcggcgaacgcggaactaaccggctgccggagagggtcggcgtccacgtcaatgctgcggcgctagccgacggcgcccttgctcagatgggggattctggaggaaagaagccttgagcacattcaatggtccgtttcataaatgtgctggggtccctttttttgcgttttataaatgttctaagaaaaaaacggaacgagcaaataatcatctttgctctatgagacttttgggatattggaatgtttatttttttttgcgtagtgcctttttctgcatatgaaatttgttgcgtaattcatgtaaaatttgtgagttctaaatgagagagtattccaacaaagtacaaaaattaaaatattacatcatttaaagtgtttaggacacttaaaaaacaaattaagctctattaggtaagaactaaatcatgtatgttaaaaagtaaattacattattagttgggccctatattttatgataggacattttaatttaaggtacggttgaagatactctagtaattgggataaagaacgaattactatcttagcaatattataatctatttagaattacttcggcaatggtggtagccagcttaaagttt

SEQ ID NO: 23676 - DNA, 711 bp, Zea mays
gtcccaggacacagccgggttaaccatcaggaaaggtgtgtgcatatttttcccccactataatcatcgacttccgcttcaaatgcaaataaaggtggaggcggacaagagccggagctggcgggcacagtcaacaatttcttggtcgcagggtttgacacgatgtacccgaacttgccctcccgcgtgcacccaaagagcaggagccccgttgcaagaatccaagaggaccatgcgctcgaccccaggcaccattgccttgataaaagagaaggaagggtcgaccggaggcactccgctccccggcaggctggtgaaatggccgtagctgcgaggccctccgacgccgccgtggaagaagccttccagggtctggggcagcttcttgcggttgagggggtcggtgatgaggttgcgccaagatttgcacacgtaagtggaacggcggaggtctttgacgggcatgcgcgagaagatctccaccatcagctcgtcgtagaggtccgccatcgaccttccctttgcgcagtccatggcgccgggagcggggaagggacgcgctgcaagcggctgccggtgagagtcggcgtcgacggcgacggctgcggcgctagccgacgggggccttgctcaggggatttgggaggaaagaagccttgcacgttttctaatagccctagattctctaaatttggaatctgattgtattat

SEQ ID NO: 23677 - DNA, 2419 bp, Zea mays
tttttttggcttgtttgaccccgtctattcaattttttgcgaaaaaatgaaaaattcaaagttgcattttaaagtatattatatactaaactatatcacatcaaagattaacaataattatgattttttaataagacaacggttaaacttaggataaaaaagtcaaatgaattataaattggagcagagggagtattatattaagaagaaaaagaagaaaaacagaggggaaaagccttttttttttttttttcgggcaataccataggtgcgcaggtgcgcattcaatattgaataatcacaacaaaaaaccgaagctaatacctatattggccagcaattaagtgtgatctaatttgatatatcatagaactaacaatactgtcctgtaaacagctttctcactgatatatcatagaactaaccatgttgtcctgtaaacagctttctcaaagcattacaaaaggacattaaagcaccatcagactagatcaccttgccccacacttggatgatcaggctcttgttgaacatgcagagaagtccccagaaacaacaacctcagtgtttggtggcaagaaccgatgactccaagaaacagggaacatatggggtaataatcacatagccctttccaagagtgcagagaccatgcagttcctgagtatccatgttatatgataccagtttctggttccagtgctgaacaaggatgaacgaattgtgatctggatgaatggccacaatatggaagtctttgattgggtgactcagtaattcaaagaactgcgaagagctcacattgtgctttaggatccatgcttctgtatcatagtcctcaagaacccagatcgacatttgcgtgaagcgcacttgggagccttgatgtaattgcaaattcacaccgatgcagtgtagatggttttgggattgaccaataaaagcaattgttctcacatccttaccatgccagccgatgatcctacaagttttcccttccccatccactgcaattatcacattctcttgtttctgaagatcgaagacaagaaaatgcagcagaccatcgaccaaagcccagccacgcgtcaatccaatcacggattcaccccacagcttccattcaccgccctcttcacctcgcccccacttgcttgacctgtcactccatgccttggtttcagacgagtaagagtgtaccgtttccacctccttcaccgcattatcctcccagatctggaccaagtggaagtgcgaggagacagcagggttaaacatcagaaaggtgtgcgcatatctttccccaccaaccgaaggtggaggaggacaagagcaggagctggtgggcacagtcatcaattcctcagtcgcagggtttgtcacgatgtacccgaacttgtcctcccgggtgcacccaaagagcaggagcccgttgcaagaatccaagaggaccatgtgctccacgccaggcagcattgccgtgatgaaggagaaggaagggtcgaccggaggcacgcgttctccgctccccgacaggctggtgaattggccgtagctgtgaggccctccgacgacgccgtggaagaagccttccagggtctggggcagcttcttgcggttgagggggtcggtgatgaggttgcgccaagatttgcacacgcacgtgcaacggcggaggtctttgacgggcacgcgcgagaagatctccaccatcagctcgtcgtggaggtccgccaccgccctcctctttgcgcagtccatgccgcgggagcggggaagggacgcgctgcaagcggctgccggagagggtcggcgtcgacgtcgatgggctccggaggcggggagtgcgaaatgcggcgaacgcggaactaaccggctgccggagagggtcggcgtccacgtcaatgctgcggcgctagccgacggcggcggcgcccttgctcagatgggggattctggaggaaagaagacttgagcacattcaatggtccgtttcataaatgtgctggggtccctttttttgcgttttataaatgttctaagaaaaaaacggaacgagcaaataatcatctttgctctatgagacttttgggatattggaatgtttttttttttgcgtagtgcctttttctgcatatgaaatttgttgcgtaattcatgtaaaatttgtgagttctaaatgagagagtattccaacaaagtacaaaaattaaaatattacatcatttaaagtgtttaggacacttaaaaacaaattaagctctattaggtaagaactaaatcatgtatgttaaaaagtaaattacattattagttgggccctatattttatgataggacattttaatttaaggtactgttgaagatactctagtaattgggataaagaacgaattactatcttagcaatattataatc

SEQ ID NO: 23678 - DNA, 1668 bp, Zea mays
cgggcaataccataggtgcgcaggtgcgcattcaatattgaataatcacaacaaaaaaccgaagctaatacctatattggccagcaattaagtgtgatctaatttgatatatcatagaactaacaatactgtcctgtaaacagctttctcactgatatatcatagaactaaccatgttgtcctgtaaacagctttctcaaagcattacaaaaggacattaaagcaccatcagactagatcaccttgccccacacttggatgatcaggctcttgttgaacatgcagagaagtccccagaaacaacaacctcagtgtttggtggcaagaaccgatgactccaagaaacagggaacatatggggtaataatcacatagccctttccaagagtgcagagaccatgcagttcctgagtatccatgttatatgataccagtttctggttccagtgctgaacaaggatgaacgaattgtgatctggatgaatggccacaatatggaagtctttgattgggtgactcagtaattcaaagaactgcgaagagctcacattgtgctttaggatccatgcttctgtatcatagtcctcaagaacccagatcgacatttgcgtgaagcgcacttgggagccttgatgtaattgcaaattcacaccgatgcagtgtagatggttttgggattgaccaataaaagcaattgttctcacatccttaccatgccagccgatgatcctacaagttttcccttccccatccactgcaattatcacattctcttgtttctgaagatcgaagacaagaaaatgcagcagaccatcgaccaaagcccagccacgcgtcaatccaatcacggattcaccccacagcttccattcaccgccctcttcacctcgcccccacttgcttgacctgtcactccatgccttggtttcagacgagtaagagtgtaccgtttccacctccttcaccgcattatcctcccagatctggaccaagtggaagtgcgaggagacagcagggttaaacatcagaaaggtgtgcgcatatctttccccaccaaccgaaggtggaggaggacaagagcaggagctggtgggcacagtcatcaattcctcagtcgcagggtttgtcacgatgtacccgaacttgtcctcccgggtgcacccaaagagcaggagcccgttgcaagaatccaagaggaccaatgctccacgccaggcagcattgccgtgatgaaggagaaggaagggtcgaccggaggcacgcgttctccgctccccgacaggctggtgaattggccgtagttgtgaggccctccgacgacgccttggaagaagccttccagggtctggggcagcttcttgccgttgagggggtcggtgatgatgttgcaccaagatttgcacacgcacgtgcaacggcggaggtctttgacgggcacgcgcgagaagatctccaccatcagctcgtcgtggaggtccgccaccgccctcctctttgcgcagtccatgccgcgggagcggggaagggacgcgctgcaagcggctgccggagagggtcggcgtccacgtcaatgctgcggcgctagccgacggcggcggcgcccttgctcagatgggggattctggaggaaagaagacttgagcacattcaatggtccgtttcataaat

SEQ ID NO: 23679 - DNA, 1771 bp, Zea mays
tttttttttttttttttttagagcggagggagtattatattaagaagaagaaaaaacagaggggaaaagccaacaagctgaacacacagggtaataccataggtgcgcattcaatattgaataatcacaacaaaatatcgaagctaatacctatactgaccagcaattaagtgtgatctaatttgatatatcatagaactaaccatgctgtcctgtaaacagctttctcactgatatatcatggaactaaccatgttgccctgtaaacagctttctcaaagcattacaaaaggacattaaagcaccatcatactagatcaccttgccccacacttggatgatcaggctcttgttgaacatgcagagaagtccccgagaaacaacaacctcagtgtttggtggcaagaaccgatgactccaagaaacagggtatgtaaggggtaataaccgcatagccctttccaagagtgccgagaccatgcagttcctgagtatccatgttatatgatacaagtttctggttccagtgctgaataaggatgaacgaattgtgatatggatgaatggccacaatatggaagtctttgattgggtgactcagtaattcaaagaactgcaaagagctcacattgtgctttaagatccatgcttgtgtatcatagtcctcaagaacccagatcgacatccgcgtgaagcgcacttcagagccttgatctaattgcacattcacaccgatgcagtgtagatggtcttgggattcaccaataaaaacaattgctctcacatccttaccatgccagccgatgatcctacgagtttccccttccccatccactgcaattatcacagtctcttctttctgaagatcgaaggcaagaaaatgcagcagaccatcgaccaatgtccagccacacatgaatccaatcacggattcaccccacagctcccattcaccgccctcttcacctcgcccccacttgcttgacctgtcactccatgccttggtttcagacgagtaagagtgcaccgtttccacctccttcgccgccttattctcccagatctggaccaagtggaagtgcgaggagacagcagggttaaacatcagaaaggtgtgcgcatatctttccccaccaaccatgtccctttcaaatggaggtggaaggggacaagagccggagctggcgggcacagtcatcaattcctcggtcgcagggtttgtcacgatgtacccgaacttgtcctcccgggtgcacccgaagagcaggagcccgttgcaagaatccaagaggaccatgcgctccacgccaggcagcattgccgtgatgaaggagaaggaagggtcgaccggagccacgcgttctccgctccccgacaggctggtgaattggccgtagctgtgaggccctccgacgacgccgtggaagaagccttccagggtctggggcagcttcttgcggttgagggggtcggtgatgaggttgcgccaagatttgcacacgcacgtgcaacggcggaggtctttgacgggcacgcgcgagaggatctccaccatcacctcgtcgtagaggtccgccaccgccctcccctttgcgcagtccatggcgccgggagcggggaagggacgcgctgcaagctgagcgtggccgaagagtgaggttcgggatgcgtcgacggctgcggtctgcggatgcggcgctagccgacggggcccttgctgagatgtggggtttgggaggagagaagcgtcctaatagccaaagatttaatt

SEQ ID NO: 23680 - DNA, 840 bp, Zea mays
atgactccaatcacggattcaccccacagctcccattcaccgcccttttcacctcgcccccacttgcttgacctgtcactccatgccttggtttcagacgagtaagagtgtaccgtttccacctccttcaccgccctattctcccagatctggaccaagtggaagtgcgaggagacagcagggttaatcatcagaaaggtgtgcgcgtatctttccccagcatccatgtccctttcaaatggaggtggaggaggacaagagccggagctggcgggcacagtcatcaattccttggtcgcagggtttgtcacgatgtacccgaacttgtcctcccgggtgcacccaaagagcaggagcccgttgcaagaatccaagaggaccatgcgctccacgccaggcagcactgccgtgatgaaggagaaggaagggtcgaccggaggcacgcgttctccgctccccgacaggctggtgaattggccgtagctgtgaggccctccgacgacgccttggaagaagccttccagggtctggggcagcttcttgccgttgacggggtcggtgatgatgttgcaccaagatttgcacacgcacgtgcaacggcggaggtctttgacgggcacgcgcgagaagatctccaccatcagctcgttgtggaggtccgccaccgccctcctctttgcgcagtccatgccgcgggagcggggaagggacgcgctgcaagcggctgccggagagggtcggcgtccacgtcaatgctgcggcgctagccgacggcgcccttgctcagatgggggattctggaggaaagaagccttgagcacattcaatggcataaatcat

SEQ ID NO: 23681 - DNA, 1643 bp, Zea mays
aaaaggaagggagtatttatttacacttattcaatatacccactaggggctacaatcacaggcaaaacccaactaaaattaggcaccaacaagatattacataggccggtgagagctctcaggattatccaaataggctgaagcccacatgaagggcgggcgaacctctcggccttgttcgttctgtcttttaaggggggaacgtagtaggtttagccgtttagccaattcagtaatacagcagcctcatatgtagagttaaaacacaggttttgaaatgtgagcactacaaatcgaaacaaaactggaaacatgagcgagaatgacaactcagtccaaggatcttttcattgccaagtgtgtacaaattcctcaagcagaccaaaaagctgcttatccagagcaacatcatcaaacaagcagaccaaaaacctaggatctgagcctgctctacatgcgccatggccaaccagcaacatctaacatctgaaccaagaaactgaaccggttggtaatcaaacagcctctgattcgtctgttctttatctacattttgatgctaaagtagtcagaatcaaaatgatgcagccttacatatccatcttcaccaccacttgaaaagctccgcccatcaggattaaatgccaaagcattaattggcccaaaatgccctttaacaccaccaatttcctcttgcaaaatcttgtggtagaatttagcctcgaatttaccagcacggcggtcagtcatagtcacattcattgcatcctgaccacctcctagaaccacagtatcatgagtgggagagatgtcaacagcattaacaggtctctctgtgacatatgtcttgatcagggtcagcgttcttgtatcccatagcttggcagatttatccaaggagccagtaataaaatgtgaccaatctagggattttgacaatgatgaaatggtcttctgatgtccggattccttgtcagactctttcagaagttgtccagtctctgaatcccaaatgcgaacggtggcatcctctccggcagtgatgatggtcctgttgagcggcccccaaacggccctgttgatccttcccttgatgccggtgatgacgagtgcagactcctccgtctggtcgtcgatgtcctcggcgatgcgcttgacctggacggtggggacgtggtccatgaagttgtcggtggtgacgacggcgagcgcgtccccgatggcgaactcgacggacctggcgggcgcgtcgaagcggaagctgaagagctccttccccgtgctgacatcccagagcttggcggtctggtcggcggatccggtgatgagacgcgccgagtcgcgggagacgtcgcaggtccagacagcgccgttgtggccgcggtaggtgccgaggcggtcgccgttgtcggcgtaccagaccgtgggggtgtggtccttggcgcaggagaagaggaggtccccgtcgcggttgtagcgcaggaacgtgagcgggcgctcgtggcccttcatcaagatcggcctcatcgtgtctcgctgttgctggtggtgctcgccgctgaggaggaggagagggtggtggcttgatttgggtttggatgcgtcggcggcggcggtgggggggaccccctcgggggccccaa

SEQ ID NO: 23682 - DNA, 1718 bp, Zea mays
atgatgcttctgccagtttgggtctttcacatagatgtccatctgaaggtagcaacaaaacatgataggatagaggcagaatggtaccattcaattcgcagcaacggttttagaaacaaaatgagtacatacagacaggaggtggtcgtcaaggaattgtctcctttgaaataacccgcctgtctcgctaatcgaaaaaaacgcaacggtcctgccaacgagcacctgctctgctctcgccggctctctaacccttccgaatcccctcctcgcaacagcccggcaatcacctgccccacgaccaccaccataaatcaccagacgatggagctattccccgacggggccttcgtgcggctgcagagccgcgcgagaagaacgtacgtccacgccgacggggactgggcgggggtctccctgcgcccgaacggacccgtcccacccctgaacgcggtgtggcgggtggagcatttggtctggtcggaccagggggacacattcgtcctcctccagaatgccgcctacggccgctacctctccttctcgatccaggaggcgccgcccggccaccgtggccgccgcaccacccagctcgaccgcaacgagccccacgcgctgagcccctcctccccgtggatgtggagggtccagaggttggacccgcccgaccatggctacgtccgcctgcgctacttcggctgcgacctccgcgccaacggtaggcaccgcacctggaaaacctgcgtcaccgtcgacgtcaaccgaggccgcagggtctccaccatgatgcagtggacggcccacgtcgtcgcagcgagctcggtaccgccgccccttccagcctcacctcagcctcagataggaggctgctgtggcctgttgttctggcggcgcaccggggtgcatcagcacccgccgcagacgatccggcacgtgcgggcgagcgacgaaggggacttcgaccagaatcctcacaactggccctcgttcgtttcctacgaccactccgtgatgaacctgaggatccagctggggcagctccaggacgactgggacggggagatgttcggcttcacgctgtgcatgcggcccggctcgcatggccggctaacgccactggtcaccgacctgcctcgcagcctagatcccatggacatcgtcgtcttcaggaccggatcaccagctgctgctgcattggtgtatgcattctgtagaggagtacgatagcggaacttctgacaacgtcgaaattcatcggttcaggaaccaaaaacatttaagcttgctgcccctgaccctgatattgtgacacgagaactggctcatggtttttgaaagttcagtagcttttctgtaatggtggttagatctgatacgctctactgattcagtttcagaacatgaaaccgctgaaagcgtcatgtggaagtaattgtgaatggttctgcaaagtaacatctaatatgttcgctgcggctttaacccagctgttcagactgctgtaattgtaattaatagagacaaaatattgtagaaaaagtagaaccagcgagttgtatttgccatcgtcatctccgttgggtgatgaaatgatggcaagaatagatctggctgattttgcctgtactttgatcctgacacgtcagaaatgttaattgtgtctaccttttagtcatggactgaaaattttggttgcagccaaaaaaaaaaaaaaaaaa

SEQ ID NO: 23683 - DNA, 1666 bp, Zea mays
aaccacattcatcgtgtctatatatataaagataagctccttttgttagtacacaagcatacgcattggccacgtgtatgcatggatacttaagtaaattttgccttttaagcaaacaaaaaaacaccgggttttgaaatgggtctactaccgtattggaacaattagatgaacagagaatacaaatcaaaactagattggaaaccatggagcgagaacgacagctcaagacagcagttcaaggatcttttcattgccatgtgtgcacaaattcctcatgcagaagacaaagctgcttgtccggagcaacatcgtcttaaaacaagcaacagactgccactacccctagaggagctgagcctgctctgcgtgcgtcatggccaaccagcagcacctgaaccaaaaaaaaaactgaagcagcacctgaaccaagaaactggaccagttgggcctcaaacagcctcggattagtctggtgttctttatctacatcttgatgctgaagtagtcggaatcaaaatgatgcagccttacatatccatcttcaccaccacttgaaaaactccgcccatcaggattaaatgccaaagcattaattggcccaaaatgtcctttaacaccaccaatttcctcttgcaaaatcttgtgatagaatttagcctcgaatttaccagctcggcgatctgtcatagtcacattcattgcatcctgaccacctcctagaaccacggtatcatgagtgggagagatgtcaacagcattaacaggtctctctgtgacatacgtcttgatcagggttagcgttcttgtatcccatagctttgcagattatccaaggagccagtgataaaatgcgaccagtccaaggattttgacaacgatgaaatggtcttctgatgtccagattctttatcagactcattcagcagctgtccagtctctgagtcccagatgcgaatggtggcatcctccccagcagtgataatggtcctgttcagcgggccccaaacggccctgttgatccttcccttgatgccggtgatgacgagtgcagactcctccgtctggtcgtcgatgtcctcggcgatgcgcttgacctgaacggtgggaacgtggtccatgaagttgtcggtggtgacgacggcgagcgcgtccccgatggcgaactcgacggacctggcgggcgcgtcgaaacgaaagctgaagagctccttccccgtgctgacctcccatagcttggcggtctggtcggcggatccggtaatgaggcgcgccgagtcgtgggagacgtcgcaggtccagacggcgccgttgtggccgcggtaggtgccgaggcgatcgccgttgtcggcgtaccagaccgtgggggtgtggtccttggcgcaggagaacaggaggtccccgtcgcggttgtagcgcaggaacgtcagcgggcgctcgtggcccttcatcaggatcggcctcatcgtggcgcgctagtggtggcggtgttcacctccgccggaaaagggagaaggagctggggcggtgctagtaaccagcgaaggcctcggcagtcggcaccaggcgtcggcgttagagcgagcgagagcgcggcggctggcaccaggcgttagggttacttcgcagtacgtcccgccctggccggcggctcggcctccccccg

SEQ ID NO: 23684 - DNA, 1437 bp, Zea mays
aagacagaaagatcggcatggaaccatggatatataaaagcacagcaggttttattttgaatcccacgtcccttttgatttacgtattccctccttgtgggtaaaaatgttgcattaaataaattatcatgccttgttggatagactagagtaaaactagtagtagtcagaaatgatgtgttatagtatgaacacaaaatgcatcaccactgcccatagccccgtaacaacaagcaactgatggggcattcttagggctagataaccaaattatagtggacaccagtcctatctgcagccagcatcctaacctctgaatcccaaatgcgaacggtggcatcctctccggcagtgatgatggtcctgttgagcggcccccaaacggccctgttgatccttcccttgatgccggtgatgacgagtgcagactcctccgtctctgcatgtacacaggatctcaaggtcaaggatgctggcttgccattcaaacgaaacagcggaggaggcatgaacgaaagcgttgttgagaaggaaaaagcactgacggtcgtcgatgtcctcggcgatgcgcttgacctggacggtggggacgtggtccatgaagttgtcggtggtgacgacggcgagcgcgtccccgatggcgaactcgacggacctggcgggcgcgtcgaagcggaagctgaagagctccttccccgtgctgacatcccagagcttggcggtctggtcggcggatccggtgatgaggcgcgccgagtcgcgggagacgtcgcaggtccagacagcgccgttgtggccgcggtaggtgccgaggcggtcgccgttgtcggcgtaccagaccgtgggggtgtggtccttggcgcaggagaagaggaggtccccgtcgcggttgtagcgcaggaacgtgagcgggcgctcgtggcccttcatcaagatcggcctcatcgtgtctcgctgttgctggtggtgctcgccgctgaggaggaggagagggtggtggcttgatttgggtttggatgcgtcggcggcggcggtgatggaaaaccctagcgcgtcgagttatagataggcctcttcactcctctacgaaagaacactggcgtccgtgttccttcctggcccagcacatggtgctttcctggcccagaaatccgtacgggccgggccgtgcggtttgatccttcctcgctgctcatgctagattcggccatctacgctgcacagatcacgcaaccgcacactatgccggtttagtttgagtgactaaaaattagtccatatattttagtctcatttaatcgacgatatatcctatccaatcatttatttgttgtaaatctgcaatcaaactatccaaagcatcaaattatatccattggtttcatatgagaagtgattaaatgtaaagcaggcactaggtttcaaatggaaggggat

SEQ ID NO: 23685 - DNA, 1108 bp, Zea mays
  misc_feature (42)..(47): n is a, c, g, or t
ccggcaccactttattttcccgtcaggtttaacttggtgcannnnnngccaatctccatgacgatgccaccactcatcagttcataattccagcagccttgtacgagtcgacggtgtccctcagggtttcctccaccgtcctgcacttccaccccagcgcctgcagcctcctggagctgactctcttctcgtcttccacctgaacaaacttcctggggtattgcagcagcttcaggtccgggcgcaagctgggcacgaggccgaccgtttcggacaccctcatggcgtgcgcgctgcagatgtaccgccggccagacgcctgcggcgtctcgtacgtcaggacgagagcggccgcgacgtcgcgcacgtccaccatgttcctcgtcttctcctcggtgttttctcctttcaggtacgtcacgaagcgcatgctggtggcgttcaccgtcggctgcagcagcggccccagaacccacggcgggcagacggtgaccacgtccatcgtcccagtcctctcgccgtacgccagcgcctcgcgttcggccaccgtcttggaaacgcagtaccagttcttagtggttctgcagtagtcctcgtccgaccagcagtcttcgtcgacgacggcgccgtcggggatgctggggttcgcgatcaccgcgccgaccgacgacaccaccacgacgcggcggacgctggccgcgtggctagcctcgagcacgttctgcgtgccggtcaccgccggaacgaggacttcgtcggggttcgtgggctcgacggccgggacggggctggcgacgtggaagacgccgtcgcagccagccacggccgcggcgacgctggcagggtccagcaggtccgccttgaacagccgcagccgctcgctggcgccgcccagcgccgccaggtgcgcgttcttggggtcaccggggtcgcgaacagtgccacgcacgaggtagtcgcctctggagaggaggagctgcacgagccacgaggcgacgaagcccccggcgcccgtcacgcacaccgtcttcatcctcgtcttggccgcgtcgccgccgccgtccatggctatgctggctggtcctggcctctctcgatcctcccccgg

SEQ ID NO: 23686 - DNA, 1209 bp, Zea mays
tccgccccgagccagatcgtaggcggcgagcgcaccgccaccggaggggatggcgcggagacggggcggccccgcgccggcgacagcggtcgcctcgccggccgtgctcggcactgtggccgtcatggtgttcgtgtactactccacggtgttcgtcttcctcgatcactgggtcggcctcgccacgccgatcggcgccgcccacgccgccgccgtctcgctcgccgtcgccgcgtgcttcctcgccttcgtctgcgccgcgggcgccgacccgggcgccgtcccacccgccttcgcccccgacgccgaagccgcgcagggacaggggttgaaatcaaggtattgtgataaatgttgcatgttcaagcctcctcgtacccaccactgcaaggtctgcagaaggtgtgttctgaaaatggatcatcactgtgtctggatcaacaactgtgtaggatacgcgaactacaaagccttcatcatttgtgtcctaaatgcaactattgggtctctttattcatttgtgatatttctatgcgatctacttctgaaagagcatgactttgatattctatatgtgaaaatactctatatcttggcaggtgtcctcttgttcttcttaagcttgacaataggttctctactaggctggcacatctatctattgtgtcataacatgacaaccatagagtaccgggaggcagtaagagcgagatggcttgcaaagaagagtgggcagaagtaccgccaccggtttgatcttggaatactgaagaacattcaaatgatcctgggtccaaacattctttgctggctttgccctactgcgacggggcatctgaacgatggcaccgagttccaaatcacgaacaactgatgaatgcgccagcagcatttccagttaccacgtgctaccgtgtagatttccctgttcattcttgtaaccaaattgctccggtaggcctacaatcctgttgcattggctttcttgcgtcttgctagctagggcacctgtagaaaccttcagttcttcccgatcttgtaacagcatgtaaagctttttctccctctcccagtctccatgtattttgttcattttttgttgttgtacgagtaaagttgttcttgaggccgaacctactctactgaaacattggatcgtgaagttaatgtgaatatgtgctgcaacttatcccaaaaaaaaaaaaaaaa

SEQ ID NO: 23687 - DNA, 1758 bp, Zea mays
  misc_feature (1642)..(1642): n is a, c, g, or t
ggaaggccagaatcttccttcgaataatgaggcgagaagagaaacattaaaagggaccaaagggggaaaccccatcgtcaccacatgcatgctgagaatcatgaatttgaagaaaaaataataatatatggaatagtgtaaaacggtagtagcagtagcaagaactaatgaaacagtaacggctgtctagtttcaagctagggaacggcttgattaaaccttagttacacaggcacacggtcgctcgaatatagccgcagcagcagcagctaataactaataatgcgaaaatcccatcacctaataaacaaactcctacatgaaatgacatacacctgagcagcagcacatcagtgaagagctagcagtgtgtgtgtgttaagctcgcacaccttacctcgtagtcgtagttaagcacgtacgttcatcactctctcatcgcttcgcttccttgctcctcctggccctggagccgctgggccgcggccggcggcgcgaggaaccccatgaacccgccgccggcgccaaccagatggctgaagccgacctgcccagccatcgccgacggctgctggtggatcgcggccagagggtcgagccaagtgcgggccgcagacggccagccgccactggactgaaggggttccccttgggagaagagctgcccgccctggtggtctagccccccttgccgtgggggcacgccgaacatgtagctgtcgccgccattgccggctcccgcgccgttctccgaagcatgctgccacgacggcattctctggccgtgttccgccgcccagccttggacgcctgctgcaccagagatcataccgtgctggttcggggacacatggccgaagaactgctgctgctgctggtgggcttggtggctattagcggactggagagtgaggcaaagctcctgcggctggtggttggtggtcgtgcgcgacaggaggtccggcggggagcccctgtactcgtcctgggtgggggtggtgctggctgccgacgacgaggggaacaaagacttgacgttcgcggagccggagacgccgccatcggcgccgccgacagaatgtggcatgaacgagccggccatagcaccgatggcgccaccggggttgccgaaccggtagggcgacgtcgacgtcacctgctcggccggctcggtggcatctgccgcctccgtgggaggctgctgcacctccacccggtcggccgggatctcgtcgatggcggccttagcgttgcggatgagccagtcgacggccttgctggggcggtcgtagcctagccgatcctgcacgtcgtagaaccggatggccgtgtgcgccgcgaggcggacacggcggtcgcgcagcccgcgcgcggtgcacaccttgctgtggcggtccttgcgcccggcggcggagcgcacgatgcggccgctcacgaatgcggtggccagcgcgtccacgggcgtcgactcgccgctgctgacgccatcggcgccggctcctgcagccctcggcggctgctgctgctgctgctgctgctgctgcctcccgtggtgctggaggtagctgaatccttgctggtgatagatctggagctgctcctgcgcctgcgctctctccttctcctggagcaggtagtgcanggtgctggtggcggcggtagggttgctccaagggtcaagccccttggacactggttcttgtcctccttcagcttgagctaactcacttgcgcactccctacaacacagccgggaaa

SEQ ID NO: 23688 - DNA, 2120 bp, Zea mays
aattcggcacgagggttttttttttttttttttttttttttttttttataaaaattatataaggcaatacatattagagccaaacaaacatgcttatcaaattcagaacctaatacacattaggaactgggtcatcaaatacaacgatcagtagactggttaactacaataatcaaaactccactagcatgtaagtggcaactgggtcattgccccgtcattacaaaacatcagttcactaccatcgctcccacaatccatcatctctgaccgcaatacccagccagcctagcttccattccatcaccgtgtcatcacacgactcactcgctacttcgctagacactacacctcggcagcagcttgtaactcactcactcactgggtgctgctgagctgctgaaccacggcctccatggtcggccgctgacctggcgtctcgctcgtgcaatacgcagcaacagccgccagcctcgccgcctccgttctcgagaacgcgccggcgcggttcgcgtcgaccaggccgccgaggtcgctgacagcggcggcgccgaccttcagctgggagacgtccctccttcccgtgaggacctggaggaccacgaccccgaacgcgaagacgtcgctcttgtccgtgaaccggcccgtggcggcgtactcgggcgcgaggtagcccatggcggcgctcgctttcagggccgagaagacgacgtcgtctgcgaggagcttgtgcagccccggcaccgagagcctcggcgccaggtggtggtcaaggaggatcttgtcggccgatatgttctggtgcaccaccggtggcttgctgcccttcttgctgtggaggtactcaattcctttcgcaatgcctctgatgatggaaactcttgtaggccaatcaagaacggtagcaccggaagaaccatccttgacgtccagataccgcgacaggcagccattaaccatgaagtcatacacgaggaagcattcccctctccccctggagcagcagaatcccctcaggctgacaagattgtcgtgctgtaggagggtgagcatcttcagaccacgcaggaaatccgactcctcttgcttgcagctcgtcttgctgaggcttttgacagcgactaccgatccatcccgaaggatccctttgtacgtcgcggcggcgaagccactcttcccgagcaagttcacgtcggagaagtactgcgtcgcgcactctacctcctctaggttgaatctgaagctatcaccaactacttgaccgggtgatccaacaccagccccacctgcagacaacgggtcccagctgttcgagtactcgacgctgatcaaaggagaggcgctccttctgcaggcttccttctgctggaaatggtcggtgctgagcctgctatcagaaacctccagcgagcttccgatcttctgtttctgccggcggtaccaggagaacgcaaataaaccgcaaaatgcagcaccgatcaccgccgcgacaacagcgacgataagaactccttgggacgcgtttgcggactttgagcagctagcgcctgagcagccgtctggatttgctgattgaggcacctgccttgtcttgacagtaccgtctggtccaaaaggctcgggcttgctgggcttcaggccatcctctgaagaaaggcaaagctctagcaaactgaagccagcgccacaaagccctttgttattcatatactggaagccaccattcagtctcctcaatccaacagggacactcccagaaagggtgttgttgcgaacatcaaagacctcaagcaatggaacctcagcaatcttggacgggattgaaccaaacaggctgttgaagctcaaatcaagccgtctcagctgtgttagctcaccaagggttgccggaatggctccagcaagctgattagactgcatcgcgagcacggttaacttattcagattgcccagctggggaggtatgctgcctgtcaaccccggcccgcccggccgcaacacttggaggttggcaatggcagcaatctccacgggcacgggcccggtgagatggttcacgtcgaggtacaggtccgtgagctcggacagcttcccaatctcccgcggaatgggccccttga

SEQ ID NO: 23689 - DNA, 4523 bp, Zea mays
tgctcacgcaggtcgtcggcgatgggattcctgcgtgctggattgctgcgaggcgtggatagcggcgaggggatgtgttttcttctgtggcagtgacacgatttttccttccatggccgattgcggctaggaccatgcgaatgcaggggtagtgagggagggtgcgtacggtgtgaagaagggagacactaacatatgggtcgtatgcgtcgtgagaaggcagaactgtgcaccacggtctacgttaggttcatagagtagtatagatagtaagagatttccctccatggattccctttaaattcgttactaacaaatcaaccctaaacgagctgagctagtagcacgagctagtagcacaagtacatacaaaccagactgatacacatcttctttaatgtcagctgtagctgcaattcagagagacaaaattttataaaaattatataaggcaatacatattagagccaaacaaacatgcttatcaaattcagaacctaatacacattaggaactgggtcatcaaatacaacgatcagtagactggttaactacaataatcaaaactccactagcatgtaagtggcaactgggtcattgccccgtcattacaaaacatcagttcactaccatcgctcccacaatccatcatctctgaccgcaatacccagccagcctagcttccattccatcaccgtgtcatcacacgactcactcgctacttcgctagacactacacctcggcagcagcttgtaactcactcactcactgggtgctgctgagctgctgaaccacggcctccatggtcggccgctgacctggcgtctcgctcgtgcaatacgcagcaacagccgccagcctcgccgcctccgttctcgagaacgcgccgtcgaggttcgcgtcgaccaggccgccgaggtcgctgacagcggcggcgccgaccttcagctgggagacgtccctccttcccgtgaggacctggaggaccacgaccccgaacgcgaagacgtcgctcttgtccgtgaaccgccccgtggcggcgtactcgggcgcgaggtagcccatggcggcgctcgctttcagggccgagaagacgacgtcgtctgcgaggagcttgtgcagccccggcaccgagagcctcggcgccaggtggtggtcaaggaggatcttgtcggccgatatgttctggtgcaccaccggtggcttgctgcccttcttgctgtggaggtactcaattcctgcaaattaatgtgcaaaactcgatgaacaagttagacaactaagacgctgatacgcatcaatcttcgttgggatacagagtggggatgatacctttcgcaatgcctctgatgatggaaactcttgtaggccaatcaagaacggtagcaccggaagaaccatccttgacgtccagataccgcgacaggcagccattaaccatgaagtcatacacgaggaagcattcccctctccccctggagcagcagaatcccctcaggctgacaagattgtcgtgctgtaggagggtgagcatcttcagaccacgcaggaaatccgactcctcttgcttgcagctcgtcttgctgaggcttttgacagcgactaccgatccgtcccgaaggatccctttgtacgtcgcggcggcgaagccactcttcccgagcaagttcacgtcggagaagtactgcgtcgcgcactctacctcctctaggttgaatctgaagctatcaccaactacttgaccgggtgatccaacaccagccccacctgcagacaacgggtcccagctgttcgagtactcgacactgatcaaaggagaggcgctccttctgcaggcttccttctgctggaaatgatcggtgctgagcctgctatcagaaacctccagcgagcttccgatcttctgtttctgccggcggtaccaggagaacgcaaataaaccgcaaaatgcagcaccgatcaccgccgcgacaacagcgacgataagaactccttgggacgcgtttgcggactttgagcagctagcgcctgagcagccgtctggatttgctgattgaggcacctgccttgtcttgacagtaccgtctggtccaaaaggctcgggcttgctgggcttcaggccatcctctgaagaaaggcaaagctctagcaaactgaagccagcgccacaaagccctttgttattcatatactggaagccaccattcagtctcctcaatcctagcatccaacacagaattgtagtggttaaaataccatgaagactaacaaaaaaaagtacaagtttcagaaaggctatgagattattaccaacagggacactcccagaaagggtgttgttgcgaacatcaaagacctcaagcaatggaacctcagcaatcttggatgggattgaaccaaacaggctgttgaagctcaaatcaagccgtctcagctgtgttagctcaccaagggttgccggaatggctccatcaagctgattagactgcatcgcgagcacggttagcttattcaggttgcccagctggggaggtatgctgcctgtcaactgattgtaaccaagctgcaacactgcaaaagggtagtgagagaactatgtaaattaatttatggcattgcaaatcagcacttttgatgttaaaagaccaaactcatcagctcttttctgaactttcatgatagacgtgaccataacctggcctacgcagctagcatgtggactaattgcatgtgcaagtaaacaaataaacccctgtggcatccaaacgatactcctagtcgaatgcccattaggatacaaaatattactataaacctagttctacaaaacaccaaaacatgaacagaagaacgacagatcgacattggtggggaagacctaatcatcaaagccgtatccacatgtatgattagtcccggttcagatttcacaaagagcagaaaaaaaaggtaacacaaagagctcaaaatcaagtcaaatcgaagaaattccttctgtcctgctggcaaacgttctgtatctcagcgacagatccaatctgaagccacgccgcaaaaatagtcccctcagaagcagaaacaaaaatattgagtaaaatataccggtggccaatgcttcaactctcaaagaagctcgcacagatgtgcacgaataaaataaaatataaacatttgactgctacacactgctccaaaagaaaacccagaatagaaacgcaaaatcagagagtggttggtgagaagtatacacatgacccgtttcaaaaaaataaccgttgcactgattgtggcatgtaggtgctgggtgcagcacctagtaagaagcgagtgcatagcggttgaattttcacattgatgggcaactgcttttcgcgctttctgctcacaaatactctatcaaactctagtactatacagtagcagacgagtaaatgagccacctaaaaacaaaactgactttaagatgtctccattctgccaaaaaaaaccagcaagaaactgacgaaaaatggaataaccattttcgccatttgaaatacggatcctttgtaccaaaacgaggaaagaacggccatggatagtgcaatggttcttgaatcgctgaaaatggagcttacgcaacttgtacttaaacagtgccactttggtttgaaaagaaagcaagatatccagcatggaagacccctaaaaggatttctgtaacttagcaaaaggtgaagtagcccctttataaaggtcaaatggaggaagagaacatattcctcccccagtgttcaaatccgaaatacgaacgagctcagaatgtcaggcacgtaaaccccagtcaccaggcaagcgaaatgttcactgattactgaacccaggaaaagccaaccaagaagatgtcctttatccaactttccacccagaaaaacccgagaatgaaggcacggaaagctcaaaatctcaccttggaggttggcaatggcagcaatctccacgggcacgggcccggtgagatggttcacgtcgaggtacaggtccgtgagctcggacagcttcccaatctcccgcggaatgggccccttgatgccgttgtagtggaggtacagcccctggagccgccgcagcccggcgaccgccggcggcagggttcccgagagcccgcggccctgcagccatgcggcggtgacgcggccgtcgcggccgcaggtcaggccgacgaatgagccggcgcatgggtcgccggaggggtcccaggagccgaggacccggccggccgggtctagcgcccgcttgagcgccgcgagcgcgcgggcgtcctcctcgttgcgcgcggaggcgccgaggacggagaggaacaggagcaggagtgagcggaagctcgtggtggccatgggaacagagggggcttgaagtggcggagggaggacccggacagagtgatgtagagtgagcggactgtgacagtgtgactgtgaggggagggcctgattccgcacgttcgtgcgccctttgtctcgttataaagttttgaattttg

SEQ ID NO: 23690 - DNA, 1431 bp, Zea mays
ttttttttttttttttttttttttttttttttagattaaaatcaaacgaataggcttatcagtagactggttaactacaataatcaacactccactagcatgtcagtggcaactgggtcattgccccgtcattacaaaacatcagttcactaccatcgctcccacaatccatcataatctgaccatggcggcgctagctttcagggccgagaagacgacgtcctctacccagccagcctagcttccattccatcaccgtgtcactcgctacttcgctagacactacacctcggcagcagcttgtaactcactcactgggtgctgctgagctgctgaaccacggcctccatggtcggccgctgacctggcgtctcgctcgtgcaatacgcagcaacagccgccagcctcgccgcctccgttctcgagaacgcgccgtcgaggttcgcgtcgaccaggccgccgaggtcgctgacggcggcggcgccgaccttcagctgggagacgtccctccttcccgtgaggacctggaggaccacgaccccgaacgcgaagacgtcgctcttgtccgtgaaccgccccgtggcggcgtactcgggcgcgaggtagcccatggcggcgctggctttcagggccgagaagacgacgtcgtccgcgaggagcttgtgcagccctggcaccgagagcctcggcgcaaggtggtggtcgaggaggatcttgtcggccgatatgttctggtaaccaccggtggcttgctgcccttcttgctgtggaggtactcaattcctttcgcaatgcctctgatgatggagactcttgtaggccaatcaagaacggtagcaccggaagaaccatccttgacgtccagataccgcgacaggcagccattaaccatgaagtcatacacgaggaagcattcccctctccccctggagcagcagaatcccctcaggctgacaagattgtcgtgctgtaggagggtgagcatcttcagaccacgcaggaaatccgactcctcttgcttgcagctcgtcttgctgaggcttttgacagcgactaccgatccgtcccgaaggatccctttgtacgtcgcggcggcgaagccactcttcccgagcaagttcatgtcggagaagtactgcgtcgcgcactctacctcctctaggttgaatctgaagctatcaccaactacttgaccgggtgatccaacaccagccccacctgcagacaacgggtcccagctgttcgagtactcgacactgatcaaaggagaggcgctccttctgcaggcttccttctgctggaaatgatcggtgctgagcctgctatcagaaacctccagcgagcttccgatcttctgtttctgccggcggtaccaggagaacgcaaataaaccgcaaaatgcagcaccggggggggggcctacgtagctga

SEQ ID NO: 23691 - DNA, 3151 bp, Zea mays
ttttattgtccaacatttttaaaattatatgtggtcatatggtgcgccttcatagaatttcatgatttttttagactatttatgcattattaattttttggagaaagtcatcaaaatacaattaaatttatcaaatattctagggtggatcaaaaattgcaaataagttatcaagactaacaaccgttctataagaagataatcttaagtcccaacataaaaatgataaacaatctattaattggatataaatttggactttttcaataatttcgacgtaaagtttattcaaacaaaaatgtgatgtactataaagttgtagatctcttcagactctacaattttcatataaactttatcttcatccgatttcatacgtaaaaattatgattttataataatattatgaaaacgggtacccaaaatccgggtaaccatattcgacccgaatatctgggtatttatcggatagttctcactttatatccgatctgaatccgaaggtgcactatccgggtactatctgtatcggttccgaatataaatactcgaatttgtataaaaaatgggtacttttattatccatattcggtatccgacccgttgacatccctactactaaggtcctgtttgtttcagattataatctggtgagattatataatccagcgcaaataatccgacgggtaaacaaacacctagattatagatacatattatataatctaattttcatattatgataatctcataatctactaagagtagcttatttcagattatttttggtaaaatacctactacttagtaaagtagttaaaaattacaaaacttgtcatcaccatctattctatcagtcgtccatatcttctccaggctccaagccgccgcccctgcgcgctacgcatccctaagcacgccgccccctaccttccaccaagtatgatatttgtacacaagttttattttgaaattcaaaaaactttgtttttaaatttttatgttggaaataaataaaggcattgttgccattatgacttagataatgccaaacaacatatatattataatctagacagattataacatgaattatataatctagattataatccagattatataatgtataaactgaaacaaacaggacatcactacaggtctacagcctcccgcattcatggccgccccagccgactgttgcatgcatctgctagcgccacacggctggctgtaatccgtgtggtcaccatgccatggctctcggttggattcggctaaccgttctgaacggcgacaaaacaatataaagaagctgaatgcggccacaacacaactgcgcatgcaaatacaatgacgcgccatggtaagggtccagaatataacacctcccattaccttaaaaaaacacctgcccaattcgctatctgttcccgtgattacaacagtccaatcaatggatgcaacgggtattcgcagagcacgtagattctgctccacgacgtcgtgccaggtctactaggtccggccgccgccacgggcatgacctcacgcacgcagccgcctcagctagctgcaggcggctcgcagctcatggccatgggcgtccgcagccgagccgcccctgcccatgttcatcagggtggtcaggtgcgagacctccttgggcaccgacgccgtcagcacctcgtggccgtcgtcggtgatgaggacctcgtcctcgatccggatccccataccgcggtacctgctcggcgcgcgctcgttcaggaccggggccgccgggatgtacaccccgggctcgatcgttattacgacgccaggctccaagggcttgtccttggggagtgtcatggagtcatgaatatccatgcctaacgagtggcctattgcggttgggttcaagtagttgtattggatggatttccccttctccaggatcctcagttcttggaatccctttatcaacagctttaccgaatgattgtgtatctcgttaatgcttgtgccgggtttacagagctttatgcactccttatttgtctccagtattaggctgtacagctcttcctgagcaggtgaaaacctgccacagggtggccatgttcgagtcagatcgctaaggtagccatgatactcgcagccaacatccatgagcagaagatcacctgtcctgatttttctatcgtttcttgaataatgtataatgctgccatttgctcctccaccaactacgggatggaacgccattctttgggcacctctcattttgcactcgtattcaatcttagctgccaactggctttcctctctgtgggtcctcgacatcaacattgtttgtaaaagagactgagaaacaatagatgctgattccctcatcaacttaatttctgatttcgacttgacccaccgtaattcatcagtgtaatttgtaagatcttttactttattgttgagtgatgccctacgaaaggcatccaagttcttataagaagatgttgtattcacattgtgatacaccccttttgattgctcaatcagttcaggaaggatcttttgcatctgactaagtggaaatgctttatctgctttaaagaaatccacagcagcctcaactccagcagtttcaccttgccaaactaaatcctccttatttgtatctggcatgaacatgcagaaccctgtttcttcactcaaaactgctactccaccgggttgtgtacaacctgtaatatacaggtaatcaccattctgtctgaatggatatggcactacatcagtcatcatctgctgatcagcagaagcaataatggccaagctcttctctggtagcacctctaaaagtttttttcttctagagatgtattcctcgtttgtgatgcctggtgtgatctctccatcagctaataactctggatgagactggggtgttggttggccaacatcgactatcccaccagctgtgtatgcagctcgctggacgaaaccatgggaagcagatagaaatcgagatgccacctcggttgctcgcagcagccgcgccgccatggccatcggcaacagcctccttgaatccctttctcgagttcgcttctctctcggtcccctcctgctgcggtgcgagattctctctctggctcaagttcgcttc

SEQ ID NO: 23692 - DNA, 1599 bp, Zea mays
  misc_feature (10)..(10): n is a, c, g, or t
gcctcaatcnaaaatgtcattggtaaaaatgttggaagtgcagtatgttaaaagtaattaattctaaatttgacaacaccactcataataggaggtacatctttgcctattattgcatatgtttcttctcgccaagacgaacagatcagggatcctccaaacagaaagtaaacgcccttgcttatcgtcccataggaccaaaatcccccacttgataaatagctcaagaagcatcgatgaaaagaaagaaatcacatctttcttgaagtaaaacaacaacaacacagatgctctaaacaagctggcaaagctcactaagcacccatggcaacccttctgcccctcttgggcgtcgactgtgcattctctgccaagatcctagacagaatatctgcttgctttgagtatccttcggattttaagctctccatcaagtcatcgcagcctttctggctgacaacacctcctttgttcttgatcttgcacagcatggagtacgcaggcaacgtcttttcttcggcgtacagggcctccagaactctgtcataggtcgagaagctaacatcaaagtccctgtccaacgcaaaatcagccagcttctgcgcctccatcactctaccattgtcacataggccgaccagcaacttatccagatcaggcatgcagccattttccaccatcagattgacacggccgattgcctcctcgacatggcccctcgtgaatagagcttccagtatcttgtgtgccacatccatgttctcagtaactcccttctcaatcatactcttcatgaccctgcttgcggtctgaacccggccatcgttaaacagcgcctccatgacagacttgaacagagctgggcttggcaagtgaccctgttgcatcatgctgtctaatgccgtctttgcatcagccggctcattcttcttcaggaagctatcaactagcagcgcatgtgattcagggtcagttgggaccccgcggcgtgtcatgatggcgagaatctcctgagctgcctctggcacaccttcttttgcatgtccacggatgagactgttgaatgcagccttgtcatccacacctttcttcatcagctgcctgaagaatgtctcggccttggcggtgctaccattgctgcacaggaactcgatcaccgggttataagccgatgcttcaagcacaggactctttgggctcagcaaggtgcccttctccataagctcatctagcacctcaatagcagtctcgcacttgccgccagcgcaaaggccttccatcagcaccccatactgtcttggatccaccagcacatgcttgaactgcccgctcttccggtgcacctcgagcgccccatccaagtcaccagccttgcacagcgttgtgacaagcctcagaaacactgacttgtcctttggcgtgagcctccgctctgccatgtcatccactgccttccgggcctctgccaccctgccctggtcatcgcaaagccctggcatcaacgcagcaaatgtcttctcactcagcctcaatcctttctcagccatctcagcgaacaacgccactgcctcttccaccctattgcccttcacgtacccc

SEQ ID NO: 23693 - DNA, 2436 bp, Zea mays
atctaccgattccatcgcgtgacaaaatatatatttcctctatttagagaaattgaaactaacacatactatgccccccagctgcaacttctttgttgcatcaaaacgagaacatgcatttctttgatctattacatcaatacagaagggtttttttttttttgtgtgggaataactgaaccatatttcattatattgcaatgtaaaacataatacatgtatagagtgaactatagatcattgttgagatgaactttttcctaatgacccccaacttttctattggatcacaaaactgaatcgacaaaatttcctcgattaatcctcttggcagttgacaagccaccatgtattcgttttactgtgatgttgtcagaaggatattcagtgtagctgttaacaaatccctgcgtcgcctctggagtcctggcattacctttgagggacagtattcaaactgcgctccaggtcaggtcttgctttttattccttcttgttatggaaaaaagaatttcaattccgacagagttccaccatttgtaactatatggaagctgaaattcactgggaacagttatgccaaagtggacaaggttgttcgagtcatctaattccttcagctacaacaaaggtccatgcccagtaggaaaatgactaggatgaacaccacgctttggcctttcattaccataccgtctcatttcaactggaccccaaccaagaattcctgcagaactactagattcctgcaacctatttccatttgtcataattggaggttgatacaaaggctgggtgtcaaactgattatcagggtctgctctccgtcgacgcttccaggcttcagaacttccagagctctcattattgtgcaaagactcagaattgtactggagagacctggttggcctatggtttcttgtaggatgaagttgatttgagttacctcccttgctggaaggaatggatgtgaaattggcaccatgagatgggccaactccaccttccagttggtcttgactaagtttcaaatagagatcatgcaattgctccccagacatgtttgaaaaggtggcaacataattccataacctcatggtcatgcgggaggtgcggctacacttacgggattgcctataagattcactgtgttgccggacaacttcaccaattttgtccccaattatcaggagatacttgcggattcttgaaagaaccttttcctttgggaggtttacacttgtattctgcagcctgtccaggcgcttcaaagtttcctgttcctcatttaaaacttcagagcaccattcgagccacttctcctctttgtccagacgatactttgtctctgcctctgattcagaaatttcaccttcttctcttgcttcagcttccatcattaccttgcgcttctgaatgtcatctttgttcggcttattatcctctttatctggtgcatccttttgtcggcctctcattgatcgagctccactattactgtcgttattgactgtctggcgggcatttcctttgacttttgagctattaccgctaaacttagcatattccttttgcaggagagcgctagcacggttatccaagtttggagcacgtggtaaaaatgtctctctctcaccaagtgttgctggtgcaatttttgttgtcaggccaagctttggatccaaacgtattttctcccaattcccgtagccataccaatgaattccaaccatcaatctagcatcatcagtttcagtccatccacagcttgctgaccactgaggctttttataaggtagttggatgcggtattgcttgattggatctttgtatcgtgcaatgcgctttgacaacaactgaagctcttcaacacgagctagcaattcataggccttcacagctacaccgaaaaaatccaaaactgtgcccttgatatctgtattctctttaacagctttctgacaaccatcaatcaacaaatcaaatagctctatttgtgcttcatgtggtgccttctctagtacaccaccaacatcatccacaattaagtcaatctgggttgcattcccaaaattttttaaccgctcgtacaaaacgagaagcatccttctttggaatattaccaaaagaccactctcgtacttgagctactgctccatcaaccaatggtactgaattaactgtttccactgttctgccagaacgcctccttggcttttcttgtgcttcaactgcacgtcttttcctgttattatttttgtcaaactggggatcttcaacataactctttttattacgtgcagcacgaggcgccaaagtttcctgaataatatctgcaggatctggctgtattagcctactccagaatgttgcatcatcctcgccactggaaaagtttgcgaccttgaaagcactaagaagctcatttccttcctc

SEQ ID NO: 23694 - DNA, 2519 bp, Zea mays
tacatttaagtgtttggccatcaccattcatacacaggattaaaaattcaattgggccatcatcatacaaccctagaagcatacttactgagcataagtggggcaaccaggggaaagtaggcctcatgcaacttcggactaccagatgacttgtagaatggctgagcacctactaagctgcaccatagaatatatatagatcatgacatgtcaaagtgtaaatgataacaccgtggtgtcaaactattgtttgaaatgtatataaccacccacctaattatcaccatttcttataaccgtacctcattcagtacattgtctcagggaaaacactatggaatcgataagtatccgataattccatcgcatttcactattatgctcccggctgcaactttttgttgcctcaaaatgagaacatgcatttctttcatctattacatcaacacggtagaaaaacggcacaaaacacatcgagagggagggagcataacggaaccatatttcaatatattacaatgtaaagcataatttatgtattgagatttaactatagatcattgttgagagatcacaaaactgaacaggcagaacttcctcgattgatcctcttggcagttcacaagccaccatgtatttgtgttgctgtgatggtgtcagaaggatattcagtgtagctgttaacaattccataagtcgcctctagagtcctggcattaccttttaaggcatataattcaaaactgtgatccaggtgaggttgctctttattcctttttgttttggaaaaagaatttcaattcctacggagatccaccatttataactatatggaagctgaaattcactgggaacggttatgccaaaatggacaaggttgttcgcatcatctacttccttcagctacagcaaaggtccatgcccagtagggaaatgactaggatgaacagcacgttttggcctctcattaccataccgtctaatttcaactggaccccaaccaagaatacctgcagaactactagattcctgcaacctatttccatttgtcataattggaggttgacacaaaggctgggtgtcaaatcccggccatctgccgccagctccccgtcgacgcttccaggcttcagaacttccagagctctcattatggaaagactcagaattgtactggagagacctagttggcctttggtttctcgaaggatgaagttgatttgagttacctcccttattgggaggaatggatgtgaaattgccaccatgagatgggccaactccaccttccagttggtcttgactaagtttcaaatagagatcatgcagttgctccccagacatgtttgaaaaggtggcaacataattccataacctcatgaccatgcgggattgcctataagattcactgtgttgccggacaacttctccaattttgtccccaattatcaggagatacttgcgaatccttgaaagaaccttttcctttgggaggtttacacttgtattctgcagcctatccaggcgcttcaaagtttcctgctcctcatctaaaacttcagagcaccattcaagccacttctcctctttgtcctgacgatacctggtctctgcctccgattcagaaatttcaccttcttctcttgcttcagcttccactattaccctacgcttctgaatgtcatctttgttcggcttattatcatctttttctggtacatccttttgccggcccctcattgatcgaactccactattactgtcgttattgactgtctggcgggtgtttcctttgacttttaagctcttaccgctaaacttagcatactccttttgcaggagagcactagcgcggttatccaagttgggagcacgtggtaaaaatgtctccctttctccaagtgttgctggtgcaatttttgttgtcaggccaagctttggatccaaccttattttctcccaattcccgtagccataccaatgaattccaaccatcaatctagcgtcatcagtttcagtccatccacagcttgctgaccactgaggctttttataaggtagctggatgcggtactgcttgattggatctttgtaacgtgcaattcgctttgccaagaactgaagctcttcaacacgagctagcaattcataggcctttacagctacgccgaaaaaatccaaaactgtgcccttaatgtctgtattctccttaactgcttcctgacaaccatcaaccagcaaatcaaatagttctatctgcgcttcatgcggtaccttcgcaagtacaccaccaacatcatccacaattaatccaatctgggttgcattcccaaattttttgaccgctcgtacaaaacgagaagcgtccttctttggaacattaccaaaagaccactctcgtacttgagctactgctccatcaaccaatggtaatgaattaactgtttccacagttctgccagaaagcctccttggcttttcttgtgtttcaactgcccgtcttttcctgttattatttc

SEQ ID NO: 23695 - DNA, 1540 bp, Zea mays
  misc_feature (7)..(7): n is a, c, g, or t
  misc_feature (1352)..(1352): n is a, c, g, or t
  misc_feature (1385)..(1385): n is a, c, g, or t
  misc_feature (1396)..(1396): n is a, c, g, or t
ggtctgntctccgtcgacgcttccaggcttcagaacttccagagctctcattattgtgcaaagactcagaattgtactggagagacctggttggcctatggtttcttgtaggatgaagttgatttgagttacctcccttgctggaaggaatggatgtgaaactgccaccatgagatgggccaactccaccttccagttggtcttgactaagtttcaaatagagatcatgcaattgctccccagacatgtttgaaaaggtggcaacataattccataacctcatggtcatgcgggattgcctataagattcactgtgttgccggacaacttcaccaattttgtccccaattatcaggagatacttgcggattcttgaaagaaccttttcctttgggaggtttacacttgtattctgcagcctgtccaggcgcttcaaagtttcctgttcctcatttaaaacttcagagcaccattcgagccacttctcctctttgtccagacgatactttgtctctgcctctgattcagaaatttcaccttcttctcttgcttcagcttccatcattaccttgcgcttctgaatgtcatctttgttcggcttggggggggggcctacgtagctgacctgttgtcggcctctcattgatcgagctccactattactgtcgttattgactgtctggcgggcatttcctttgactttggagctattaccgctaaacttagcatattccttttgcaggagagcgctagcacggttatccaagtttggagcacgtggtaaaaatgtctctctctcaccaagtgttgctggtgcaatttttgttgtcaggccaagctttggatccaaacgtattttctcccaattcccgtagccataccaatgaattccaaccatcaatctagcgtcatcagtttcagtccatccacagcttgctgaccactgaggctttttataaggtagctggatgcggtactgcttgattggatctttgtaacgtgcaattcgctttgccaagaactgaagctcttcaacacgagctagcaattcataggcctttacagctacgccgaaaaaatccaaaactgtgcccttaatgtctgtattctccttatctgcttcctgacaaccatcaaccagcaaatcaaatagttctatctgcgcttcatgcggtaccttcgcaagtacaccaccaacatcatccacaattaatccaatctgggttgcattcccaaattttttgaccgctcgtacaaaacgagaagcgtccttctttggaacattaccaaaagaccactctcgtacttgagctactgctccatcaaccaatggtaatgaattaactgtttcncacagttctgccagaaagcctccttggcttttncttgtgtttcnaactgcccgtcttttcctgttattatttttgtcaagctgaggatcttcaatatagctccttttatttcgtgcagcacgagcggccgctgggtcctgaactatatctgcaggatctggctgtattaacctactccagaaaaatgc

SEQ ID NO: 23696 - DNA, 1929 bp, Zea mays
gaggtcaaactaacttcagagaccggctgctggttctccaccaaaccaaccaaccatgcgtccgtcgtcgcgctacccgccgcaacccgcgctactcgctctcgccctcgccctcgcggcggcggccccggagctgagacccgtcgccgccgccgtcgccgtcaccgtcacgccgccgccggagcggacggacgaggaggtgcggcggctgtacgaggagtggaggtcggagcacgacgcggggccgaggcgtggcgccaccggcggcagcctcggcccgggcgacgccgacgccggcgccggcgccggcgaggacgacgacgcgcggcggctggaggtgttccgcgacaacctccgctacatcgacgcgcacaacgcggaggcggacgcggggctccacggcttccgcctcggcctcacccgcttcgccgacctcacgctggaggagtaccgcgcccgcctcctccttggctcccgcggccgcaacggcaccgcggtgggcgtcgtcgggagacgccgctacctgcccctagccggggagcagctccccgacgccgtggactggcgcgagcgcggcgccgtcgccgaggtcaaggaccagggccaatgcggtgggtgctgggcgttctcggcggtggcagcggtggaagggatcaacaagatcgtgacaggcagcctcatctcgctgtcggagcaggagcttatcgactgcgataagttccaggaccagggctgcgatggcggcttaatggacaatgctttcgtgttcatgatcaagaacggcgggatcgacaccgaggccgactacccgttcactggccacgacgggacgtgcgatctcaaactgaaaaatacaagggttgtatccattgattcgttcgagcgtgtgcccatcaactacgagagagcgttgcagaaggccgtggcgcaccagcctgttagtgccagcattgaagcatctcggcgcgcgttccagctctacagttctggcatcttcgacgggagatgcgggacgtacctggaccacggtgtgacggtggtggggtacggcagcgagggcggcaaggactactggatcgtgaagaactcgtggggcacccagtggggcgaggccgggtacgtccggatggcgcgcaacgtcagggtgaggccgccaagtgcgggcatcgccatggagccgctgtacccggtgaaggagggcccgaacccgccgccgggcccgacgccgccgtcgcccgtgaagccgcccaacgtgtgcaacgcggagtactcgtgcccggaggccaccacctgctgctgcgtctccgagtaccgcggcaaatgcctcgcctacggctgctgcgagctggagaacgccacctgctgcgaggaccactcgtcctgctgcccgcacgactaccccgtgtgcagcgtccgggacgggacctgtcgtaagagcgccaacagcccgatgatggtgaaggctctgcagcgcaagccggcgatgtatactggcggcggcggcggcggcgagcaaagcgggaggagcagctggtgaggagattgagactggtggtgcgtggcgtgtactgttcatcgttcagacagatgacttgctggccgtgctgtgggctcaggaactgcttcttcacagtggcgatgttctgatctgtaatgcgcgaagcacgatactatttgttgtatatgtatgtgtaactacagataagattagggaacggtgtgaaagaataaagaaaccgatggaataagtaatttgggaacaatctcagaatcagtttacgcagcccttataggataacttcgggaacagtcttgcacaaacaacaaggtaataatgcaataatgcattcacttatcgtgttatgtaaaacggtgttcccccgaacaaagctcagatttgcagtgaatatattcctgaattcaagttcg

SEQ ID NO: 23697 - DNA, 2671 bp, Zea mays
ggctgcgatggcggcttaatggacaatgctttcgtgttcatgatcaagaacggcgggatcgacaccgaggccgactacccgttcactggccacgacgggacgtgcgatctcaaactggtcagtgtcgatctgtcataggtttgcgtacttaactgtgctctgcccgtttctgtgatggtgtgacggaggtttgcgctttgtctatttcagaaaaatacaagggttgtatccatagattcgttcgagcgtgtgcccatcaactacgagagagcgctgcagaaggccgtggcgcaccagcctgttagtgccagcattgaagcatctcggcgcgcgttccagctctacagttctgtaagttgctgtttaatcgatccaagtatgaccggtgtatatgctcaacaacatctatatgctcgattgaaacttgctgggtttttgaaattgggagcatgtggatagatgaaggactggaatcactatgatttgcctatttggtggtaaccaatgctacatttctttgtaacactgtttttgatatccgtgctgctctgtctgtctttgaccgagatatgtcgccaataatggagaatgcagaaaatcttcttttgccgcggaagttcagcccaaagggctatatttccttctaatagtgcttttcattgagctcatttacccaatttttactctagaacagtcttgagttcaaatacttgtccattattgatacactagttttcatggctgtggctgccggttgctctagtcaaacctaccttgtcatttgtgttagttgaactcgagcatcaggccatcggcatcctgatcttgccccctttgaatattacatcacaaaacgtgttgcctctgcaatgctcctttcaatgtctatccaacccttcaatatttaatttggatgattgagtgggaccatcatggccatgaccacctttttttttcaaatgcgtaaacattactaaacagtaccgagttccgtgtctcgatggaactaaatgatatcgggatctccatgttctttatagcccacacatacgtgtaccttgtggataattttactttataatgtctagttgcattcttgcagagctggtggttgaacacttgtaaaacaacatttttctgtgttttattaagagggagcagggcattgtttacatcatcggtagcctgccgtgctgcggccaccgatccgtgaacatttagtgtagtgtttgacttgtgacaacacgtataactggtcatctgttgcttgtctgagaaattgatactagcagaagtgttctttgttcagaatcttcagatccagtgagagagcagctgtttgttccgagctgttaaaacgaaccattgcacaaggattttttttctctggtttgtgatttccgatcacacgcagggcatcttcgacggcagatgcgggacgtacctggaccacggtgtgacggtggtggggtacggcagcgagggcggcaaggactactggatcgtgaagaactcgtggggcacccagtggggcgaggccgggtacgtccggatggcgcgcaacgtcagggtgagggccggcaagtgcggcatcgccatggagccgctgtacccggtgaaggagggcccgaacccgccgccgggcccgacgccgccgtcgcccgtgaagccgcccaacgtgtgcaacgcggagtactcgtgcccggaggccaccacctgctgctgcgtctccgagtaccgcggcaaatgcctcgcctacggctgctgcgagctggagaacgccacctgctgcgaggaccactcgtcctgctgcccgcacgactaccccgtctgcagcgtccgggacgggacctgccgtaaggtaaaatctgatgcctcggaccgactgccgggcctctttgtttcagcgtttttgctgattctgagtatcagaaactgccgcggacggctaaacatccagctttttagcttgtttctatgacaatcgtaaaatcatttaaagtcaacttaaaaacacaatcgatcaagtcgtcatgataaaagaaatttgtcacttcttagattccaaagccgatgaatcttttatctttctttgtatgtaatccctatgatacttatatttttctcaaagccagattctctctacagccatagtatttgactctccacagccaagccatagtatttgactctccacagccagagtattagaaaggatcgttagagaaaagctaaaccaaacagacccatcgtttcttgcccagattctgcgcccacggaactgtgtgtttcatgtatagataggtattcttagggcatgtataaactagatactacgttgtggttctttaagcactagatacacctaaggaacctcttcatacaacctaatcaaggtttaaaatagcgggttatgcaaaatagcggcgtcatttttttaggctacatggctattgcccggctatagcgcagctatagcaaatagcggatttataaaaaatattaaaaatatgcatgatttatacaaaaaatatatgtaagtcaagatatttaactaagaccaatatgtttccaaggctctaggagactagagccagtacacaatacatgattcctggaattcaagtgtttggcacttcaataacatagttagccactaactaggttgctg

SEQ ID NO: 23698 - DNA, 2215 bp, Zea mays
gcacgagaccattacctagaacatcctaatcgaaaaaacttcagagttcagagaccggcggctggttctccaccaaaccaaccaaccatgcgtccgtcgtcgcgttacccgccgcaacccgcgctactcgctctcgctctcgccctcgccctcgcggcggcggccccggagctgagacccctcgccgccgccgtcgccgtcaccgtcacgccgccgtcggagcggacggacgaggaggtgcggcggctgtacgaggagtggagatcggagaacgacgcggggccgaggcgtggcgccaccggcggcagcctcggcctgggcgacgccgacgccggcgaggacgacgacgcgcggcggctggaggtgttccgcgacaacctccgctacatcgacgcgcacaacgcggaggcggacgcggggctccacggcttccgcctcggcctcacccgcttcgccgacctcacgctggaggagtaccgcgcccgcctcctccttggctcccgcggccgcaacggcaccgcggtgggcgtcgtcgggagccgccgctacctgcccctagccggggagcagctccccgacgccgtggactggcgcgagcgcggcgccgtcgccgaggtcaaggaccagggccaatgcggtgggtgctgggcgttctcggcggtggcagcggtggaagggatcaacaagatcgtgacaggcagcctcatctcgctgtcggagcaggagcttatcgactgcgataagttccaggaccagggctgcgatggcggcttaatggacaatgctttcgtgttcatgatcaagaacggcgggatcgacaccgaggccgactacccgttcactggccacgacgggacgtgcgatctcaaactgaaaaatacaagggttgtatccatagattcgttcgagcgtgtgcccatcaactacgagagagcgttgcagaaggccgtggcgcaccagcctgttagtgccagcattgaagcatctcggcgcgcgttccagctctacagttctggcatcttcgacgggagatgcgggacgtacctggaccacggtgtgacggtggtggggtacggcagcgagggcggcaaggactactggatcgtgaagaactcgtggggcacccagtggggcgaggccgggtacgtccggatggcgcgcaacgtcagggtgagggccggcaagtgcggcatcgccatggagccgctgtacccggtgaaggagggcccgaacccgccgccgggcccgacgccgccgtcgcccgtgaagccgcccaacgtgtgcaacgcggagtactcgtgcccggaggccaccacctgctgctgcgtctccgagtaccgcggcaaatgcctcgcctacggctgctgcgagctggagaacgccacctgctgcgaggaccactcgtcctgctgcccgcacgactaccccgtctgcagcgtccgggacgggacctgccgtaagagcgccaacagcccgatgatggtgaaggctctgcagcgcaagccggcgatgtatactggcggcggcggcggcggcgagcaaagcgggaggagcagctggtgaggagattgagactgtggtggtgcgtggcgtgtactgttcatcgttcagacagatgacttgctggccatgctgtgggctcaggaactgcttcttcacagtggcgatgttctgatctgtaatgcacgaagcacgatactatttgttgtatatgtatgtatgtgtaactacagataagattaggaacggtgtgaaagaataaagaaaccgatggaataagtgatttgggaacaatctcagaatcaatttatgcagccctttaggataacttcgggaacagtcttgcacaaacaacaaggtaataatgcattcactcgtcgtgttatgtaaaacatgttctccagaacaaagctcagatttgcagtgaatatattcctgaattcaagttcgaaactaaagcttgctgctgaagacatggtcaaatttcgccagatgcatgtgcggtatcgtcttcgggaaattgaaaggtgaccattttcaaattgtgggtgtttaattagcaaatgccgtgttctgctttttgcaccttaaaaccaatgtataaagctattttcagctgatcttattattttaaaatttactttataaacagcacaatgtataatacaaaacaacgaaagaaactttagttgagttagttagatggtctgagtaa

SEQ ID NO: 23699 - DNA, 2421 bp, Zea mays
gttcaaaaagtgtagactgatttgaggagatccatggaagagaaaagtgtttgctattcaatgaatatcaagggatttctttctcattgatcccttccaatttctttgtcaccaagccaaccttaaatgcttgtatttccgttatcttggtaacacaaatgaagtgatatcgtgtcaaaaaaaaaccgtaaacagctaagggtattccagcattgcataaggattgacaggcatatatatacgaaacaagccctaaatatattgaattaacttgcgaacagctgaaagaatgaacttttttttttttttttcgttttttttttttttttgctgttgattgtaagctgttattcagatgtctcctttctataaaaaagaattgctttccaatggtatgttaaaggtggttcgctacaaaatgatcaacttgatgtaatccacaaaaaggtaaatagctgacagtgcattctatctccaacatattcacagtagctactgcctaccatcaaccttaatcacagaatgactatttccgcaacttgagcagcgacatgcaacttgtcgtagtcattgctacaatatcttggggtgaccgaggacactgaaggtttcctgctacttgatgtagtgctacatttctgattcgaaaccaatgttccaaaacccttccggcgtcagaggcggcgcgtacctgtaccgatgccttgacacaccatcgtggtgctcacatcgtaagcttgtagagcctgcaccatcgccatctgcacgaccaccaggaagaacagcatcataaaacttcttgcattgcttgcactcaacacctttcaggttctcccggtcagctttctttctcactgattctctatatttgatgtctttctttggtggatgtaccgatattgtgttttgctgcttgggaactggcatattggggatgtgccggagggcttgagttgcaatattcagatcttgggtttcatcatctgaattgtcgaaatccataacttgaggagaggcggcaagtgcctgtgcttcttcgggagttgcagggttcctgatggtattcttgacagcttccagaggtgtatcaaggaaatcatcgtgtggatcagcaacaccttgttctttgcgtgcacgggtctccctccaatttagacatgggctggcgacactggttgaagcttgtagttttgaattgttggcagaatgatttgccaatggattcattgggcgagatggcacagcaaggtgtgagtttctgattggactcctgactgaactagcgtgttgggcagcttgggctttggcacctggagcagagtcattcttcaggtcccttgtgttgggaaggatttggatgcgctccttgtttgtgtgctccaaatctttgaacttcctcttacttggaggactttcagtgtttcttctatctgcaggaatgtcctcaggaggcttggagccttcatgctggtcaatcttcccaagaagaaaggtgtactgagacttcaaatgcttgtagtttgtcttcagctgagtgtaatcctcaatcaagtccctccgcttgctctgctccagaagcagattcttatccttcaggtcaacctgctgctgcagccgctggtgtgcctctctctccctgaccacctcagcggccttctcctcaatctccctctggagctgacgtaccacctcaccattccccatctcatcctccaacctccccagaagctgtttcttctcagattcatgcctcgcagccaattgctcaaattcctgcagcagccgctgatgtgcctctctctccctgaccacctcagcgtccttctcctcaatctccctttggagctgacataccacctcacctttcctcgtttcatcctccaacctccccagaagctgtttcttctctgcctcatgcctcgcagccaattgctccgaatccacaagcttcctcttcatctcctcaagagaggtgcccagttgcagcaatctctcctccgcgagcatcttaccacggctgacctcctccagctgcttcaccaggccagcctccgtcttcctccactcaacctcactggccttcatcgtgtcggcgagatgcgcctggacaagcttcgacttggcctggatgtgcgggaagagctggctgcagaagatgaactccatctgggagacctggtccttcacttcctggatggtggccacgagaatggtgctcagcccggagatgtacttgagatcatccgccggatcgacgccggcgccaccacaaccgacggctaccgccttcccctccatctcgggaacccgattttgtagcgagatgatcctaacagtagccttcctcgctgccggcggccacccgcgctcgcctcagtgccttgctccaaattttgaaaaagcttttcaaaagtttccctt

SEQ ID NO: 23700 - DNA, 2784 bp, Zea mays
cacttctgtatatgacaccatctcaaataaagatattattagagtcatctagactataagaattgtcttagatgttagtgagtatattagacacttctaaatataaaatcatctttgtatgatatttctgataagacatattatggaaaaacgtagtaaatagtgaattcagcttagtttgatgatatgtatgatataaaatgcaaaacttatctctgcaactggatatagatggtaaaatagactcatatgcgacccaatcattaatatgccatacaaaaaacctcagtcatcattttgctttatttcatatcatttacataccaaggggtttatgaaggtataaacatcatatgatgaatatatcagtacttttatatttacattgttaaattccaaaaacccagtcaattcagatattcggactcaaaaaaggaaacccaacatccaaatgattccttctaatagtataccagttttcaagggatctaaaagcctacgacttcgagtaagagaatttcgggtcctgagaatttggctccagcacaccttcaacttcgaaaaagagttgctccatatatgcaatgccaagcgagccaaggaacttagacatcactcattttggagaattacagtttaatttgttaagatttgagtagtttaggatcatgaattatagtttcaaatattttcttttattataaatcatttaaaacgaattataaggttaaactgaggatgttgcattcatagtgttttaaaagtacaaaatatgtttaaactatgttaatatatccatagaagtcccttgtatttttttcgtatttttctgatttttaatttttaaaaataaaatatgttaatttgaagcacttaaatatctttttctctaaatcttaaccgtggctggccaggtgcctgcctccatctccctcctccactcgggtcttcacgatgccgccgccgccacacgacatcgcacatccgctcttctccctcccctcgctctcggcggtcgacgtgcgctcccctggtgccatcgcttgtgcccggctcccgccatcgctggctccccgatggacctcgcggctagtgtggggccatggatccccgacggatcgagggtcgcgccgcctcatgaggtcagtgagcccgcccacactctacttgcttgctccttgttctacgagcttcggctgcgctgaggcggtcatggtcgctgttcatgtggaattagatgtgagagaaggagcgtgcagcgccgcctcagctgtggactcccatcataaaattcgaacatggagaaacttgaaccttttctaatgcaacattcatgtgttggtattctattttggtatattatagattttgcaggacaagatggagttggaaattgaggcatatattaggcgacattatgaaggggaaatttctgacatagaaataattgagaaagaggatttagatctagtttttcacttgctctgcatactgaatctaatattctgtttgacgtccataatgaaatgatgtcatggcgataagtttggctctgtttaattgtttatgtctaagatttttctacaggaattttgatcttcttaggtttgtgtcgttctacttgtttatccattgatggccatccttgtgttatagccatagtgatgttcatatatctctagaatttagctgaagttgaatgctttatatgttcagactgaaattttgatattaaacatgtagattatcgttctttaaatatgagtaagggagatgccaatgtgctaattgtttgtttcttttttctgccattttgatgtgcctgggccaggtgtagaatataacttttaacatcccactcttgttgcagaaaattcatctttctggctcgaacagaaaatacctgaagcttcaatttgacatcgtgtagcaatgaatgcgtgcaaggaatgctcttttacatgttgagaatgaagaaaaattagatgtcgtggaggcatcccaaaacatgtactttccattttgcacattttagtccaaggttcaatacaaactttcttagataactatctcaaacactactaatcgttgttggtctgcagggtttcaaattaggacttagccatttttccatcagcctgaaacagcctaataatcttactttgatcccttgggaaaaatgttcttattattttgagtttttgacctatagtcaggtccagaacatacccctgacatcacactactaatctgggacaaaaatatgtagttctccaaaagaaaattgtttctaatcctgccctgaaaatgtgtgctgaaatactatttggtaaggttgctgcatagctaaaaggttctccaaatgaaaattattcctaatcctgccctgaacaacaagaaggaattctatggtttccaaaaatgagaatatgttttttattcgtacatgaagcttcttatatgaccccttccctcgtatagggagtttttctttttgtattcatacgtgaactagtatttgtttttgtagcagcaccataaggaggatattatttactaatgtagaaatgtttatgttttagcagttgccttgtaatatttgtcttaaattttcgtactttccagctttagtggttcgccaactaaatctagcatggttccctgcttcatataactaaatctagcattattgtcttcttctatttgttgtacaagaaaagatagaatggaactcaaattttggtggcctaacaagtgtggagacttgaattcatatatatttag

SEQ ID NO: 23701 - DNA, 626 bp, Zea mays
aatactcgtggatccacagcacaatcgcatccatccaccacgcaccccaccaacccatacccataccagaggctctctgattttacttctcagcggtagatcggctgagcgagcgagcgagcgaggcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattccttccttcgttgtttagttgctgctgctcctcctgctggtgtagtggtgtatccagtccttttaattctcttgattagtttgctcggctgaagaaatcaggacgcgtgcctggtgtcgctgctcagctgcatgtacttgtacaaccgttcctccctgcagctgctgccccttctctctttttgtttaccttggattgatggattgttaaattcgttgtttgtcattgtt

SEQ ID NO: 23702 - DNA, 684 bp, Zea mays
gccggccgggtcgaagagctgatcgcatccatccaccacgcaccccaccaacccatacccataccagaggctctctgattttacttctcagcggtagatcggctgagcgagcgagcgagcgaggcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattccttccttctttgtttagttgctgctgctcctgctggtgtatccagtccttttaatatcttgattagtttgctcggctgaagaaatcaggacgcgtgtctggtgttgctgctcagctgcatgtacttgtacaaccattccgccctgcagctgctgccccttctctcttttttgtttaccttggattgatggattgttaaattcgttgtttgtctcttttttaaccttcgcgattgtagtattgggttggtttgggagatcgatgggaataagtctatgatatctatcagt

SEQ ID NO: 23703 - DNA, 3726 bp, Zea mays
  misc_feature (3712)..(3712): n is a, c, g, or t
tcgacctgcagcacagtgatcaatggcgtttgatagcagcctattgggggatcccagacctggtcagtccattttatttcatcaccattcatgggtgttacggcctgtttggatcaaccagagccagttattagctgggctagaagttagcctaaattagctggagttggccacctaaaagattgttcggtgggtggattgaaagaaatcggagggaattagatccagttctattcaaatttattaagaagatttaatccctttcaatccacctcaaaacgaataaaccctaggctatatatttaaacaaacccttacgtacgggcgtgtaggtgtagctgatggtgatggtatagccaaatggatcgtattaaatggaccgacactaagcacgacatggcccgtagtacttcggcacggcacgaacatgattcatatagtgacagtgtcggcacaacacggatctaatgccgtgtttgggccgccaccccggcacgatgggctgacacgagcacaacatgattaagtgatcgatacggttaggcatgacttagactaaccggtagtatatagatgtgtttgtgatatttgcatgtgattgtaaattgttatttgttatgattttaaacctaatgaatttactttataatggtatagatatctaattgtgagtgctagtgacagtgcagtgacttgcctgactacccgtttgcaggtgatgggcggtgggtgccgacatgtccacaggacatcccgcccgttgaattgtctgcaaggagtatgcattatgacacagtagctagctagtgactttattatattatatgttgatgtgatgcctaactgtctcacatttatagctgaatggacgagcggatttggcatgacttatgtatttacgcggcagtggttagtagtgtatagctttacctctgttcccccatcctgttttggaaacttttatccgtgcctgttctgaaacgatcagccgggctttcctggtgagctagctgttgccgacttgttttcttgtggacgatttacagcgcaagtcagaatagtaactgataactcacgagattaactctaaatctctaaatatgtagcctatactaactaccacatattctattatttattttcacctctttcctctccacacccaatgggcagccaataggaagaggaaagagattattcagtccaccacagaaggtgcactagctgtgaagttcctgagagctgtaaaaatttacggcgcggctgcggatagcctaaaggcacgtactgatcgtatgcatgtaacagcttttgttgtcttgaggagttgaggtcgtcgacgctcgacagcattggaaaagctttggctgctaaagtagaaagtacactttgcactttccaggtgtgcattctagtagccctctcttgctctcttggccatcgaagcatcctccagagtgtgtagatccgatcagatccgcgagaacatgctgagagtctccgggcaaagggatgataagagctggaacatgaattggcagaagcagaagcgaaagcaggctgtttatttgtcatgaatggataccatgattcggcctctaggactaggagaggataagagggtcggggtggacacgtagaggaggatggtggtaggcaggagagctgtcagctgaagcagcaagcaagcccatgcatggggcggtggggtcatcgaccgacgcggcgcgggccggggccattctggagaccgtgaaatcgacatttaccgttgatggatagcgtccctacatgaccgaccgcactagaggcaaaaaaaaaaaaaagtggacccatctgccgaccacagaggcgaggagcgaaccaatgagctcctcgtcaccgcgtccagcaggcagcaggccgggtggggtgatggactgtgatgaatgcccgcgcatcccggccaagttccgcggggcgtcagatggggatgcatgcacacagctcagcgcacccgatgccctctgcccacgcatcttggcatgttggcaccccggacccccgcccgctccccgcctttataagcgccagcagccacggcaggtggagctcatcgcatccatccaccacgcaccccaccaacccatacccataccagaggctctctgattttacttctccgcggtagatcggctgagcgagcgagcgaggcacacggagctagctaaacagagcacacgggtagaaaagcaagatgtcggacggcacggcgacctgcatcgacatcatcctcgccatcatcctgccgccgctcggggtcttcttcaagttcggctgcggggtgcgtgattttttaatatctactactagttcggcggcagctttctgccttctttgctgcagtgcagtgccgatcgatagatgactgttattgcttgcttgcttgctgcaggttgagttctggatctgccttatcctcaccttcctcggctacctccccggcatcatctacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttgatgggttgttaaattcgttgtttgtctcttttttaaaaaaaaaaaaaatagtacaaaaaaggaaaaatgcttggttggtttcggttgggagatcgatgggaataagtctatgatatatatcagtacaacaaaagagagaaagaaattgccgccgtcataactagcttaccgtgcgtgaattcactactcgggcactgccagtggcttccgccatcttgggggaattactgcaccaccaactttggtgcgtgggttggacgagagcgtgacctgagcatggaacacgtccgttggttatctcgtcttcttgtgacaaccgcctggttcgtcgccgagggccgcggcccatcaaacagcctccgccgcggcggaactccaacggggccgggtcggattggggccggcagctgcccaagctggagtccgttctgtttggttgaagagccaagtagaacggaacagttctgtttcagttttgttattgtttggttacaaagtaaccagaacggaatgactccaattagggaatattctcctcagatccggaaccattccgttccaaaaaatcaatgggatggagtcgctccgttctaatcccgctctcacagtcacgctccgttccgttcactctgcaaccaaacaaaaaacagaaccgctccgttccagattaccaaacacagaacagagcggctccgttcctagaatcagggatggaacggctccgttctatttggctcctcaaccaaacactacctaacagcgtcgtccgacccggcaggcgctgacttcactagttgatttacactgctgacttcagtagagaatggcagagcgaaggagccagagaagccgcatcnaggtccagcaccac

SEQ ID NO: 23704 - DNA, 883 bp, Zea mays
tcggccgggggggtacctccgggcccggagctcatcgcatccatccaccacgcaccccaccaacccatacccataccagaggctctctgattttacttctccgcggtagatcggctgagcgagcgagcgaggcacacggagctagctaaacagagcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcctcggctacctccccggcatcatctacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttgatgggttgttaaattcgttgtttgtctcttttttaaccttcgcgattgtagtaaaaaaaaaaaagcttgcttggttggtttcggttgggagatcgatgggaataagtctatgatatatatcagtacaacaaaagagagaaagaaattgccgccgtcaaaaaaaaaaaaaaaaaaaaaaaaaaaaaaaaaaaaaaaaaaaa

SEQ ID NO: 23705 - DNA, 1163 bp, Zea mays
ctgaagcagcaagcaagcccacgcacgcatcgaccgacgcggcgcgggccggggccattctggagaccgtgaaagcgacatttaccgttgatggatagcatccctacatgaccgaccgcactagaggccaaaaaaaaaagaaaggtggacccatctgccgaccacagaggcgaggagcgaaccaatgagctcctcgtcaccgcgtccagcaggcagcaggccgggtggggtgatggactgtgatgaatgcccgcgcatcccggccaagttccgcggggcgtcagatggggatgcatgcacagctcagcgcacccgatgctctctgcccacgcatcttggcaccccggacccccgcccgctccccgcctttataagcggcagcagccacggcaggtggagctcatatcgcatccatccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgactactagttcggctgccgctttctgccttctttgctgcagtgcagtgccgatcgatagataactgttattgcttgcttgcttgctgcaggagcagtggtagatccgccttatcctcacctcggctacctccccggcatcatctacgccgtctgggccatcaccaagtagccggccggtgcgttagcatgcaatgcgcgcgcagggtgatctcgtggcgggggacgcggtgtgcgcgtgtcttgagatgtgattccttccttccttgtttagttgctgctgctcctgctggtgtagtactggtgtatccagtccttttaatttcttgattagtttgctcggctgaagaaatcaggacgcgtgcctggtgttgctgctcagctccatgtacttgtacaaccgttcctccctgcagctgctgccccttctctctttttgtttaccttggattgatggattgttaaattcgttgattgacacaaaaaaaaaaaaaaaaaaagttctctgcgttgttaccactgct

SEQ ID NO: 23706 - DNA, 712 bp, Zea mays
ttgcccgcctcgaggccggccgggacctgatcgcatccatccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctgggccatcaccaagtagccggccggtgcgttagcatgcaatgcgcgcgcagggtgatctcgtggcgggggacgcggtgtgcgcgtgtcttgagatgtgattccttccttccttgtttagttgctgctgctcctgctggtgtagtactggtgtatccagtccttttaatttcttgattagtttgctcggctgaagaaatcaggacgcgtgcctggtgttgctgctcagctccatgtacttgtacaaccgttcctccctgcagctgctgccccttctctctttttgtttaccttggattgatggattgttaaattcgttgtttgtctcatttttaaccaaaaaaaatctaacaaaaaaaaaaagaaaaagcggccgcccaagggc

SEQ ID NO: 23707 - DNA, 872 bp, Zea mays
atcatcctgccgccgctgggggtcttcttcaagttcggctgcggggttgagttctggatctgccttatcctcaccttcctcggctacctccccggcatcatttacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttgatgggttgttaaattcgttgtttgtctcttttttaaccttcgcgattgtagtactgggttggttgcttgcttggttggtttcggttgggagatcgatgggaataagtctatgatatatatcagtacaacaaaagagagaaagaaattgccgccgtcaaaaaaaaaaaaaaaaaaaaaaaaaaaaaaacgggcactgccagtggcttccgccatcttgggggaattactgcaccaccaactttggtgcgtgggttggacgagagcgtgacctgagcatggaacacgtccgttggttatctcgtcttcttgtgacaaccgcctggttcgtcgccgagggccgcggcccatcaaacagcctccgccgcggcggaactccaacggggccgggtcggattggggccggcag

SEQ ID NO: 23708 - DNA, 891 bp, Zea mays
tgggtacccctcgggccggccggggcgtcagatggggatgcatgcacagctcagcgcacccgatgctctctgcccacgcatcttggcatgttggcccgctccccgcctttgggtcggccgcccccgggccggccgggttgggatcgcatccatccaccacgcaccccaccaacccatacccataccagaggctctctgattttacttctcagcggtagatcggcacacggagctagctaaacagagcacacggatagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattcctttcttctttgtttagttgctgctgctcctgctggtgtagtggtgtatccagtccttttaattctcttgattagtttgctcggctgaagaaatcaggacgcgtgcctggtgtcgctgctcagctgcatgtacttgtacaaccgttcctccctgcagctgctgccccttctctctttttgtttaccttggattgatggattgttaaattcgttgtttgtcttaaaaaataacaaaaaagagccccctggggcccggttgcttgggttgggatgggggttgggaagaccaatgggaataagtctatgatatctatcagtacaaaaaaagagaaagaaattgacgccgttaaaaaaaaaaaaaaaaaggcccctag

SEQ ID NO: 23709 - DNA, 629 bp, Zea mays
aaacagagcacacgggtagaaaagcaagatgtcggacggcacggcgacctgcattgacatcatcctcgccatcatcctgccgccgattggggtatttttcaagttcggctgcggggttgagttctggatctgccttatcctcaccttcctcgggtacctccccggcatcatttacgccgtttgggccatcaccaagtagccggccggagcaaatgaaccacggtcccctgccagtgccaggcagctagctgtgactccgtcgcgtgcgttagcatgcaatgcaagcgcagggtggtttcgtggggggacgtggtgtgcgcgtgtcttgaaatgtgattccttccttctttgtttagttgctgctgctcctgctggtgtagtactggtgtatccagtccttttaatttcttgattagtttgctcggctgaaaaaatcaggacgcgtgcctggtgtcgctcctcagctccatgtacttgtacaaccgttcctccctgcagctgctgcccctttttttttttttgtttaccttgggttgatgggttgttaaattcgttgtttgtctctttttaaaaaaaaaaaaaaaaaaaaaaaaagaaaaaaaaaaaaaaaagaaaaaaaaaaaaaaaaa

SEQ ID NO: 23710 - DNA, 6131 bp, Zea mays
ggttctttttatctgaaagttcaacaacattctcgtataaatataattgtattctttgataaagatgttatagaaagcaactattgatcatattttaaactttgagaagcatcaaccatgaaaaagagaataaatttagactgttaattacaatttagaaagtgattcaagttccatagaaatatcacactatactttccacatgacaaaatagcttccatgataaaaaaaatggttctctacttgcacgaaaacaactttattcagtgaccaaggtaacaagagtgagccctgaccataacgaaacacatcatctgggaatggtcgaaaagtgttggtgatgccaaatataacaccaagcactactactgtcacactcctgcacagaacagtacaaaagcaaaatataaatcttttttggcaatttgtgatgtcatttagtggtggaagataatcagcttgccatcaagggaattgaaaggtcttgtgcacatatgcataaaaaacatgtatcatacagctgcccaaagaagagtatttctgccttctcatctatagttgcctccacagctttaaatcccagttcttgcaaagccaattgctcaaccaatcctgtcagaacaaagctgtctaaagaacactcagaatgatttattcaatacacctgtacagtaaaatcaaacttgcgagcctcactctatacaacataaaattcaaatacctgatgcgcaaaggttatggcttaccttactccacagcctaccatgctgagcacaacagtttgccattcccatggcacatcccatcggcgaacgatcgcccactcgtctgaactctgcttaggcacagataatgtcacaagatccacgccagtcaccacaaaaacatgatgaaagttggaataggcgaaatgcatctaaagtccacaaatgtccaggattccactacatacattgcttttacaatcttatatggattcctgaacgcttactctggtgcatccatatactgattggtttgttgcgcatgcgcacccaggttcgcgtcagccaggccgacaagacacgataattctgggcgtacgtgcagatgcaaggaaatggtctcaaaataacttactttacatctgcttatgcagaccacgtccctcgcatgcagtcaacgaaacaaacgctcagctacacagtggttcagaataggatggtgcgcagacagtatattttcctagcttgttccggaagctaaattctacacttaacatactgcttccctaattccctttgttattcacaaccggagcccatgtatttgttgtgtttaattcagggaggttataaagaaaatggaacgtttgagcatcaccttatctgaaggcgggggcgtcttgttcttggcattgtaggagaaacacgcgtagcctccgccccttctgcagctcctcctccactggccagtcaccggcctccgctgcaaccgctgctgagaccttgcttctacgcggacagctgggaatggcttcctttgtctcaagaggaggacgggtatgcacgggagcggccggaggaggataagtgatagcggcggcgacgacagtgaggaagacgccatcggaaacatgccttctgcactgccccctctgctctgctgtctcgcggcttagcggggataagatgaggagtctttagaaaatcatgcacactaccaggtgaaaacagaagttgtaaaggtactcgtgaaatatcctatagattgagggtccgcatagcaaaagagaagttaggccttcttgtccagcgcttgtgttggcggcggcgatggcgacgtcggcgagcacgtccggcgagtggctcaagggcgcgctgcaggaacttcgggagcgtaagggcagctcgctggagttcgactcggatctcatctcgggcctcgtctccttctgcgagctcgcgcctccctccgacgccaccagctatctcgaggttcgttctccagtgtccatccatttggacggtgtgtgtattgggcgattgctcccagattgctgtgctattgggatctgggtttgtacggctttcgttgtatggagcggatgattgaattatctaaaatgcctcagcttcatgttattgggagtcttaggaattttctataatgggtacaaaattcaagtgcttcaatgaattttcccgtcatgactgagatttatatcctgatgcagtattgtaagcgccattgggtgtcatgtagtgtctagggcataacgagatgctgatcattgttctgctgctgggtgtgaattttggtcaaaactatctggtttctttaaggcttgatgtgaaggtagattgttatttccactgccatttttgcattgccttctcatactgatgcaaaatcatgtgatgtttgtcacttgtctaatcgattccactgccatttttgcattgtcttctcattctgatgcaaaatcttgtgctgtttgtccgcttgtcttgattgatgtgtatgtactattctcttcaaaatcaaggaactcaatttctcagtgtaatatgttatatgtctctttatgttcatctcgaacttgaaaaggatgaactaaacacgctttgcccaaatacccatgaggccatgttagttgaactagtgtgcccttagcatttttccctttctttctcatttattattttctcaaaactacactctcagttggccagtttgcattacttcattagtaccgttgtagctcagtctctccttccattagttcttttgttttgttgtatgtgttttgtaccacttgttttcaagccacatcatcagtacatcatgacttttcaagcacaaatgttgagactgctgtagcttagttgacataaacatttctcatggtttgcacctttaatggtgcagaattttattgggaaagaagctgctcaggacatcattcaagaatacttgcggaggaggggtcacattggttcctcaaatggaactgagagctttcagtcatctaaccttcagccttatgttaagccttcagctgatgcagcaactacacaaacaaagaaacaaacacgcacgcaaaaagattcagcatcttcttctagtcagagttctaagagtcaatcagaaattgcagaatcacaagttccttccaagagaggttcaaaaaagaaaggagcaaaggtcatttccctcgctgaggcagcaaaaggttctattgtcttcaagcaggggaaaccttgttcatgccaagcacggcaacatgaccttgtcagcaactgcttatcatgtggcaaaattgtgtgtgaacaagagggcgagggaccctgtagtttctgtggcgcacttgtcttgaaggaaggtagcacttatgctggtcttagtgatgttgggctacccctttccgaagcagaaactgcagctgaagcatatgcaaagaggcttgttgactatgatagaaatgctgcagcaaggactaaagtttatgatgaccaaagtgactactatgaaatggaaggaaacagttggctctcttcaaaggtaccacatttgattatttgtacttgatagttatattgcatcccttgtggatcatacatgctcatattttaacgctgctcgacccattgatctttgttatgtctatgctaagccttcatctacaaatatcataccaagtctgttatgcgcaaagtacatcgaatcctaatatgagaattaattttattataagtatctgttattgcagagtattccttctagttttaatgatttccacagagctagctttattttcatagcgaactcatatttggtgtccttaacaattaacatcaatactatgtatttctaagaacatgtgacttcaaggacaagacaagaagctactgtgttgctgttttcagatatatacatgtccattcgagatacattcaagaatgctaactgtagatacctattttcacactccaggagaggtcagtcctgaagcagcagcaagaggaagctgaggaagcagctaaaatccaaaagggtaaagtgattgttacatttgatttggtgggccgtaaggtaattcctgctggacatcagtgcttttgcaacctcactttaaaatatctgcgcttagttgaacttttgtctagacgctctggcagagtatttggatgtagacgtaagttcgcaagtgttttattcaggtgattttgaacaaggatggaagtactgaggtggaaacagagcacccgatcatgcgaccgcccgaagagaaggaccagagccaccgcatacagcccaaccccacaatcagagagcaacctgtgttcgtcgaaacaagtccagtcaaaccaaaaactgaccgagcaaaacagagcaagaggcttgccaagaatggtctgtgcctggaggtaaccggacggctgcagcatgatgacaagggcatggagagcattctgagtggcaaggtgaagaagggtgatcacttggcttacagctcctttggtcaggcacgcgaaggggatgatgttgaatgctccccggattttgactgagcctttactttgaggtaaaaaacatgaaacagcctgtgaagttgctatgttccccatccaactacacatgaaagagcaccttttttccaacttaattccctgcaaaatgcaaactgtgagaatggcgcttcgtgtacatgctttacactataggctatggatcgaattttcataaggtcatgtttgtttattatataatccagtttaaataagttaagaggcaaacaaataacacatattattaggtaatattattatgtggattgtataatttagatatctagattatgataattcataagcaagttattaggtgcttatataatctataaggtcttgttctgttattcccattccatatggattgggtggaattaaaaaaaatcatgaactttgacttgtttgggatttaaatacgctcaatctcgctccatcggtccatccacatgaattgtgatcaaacataacaagccctaagttggactatataatactggaggtagtggaactttgtgattttatcccttgttttttaactttgtgattttaccactctgttttgaaaacgaagttgttgtttgccttctcccttaacaccgttagtgaaaattagaattagttgttaaaaagtaaaaaacaagggatacaattacattgcaagaaggatataatcacaattaatcttaaaaataatgttaaaacttttagggttaattgtgattatctctcctctcgccttgtaattgtgattttacttattatttttaattttttaatcactaattttgatgttcactaagggagagagaggcaaatggtggcttcgttttcaaagcagagaggtaaaatcacaaagagcggtaaaatcacaattgaaagatcagaacacaattgcccctaaacagacgttcttgtctcgtttaggatttgacccctacctgccaggtaactcccatgatgctccgacctttgtcagttgtcacttgtcaccaatagtcgacgtactgcaccttgccttcctcaccctcggtcactacacgcctaaaggccttccctctaatctcgttcgcaaccaattgtttgaccgtgattgtagtaggtcttaactagatttcacaccaaatcattagcacacatagattgatgtgtatacatggtcatatagacatccaaacaatccctaactgtttaactggtggggaaggcgacaaaagttgaagacaattcatggactagatgtggatgaggatcaaacggagggaacacatgtatgactacttccagtagactacctatcttattctctatctcgtttcctattttaaacttcactttatagacagtgtaagaaatgtaaaataatattttgcttgcacgattctttacacagcctgctggagatggtctaaggaagaaagttttgtacctctttcattctaaataggtcactttaattttttatacatagattccgttatgtatctagacatacattatttttagatacgtaacaaaatcaatgtaccaaatgtaatacccactttgtaagaaagtctaaaaggagaaattatatttctt

SEQ ID NO: 23711 - DNA, 3487 bp, Zea mays
ggccttagagcacctctaacagtatcttaaatcagtgtcttattttataatttttgatcaaaaatatacttcacagtatgaagtgattcaaatatatttaccctagactagtgccctatacttttttcaacatcattctcaaattttctttcctaataatgtaatttacttcctaaaatacatgatttaaactgttgtaacgcaatttgtttttagtgccctaaatactttaaacgatgtagtattttaatttttggggcacaatttagagtcatattgttggagatgctcttagttttaaacagtgacaaagcttcacattgatattagtaggacagtagtggtaacatagccagactagcaaatgttaagcagtgtatttaggacctactacgctacaatcctggagagtgaaggtgaggacccaccagcggcagcgctaggagggtaggggaggggcctgcggcggcgtgagtgaggcaaagggggacgggcggcgaggtcgcgggggagggggagacaagtggtgtgtgagggatgagtgagaaaagatgatccaaataatattggttattagatttgaatgattatgagataggaggattatgtagctatctgagttgttggtgttgtttttgaggtgtgttatgtgcggatgcaattcatttgttagattcagtgaaagttatgtgtgtaagggttatttggttaagtgagttttgcaaaatttaaactgatggattatatagtgctatagattatagatttattattaacttcatttcctttaaaattagagagagagagataagcatgttctctgcatgttttttttttttttttgcaaaatgcgtatggagttactataaggccttgttcgtttgtgtcggattggtgggtcggaacgattcctagccggattgcttctctaatttatataaactttgtttagccgaaacgattccgggtgtaatccgacgtaaacgaacaaggcctaaagtgtcaagtttcaaattttttcatctctcacagaatgctaacctgcaggctccatagagagcagccaagcgccgctggattggccagcgcgcctccacatcgccgccaaggtcgccgacggcatggcgttcatgcacaccaccctgcgcggcgacggcgggaccaccaattcctcgtcaggcggcccaatcgcccacggcaacctcaaggcctccaacgtcctcttcacggccggcatggacccgtgcatcagcgagtacggcgtcaccgcgccgggcagggacggcgccgcggcgttccgcgccgacgtgcgcgcgctcggcgtgctgctgctcgagctgctgacggggaaggcgacgtccgcgcagggcgacggcgcggagctggcgcggtgggtgacctcggtgatccgggaggagtggaccgccgaggtgttcgaccgcgcgctgctcgccggcaccggcgtcgggtcatccgagcaccgcatggtgcggctgctgcagctcctcctccactggccagtcaccggcctccgctgcaaccgctgctgagaccttgcttctacgcggacagctgggaatggcttcctttgtctcaagaggaggacgggtatgcacgggagcggccggaggaggataagtgatagcggcggcgacgacagtgaggaagacgccatcggaaacatgccttctgcactgccccctctgctctgctgtctcgcggcttagcggggataagatgaggagtctttagaaaatcatgcacactaccaggtgaaaacagaagttgtaaaggtactcgtgaaatatcctatagattgagggtccgcatagcaaaagagaagttaggccttcttgtccgcttgtgttggcggcggcgatggcgacgtcggcgagcacgtccggcgagtggctcaagggcgcgctgcaggaacttcgggagcgtaagggcagctcgctggagttcgactcggatctcatctcgggcctcgtctccttctgcgagctcgcgcctccctccgacgccaccagctatctcgagaattttattgggaaagaagctgctcaggacatcattcaagaatacttgcggaggaggggtcacattggttcctcaaatggaactgagagctttcagtcatctaaccttcagccttatgttaagccttcagctgatgcagcaactacacaaacaaagaaacaaacacgcacgcaaaaagattcagcatcttcttctagtcagagttctaagagtcaatcagaaattgcagaatcacaagttccttccaagagaggttcaaaaaagaaaggagcaaaggtcatttccctcgctgaggcagcaaaaggttctattgtcttcaagcaggggaaaccttgttcatgccaagcacggcaacatgaccttgtcagcaactgcttatcatgtggcaaaattgtgtgtgaacaagagggcgagggaccctgtagtttctgtggcgcacttgtcttgaaggaaggtagcacttatgctggtcttagtgatgttgggctacccctttccgaagcagaaactgcagctgaagcatatgcaaagaggcttgttgactatgatagaaatgctgcagcaaggactaaagtttatgatgaccaaagtgactactatgaaatggaaggaaacagttggctctcttcaaaggagaggtcagtcctgaagcagcagcaagaggaagctgaggaagcagctaaaatccaaaagggtaaagtgattgttacatttgatttggtgggccgtaaggtgattttgaacaaggatggaagtactgaggtggaaacagagcacccgatcatgcgaccgccggaagagaaggaccagagccaccgcatacagcccaaccccacaatcagagagcaacctgtgttcgtcgaaacaagtccagtcaaaccaaaaactgaccgagcgaaacagagcaagaggcttgccaagaatggtctgtgcctggaggtaaccggacggctgcagcatgatgacaagggcatggagagcattctgagtggcaaggtgaagaagggtgatcacttggcttacagctcctttggtcaggcacgcgaaggggatgatgttgaatgctccccggattttgactgagcctttactttgaggtaaaaaacatgaaacagcctgtgaagttgctatgttccccatccaactacacatgaaagagcaccttttttccaacttaattccctgcaaaatgcaaactgtgagaatggcgcttcgtgtacatgctttacactataggctatggatcgaattttcataaggtcatgtttgtttattatataatccagtttaaataagttaagaggcaaacaaataacacatattattaggtggattgtataatttagatatctagattatgataattcataagtaagttattaggtgcttatataatctataagaccttgccctgttattcccattccacacggattgggtggaattg

SEQ ID NO: 23712 - DNA, 1568 bp, Zea mays
cccccctcgagtttttttttttttttttttttttttggcgtggttccttggttccgtcacatgtgtacacataaaacatgatgtgagttgtcattacacctttctttaacaaacaatatcagcacaatttaatcgagtactccagttgtaagaaacactctcaaaagggcagctgttcttacgttaagttcaatctgccatcttatactgtataaacagctttacagactagtgatgcctcgtaacacttctggaaacgcaaccatcagctaacttgaagactcatatttcctttcacgtagttttgttggcatcaggtgtacaagagcacatacccaacggatctccttgataccatatatattatgcacaaattatatgtgcctggttcgttcaaaccttcacgatgctcccaagagctccttgagatcatatccttgcagctgaagaaaggttagcagaagtattactcctgagttccaaaatgcatgaattgtgatcggagttagaagattgcgggtctgagcatatgaaaatcccaatgcaacaccaagtataaacagctgcggaaattgtccaggagtcagatgagcaagggcaaatacagcagcactgacaagtacacaagctggagtaggaaaccacttagtcaaggacaccattagaaatcctcgaaacagtgtctcctcgagaagtggtgctagaactccagtgattcccaccaaaaaggcagtactggtagtggatgagccaatcagcggcaacaaaaggactagtgaatcagtctctctcgctggagtttcaccattcagataagtcatagcagctccggctaaggcaatagaaattactgctccaaagagaccaattccagcccacaaaagccatccattttgcagcttgaacggttctttaatatgataacgaaacacatcatctgggaatggtcgaaaagtgttggtgatgccaaatataacaccaagcactactactgtcacactcagctgcccaaagaagagtatttctgccttctcatctatagttgcctccacagctttaaatcccagttcttgcaaagccaattgctcaaccaatcctgtcagaacaaagcttactccacagcctaccatgctgagcacaacagtttgccattcccatggcacatcccatcggcgaacgatcgcccactcgtctgaactcttatctgaaggcgggggcgtcttgttcttggcattgtaggagaaacacgcgtagcctccgccccttctgcagctcctcctccactggccagtcaccggcctccgctgcaaccgctgctgagaccttgcttctacgcggacagctgggaatggcttcctttgtctcaagaggaggacgggtatgcacgggagcggccggaggaggataagtgatagcggcggcgacgacagtgaggaagacgccatcggaaacatgccttctgcactgccccctctgctctgctgtctcgcggcttagcggggataagatgaggagtctttagaaaatcatgcacactaccaggtcccggccggcctcgaggtacccaa

SEQ ID NO: 23713 - DNA, 2328 bp, Zea mays
cccatgtgttcggctaaacatagtttcgttcaagagggcttgctttgtttaaacaactaatacggttttagtgcacaatcgatgaatttgtgttggtcacaagtctcctgatttgtccatgttttgtcaagttctgtatatcgtcatagtttcattgattattaagatttcagattagtacacggagggagctgtggctcaccaacccgttcctttccccccttcaggaaaccatgctctgctcccaagtggaaggagatgacaggaagcggcatatttgctgctgggggcgaggctgaagaagatgaatctgccaatgcctctgcaactcccatccggaccgctccaaagaattatcaggtactgcttatgtaggttgatttgtactctgttttgtttaggcttcatccctggcaacccttctgcgttgaactgttgatattaggattattgttttattttcaggtgctggctaacttgttgtgacaagatggatcacttgatttatctatttatgttcttgctttgctataaattttgaatgtcgttgatataagctgctggttgctatgatcaaaacttttaaatgttatacatacgttctagtcctacctctccttagggggctagaggttgttgagatgaatcttgtgagaagggtttgggcaagcattattattttgtatacacattggttggtgagctttccttgtgatagaactgggcattttgattggtaagttgagctgaacgagaaatattcgagaactttgattgatagacacatgagacttaggtactattttttttttgtagataactttggttaagatgtcaataaacaacaaaccttgattaaactctaaacatatatagtacagcaagtttcataatttttctacagactgcttagcatgcttctaatccataatcatcttgatgctggcttcaaatggaaagggtgaatatgcttaggtttgatatagatttaacctcttacgtcgctggaacactgttacacagactaatcctactgcattttctcaaacacaggcaattagcaccataagccacatctcattttccgaggaagaaagcatttctccgaagaagccgacttcgatagcagaggtggcgaagcagcgcgagctgagcggcacacttctgagcgaggacgacagcaagatgaagaagcagatatcggacctgaaatccaaggagctgagcggccacgacatctttgctcctccggaagacccacggccacgcaactcagagaacggctcgacctcgcagaccccgggcaaaaatgcacacgtcctgacctctgaactcacctcgccctaatataaactctcgcagtcacagaagctgcatgcagtgttgcttactgctgctggttgtcgttctctcacaacaggtaagcaacttcaagttcggcgaggccgacgaggacggcatggtgaagaccgcgaagaagatccccacaaagaaattcaccgacctcgcgggcaatatcttcaagggcgacgagaccccccctgggacggcggagaagcacctgagcacagcgaagctgaaggagatgaccggcagcgacatcttcgcggacgggaaggccccctcgcgggactacctcggcgggatccgcaagccgcctggcggggagagcagcatcgcgctggtttaacagcaacagcaacctgatggacatagcagcccctacatcattcgtttctttctcctcgccgtcaccgtcttaggagtgatcttttgttcttcttcttttttcctttcctttggaggactgatcgattggaacccccggcttgctttcctgttccccgtgacttgcgccagattttcgttgtcgatcccctctgatggtggtgttgtgtgggcatgacaacaacgatggttatctctaatttaacattgatttggcttggctcctgtttgttggttggtcggtcatggcgtacctgatgcaacaacaacccagtggtgcactatctcatttcccgtgactggatgtctcagctgctgagggaggagaaggacgacgaccaccaccatctcctccctagtgctagtgctgccctttttttatagtctctgatttctttcagttgcacgaagcgtctctgttgaatggtcctttgattgctgccggtggtcagtggcacctaacccagttatggccatggcctctactatgcctctgcgaacttggcaagctttcctcggtcgttccctgggcaacttcaagaggctactaaaaaattattcctcgtattaagggttgtgtaaaaaaatctcctaaataaa

SEQ ID NO: 23714 - DNA, 870 bp, Zea mays
ttgggtacctcgaggccggccgggcacactccattcccatcctcgcctcgcctttttagagagagagaaaccacggctgcgcacagcgagttagagagagagagagagaccaaggccaaggagcaccgctccccgtacgtccccagcaggagagggagagagactgagaaggctgtgcgaagggaagaagacgcggcgggagagaagggcgacatggagaggccggcgcccgtgaggaagtcccacacgtcgacggcggacctgctggtctggccggaaggtgcgccgcaggagttgcccgccgggtccacgccgccatccaaccgccggccgcaccagccgtcggaggcgctcaggaaggtggtgttcggcggccaggtgacggaggcggaggccgagagcctcaacaagaggaaaccatgctctgctcccaagtggaaggagatgacaggaagcggtatatttgcagctgggggcgagggtgaagaagatgaatccgccaatgtctctgcaacttccgtccggacggctccaaagaattatcaggcaatcagtactataagccacatctcatttgccgaggaagaaagcatctctccaaagaagccaacttcgatagcagaggtcgcaaagcagcgcgagctaagcggcacgcttctgagcgaggacgacagcaagatgaagaggcagatatcggacctgaaatccaaggagctgagcggccacgacatctttgcccctccggaggatccgaggccacgcaactcggagaacggctcgacctcgcagactccggtcgccatgccctcgtaaccgcctgtctgttcggggccgtgcggcccgccccctgcgtgcggcttcggtcgtcgt

SEQ ID NO: 23715 - DNA, 1420 bp, Zea mays
accctcgggccggccgagcgaccccgcaccttccttccattcgactccacactccactcccagcctcgcctcccctcccctcgcctttttagagagagaaaccacggctgccggcccccagcgagctagagagagaaaccaaggccaaggagcacagcaccccgtccgtccccagcaggagagcgagagacagaagggtgtgcgaaggaaagaagaggcggtgggagaggagggcgacatggagaggccggcaccggtgaggaagtctcacacgtcgacggcggacctgctgatctggccggagggggcgccgcaggagtcgcccgccggggccacgccgccatccaaccgccggccgcatcagccgtcggaggcgctcaggaaggtggtgttcggcgggcaggtgacggaggaggaggccgagagcctcaacaagaggaaaccatgctctgctcccaagtggaaggagatgacaggaagcggcatatttgctgctgggggcgaggctgaagaagatgaatctgccaatgcctctgcaactcccatccggaccgctccaaagaattatcaggcaattagcactataagccacatctcattttccgaggaagaaagcatttctccgaagaagccgacttcgatagcagaggtggcgaagcagcgcgagctgagcggcacacttctgagcgaggacgacagcaagatgaagaagcagatatcggacctgaaatccaaggagctgagcggccacgacatctttgctcctccggaagacccacggccacgcaactcagagaacggctcgacctcgcagaccccgggcaaaaatgcacacgtaagcaacttcaagttcggcgaggccgacgaggacggcatggtgaagaccgcgaagaagatccccacaaagaaattcaccgacctcgcgggcaatatcttcaagggcgacgagaccccccctgggacggcggagaagcacctgagcacagcgaagctgagggagatgaccggcagcgacatcttcgcggacgggaaggccccctcgcgggactacctcggcgggatccgcaagccgcctggcggggagagcagcatcgcgctggtttaacagcaacagcaacctgatggacatagcagcccctacatcattcgtttctttctcctcgccgtcaccgtcttaggagtgatcttttgttcttcttctttttcctttcctttggaggactgatcgattggaacccccggcttgctttcctgttccccgtgacttgcgccagattttcgttgtcgatcccctctgatggtggtgttgtgtgggcatgacaacaacgatggttatctctaatttaacattgatttggcttggctaaaaaaaaaaaaaaaaaagcgcccggcgtacctgatgcaacaacaacccagtggt

SEQ ID NO: 23716 - DNA, 1420 bp, Zea mays
  misc_feature (9)..(10): n is a, c, g, or t
cggccgggnnactccattcccatcctcgcctcgcctttttagagagagagaaaccacggctgcgcacagcgagttagatagagagagagagagagagagagagagaccaagaccaagaccaagaccaaggccaaggagcaccgctccccgtacatccccagcaggagagggagagagacagagaaggttgtgcgaagggaagaagacgcggcgggagagaagggcgacatggagaggccggcgcccgtgaggaagtcccacacgtcgacggcggacctgctggtctggccggaaggtgcgccgcaggagttgcccgccgggtccacgccgccatccaaccgccggccgcaccagccgtcggaggcgctcaggaaggtggtgttcggcggccaggtgacggaggcggaggccgagagcctcaacaagaggaaaccatgctctgctcccaagtggaaggagatgacaggaagcggcatatttgcagctgggggcgagggtgaagaagatgaatccgccaatgtctctgcaacttccgtccggacggctccaaagaattatcaggcaatcagtactataagccacatctcatttgccgaggaagaaagcatctctccaaagaagccaacttcgatagcagaggtcgcaaagcagcgcgagctaagcggcacgcttctgagcgaggacgacagcaagatgaagaggcagatatcggacctgaaatccaaggagctgagcggccacgacatctttgcccctccggaggatccgaggccacgcaactcggagaacggctcgacctcgcagactccgggcaaaaatgcacacgtaagcaacttcaagttcggcgaggccgacgaggacagcgcggtgaagaccgcgaagaagatccccaccaagaagttcactgacctcgcgggcaatatcttcaagggcgacgacgaggcacccgggacggcggagaagcaccacctgagcacggcgaagctgaaggagatgaccggcagcgacatcttcgcggacggggaggccccctcccgggactacctgggcgggatccgcaagccgcccggcggggagagcagcatcgcgctggtttaacagcaggggacaaacaaccagatggacatagcagcccctcccctacatcattcgtttcttcctcatcgcccgtcgccgtcgccatcttaggagtgatcttttattagggagttcttttttttttcgttcattggaggactgatcgattggaacccccggcttgcattcctgtttcccgtgactttcgtcaggttttcgttgttaatcccctccgatggtggtgttgtgtgggtatgacaacaacgatggttatctctaatttaacattgatttggcttgggcttacctgatgcaaaaaaatccgccagtggtgcgttgtctg

SEQ ID NO: 23717 - DNA, 921 bp, Zea mays
tgggtacccctcgagccggccgggtctttgaactgatattgccggccgggcttcacctcgcgtgcgcgacaactagggcgaccgccgtcgctaaacgcccagctgcccaggtcttcgtcgggcccctcgccggcgacgagcacccaacacaccaggatggcgctgaggggggtctggcagctccagaagctcgtggtaaactactgcgactggggagggagcagcaggggcatcagagccttcatggaggcacatcttccagcgtttaaggaaaagattccacacttagaagtggtgacagagcttgtccgcggtcaacatcctaacttgaagggaatttacaagaaccataacgagcgagtggtctgcgtgagaaatttaccgccagaagaaatactcctgcaagccaccaggctaaggaactctctgggcaggaaagtggtgaagctgcggaccagacacgtaacgaagcggcccagtgtccaggggacgtggacgacggagctgaagatgtgaagccaagctagcagccaaggtgtttcgttgttcttggtggtgtgatcgtagagaaatgtcagctgtgtcaataacttcggtagagagctgccgttatgccagcctatttcgatagccaaactatttacaccttttgttccgactatcaatggtaatgacataggcacacctggagtttctggttagtggcaggccgtcacgttcgacatttcagcctccatgttcctgatatttacagacagttataatgcaaaaggcgacattattttcattcagctgttaagttgggaaaaaacaacctgcttcgtatattagtcccatgttttcatgaaagaaaaaaaaaaaaaaaaaaaaaaaaaaaaaaaaaaaaaaaaagaaagagagaaaaaaaaaggggcggccgct

SEQ ID NO: 23718 - DNA, 944 bp, Zea mays
  misc_feature (885)..(885): n is a, c, g, or t
  misc_feature (888)..(888): n is a, c, g, or t
cctcggggccccccgggcccgattgctccccttcgttcacctcgcgtacgcgacaaactaggccgaccgccgccgccctacgctcagctgcccacctgccctggtcttcgactcttcgtcgtgcgctttgccggcggcgagcacccatcacaccaggatggcgctaaggggggtctggcagctgcagaagctcgtggtaaactactgcgactggggagggagcagcaggggcatcagggccttcatggaggcacatcttccagcctttaaggaaaagaatccacacttagaggtggtgacagagcttgtccgcggtcaacatcctaacttaaagggaatttacaaaaaccataacgagcgagtggtatgtgtgagaaatttaccgccagaggaaatactcctgcaagccaccaggctaaggaactctctgggcaggaaagtggtgaagctgcggaccagacatgtaacgaaacgccccagtgttcaggggacgtggacgacggaactgaagatgtgaagcaacaagccaaggtgtttcattgttctttggtggtctgattgcagaaaatgtcagctgtgtcgataactttggtagagctgccgttaggcttgcctgtttgaatagctaaaccgtttactccatttgttccgagtacaatctggtaataacataggagtacacttgactttcttagaccaggccgtcacatttgatatttcagtctggtgatatctgtctcctatattagaccagtacaatgtttcaactcgcgagatactgcgaacacagaattttgctatgctatggccattaccaaggtttttttttaaaaaaaaaaaaaaaaaaaaaaatggaagacggaaactgtcatcagatgcagccanacnatatgctgacagccagccagtcaatcttgtgtacgaaccattacggtgcgaaggcg

SEQ ID NO: 23719 - DNA, 825 bp, Zea mays
attgctccccttcgttcacctcgcgtacgcgacaaactaggccgaccgccgccgccctacgctcagctgcccacctgccctggtcttcgactcttcgtcgtgcgctttgccggcggcgagcacccatcacaccaggtgctttattgggtccgtccatacggcaggatggcgctaaggggggtctggcagctgcagaagctcgtggtaaactactgcgactggggagggagcagcaggggcatcagggccttcatggaggcacatcttccagcctttaaggaaaagaatccacacttagaggtggtgacagagcttgtccgcggtcaacatcctaacttgaagggaatttacaaaaatcataacgagcgagtggtatgtgtgagaaatttaccgccagaggaaatactcctgcaagccaccaggctaaggaactctctgggcaggaaagtggtgaagctgcggaccagacatgtaacgaaacgccccagtgttcaggggacgtggacgacggaactgaagatgtgaagcaacaagccaaggtgtttcattgttctttggtggtctgattgcagaaaatgtcagctgtgtcgataactttggtagagctgccgttaggcttgcctgtttgaatagctaaaccgtttactccatttgttccggagtacaatctggtaataacataggagtacacttgactttctgagaccaggccgtcacatttgatatttcagtctggtgatatctgtctccgatattagaccagtacaatgtttcaactcgcgagatactgcgaacacagaattttgctatgctatggccattacc

SEQ ID NO: 23720 - DNA, 2229 bp, Zea mays
ctggaacacgctggaagctgtgtatcattgtcttaaaaagaaaaggagtagaaccttaccaacacacaccatgcgctactaaaccgggctcgagttttttttttttttttttttctgaacatgaaaagtacgtccagcgctgaacaagtaacgatgctacacctttttagcaaggaaagtcactggttaataatacactagacagcataatgcaaatgtcagttacatattcagacccccagaatagctcctaattctaccagacttccacagtggtcgtgccacgtgcatgtgcctgtagaccaaccatctggcatgaacggctgaacctgatcctagtagcctagcgttagatgcataactatggaactccatacatgtttgtcaggaaagcaattagcagcgaagttgttgccaaatacagcgctcaaacaactttcacccatgaacccccacacattgggcaagcatggctccaccgactgatccaccaagcctcacgttcatttgtctgatttggggcaccaggatgcgcaaatgcacaagtttgccgcaaacaacgtatgcacttgtaccaatcaccatcgagacctgttctccacacagccgtgacaacatctcttcgagatcccatgacacctagataacctccaagacctacagatgttttcagaccaaatgcagcatctctttcagataacctacgctttcttggccaaagatcaatcccaatggaactgacagcatccacttccatgtcagacaaatgagagttgatggaaccactaatttttagacgaggcatattgtccaatggaccaaaatcatctggttctgaccagggtccaccaaacatgttgcgtctatgccattcttccgcaggaggttgcagttctaattctcgaagtagaagtccagcagcatcagctcctcgtggacgaggcatattctgcatatggggaccaagagacgcttccactacctcagggagcactgtgtagttgccgtcaatgtagtgcagccttatgataatgctactggaaccaacctgagaggcaggcaatggatgcggcaaggtagatgtccttcgacataggtcaaccagtataagaaaaaggaccttgacctcatctgaagtataaccttgcccagcgttgccagaacctattctaacagatttgccaattggattttcttcaggaccctttgcaccaccaagaacaaattgtccaccacgcgcagagtgaccttcttctactttggcagcccctagaccagatcttactgtcgtactgttatcttctgtcttagcattcatcatgtgttgtattttctgcatggcagaatcttgatttttttgcgaactggcaagtaaccttggtgattgccttcttcggaaaagcagacaaaatagcagtaattgacataatctatgaagaaaatggcaatccccaataagtctcacagcaggtgtgccagggaaagtgcccgtattaatgctgatgggcataaatgatgtcctcgtgctcattggattctgtgttgcagtggcagcaccatcagaattgttactaatcttagcaattgcaccttggacccactcctgcatttgtgagttccctgttgcagatgttgatcccccttgattaccttgattatttgatggcgaaggagaactgtttgttggacttgtaaccatatttctagaagtgcctgtggtagaagatggccccacatggctcgccagagttcgacagaaactcgcataacgccgcaagcgagttatgaaatgtgatgctaaatcaagaacagcatcaacgtaaccctgcattttttcgattaggatgggctcagcagtcattttgtcagcatcgatgctggataacatatcactggaagcttgccagggctcaggtagcagagttgatggatttgtaagggcagactcgattcctttgcctagcatatccagaagtaatcttgcttgcatgtccaacacaagtgcccgtgtcatcttgggcatttgttccgttccaacaacctacacgtaatcctatcaaggttcggcctgtcccgcgccctctcggcccgagtcggaagagaatggaagtccgcatccagaaaagctatcacactgttaagtgaaactataccatcttcggcagcactctgtgtacaaccaacagcatcccaccaatcaactccagccaataacccggaccggccggc

SEQ ID NO: 23721 - DNA, 1915 bp, Zea mays
ttgggaccctcgaggccggccggggtaagagagagagagctcgccgctccctcggaatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccgtgccccactcggctgctggtgagcagcccttgtcgccccctcctctcggcccgcccgcttcgtgtctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattattaagaggccaaagatttctggagcacagcttgtagccatcctacctctggctattgttcatactatgggcaatctcttcaccaacatgagccttgggaaagttgcagtgtcatttacgcacaccatcaaggctatggagcctttcttttctgttattctttctgcaattttccttggcgagttacctactatttgggtagtatcatctcttcttccaattgttggtggtgttgcattggcatctcttactgaggcatcctttaactgggctggcttttggagtgcaatggcttcaaatgttacctttcaatcccgaaatgtattgagcaagaagctcatggttaagaaagaggaatccttggacaaccttaatctcttctctatcattacagtgatgtcatttttccttttggcccctgttaccttctttacagaaggtgtcaaaattactcctacatttttgcaatctgctggtctgaatgtaaaccaagtccttacaaggtgtcttttcgctggactgtgtttccatgcataccaacaggtgtcttacatgattttggcgatggtgtctcctgtcactcattctgtgggcaactgtgttaaacgtgttgtggtcattgtaacatcagtgctgttcttcaggacacctgtttctcctatcaactctctcggtactgcgattgcacttgccggagttttcctgtactcacagctcaagcgacttaagcccaagccgaagacggcttaaatagggattgtattttccatctctttgtgttaatggagttaaacacttctatgtttcaggtgactgcattttaaaagatttgtgcttataacaacaacaaagtcttttagtctcaagcaagttagataggctagggttaaaaaccgaaacacctccccccaccccccaaattaaagatcagtcacatggataagtgttttccatgtacttctatttaagtctaaatctttagatatatatcatcatttgaaaccttcttttattgtcttttttcttgttaacttcgagctttctcttcttttttctcattgctatcacgccttagaattccattacgcaatggcgcctttggaggtatatgttcaaaccatctcaaccgatagacaagctttttctttaaatggtgttatctctagcctataatgtatatcataattctggactcgattatttcctgtatgaccacaaaattaatgtaacatatatatttccgcaaaaaaaaaaaaaaaaaagcggcc

SEQ ID NO: 23722 - DNA, 1351 bp, Zea mays
ttagagtcacccgctaacattgggtacctcgaggccggccgggacacctgtaaaagatagagctatcccctcccctccccccgcgatcccttggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgtctccgccgctggcgccgtcgctaccagaagcagcgccgtgggccctcgcggtctggggctcgggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattattaagaggccaaagatttctggagcacagcttgtagccatcctacctctggctattgttcatactatgggcaatctcttcaccaacatgagccttgggaaagttgcagtgtcatttacgcacaccatcaaggctatggagcctttcttttctggtattctttctgcaattttccttggcgagttacctactatttgggtagtatcatctcttcttccaattggtggtggtgttgcattggcatctcttactgaggcatcctttaactgggctggcttttggagtgcaatggcttcagatgcgacctttcattcctggtagaatgatagatttattctgaaactaagtaagatatacttcaactttctcttgtctttactgtatgtgacaggtactcaaggttttcccataccctataaacatcacagaagttcaatttgctgtcggaactgtagcagctctgttcatgtggatcactggtattattaagaggccaaagatttctggagcacaggtaacctttaacattttcttacaacttttacgctatttacttggatatatattaatactcatgttcattttaacaattttcagcttgtagccatcctacctctggctattgttcatactatgggcaatctcttcaccaacatgagccttgggaaagttgca

SEQ ID NO: 23723 - DNA, 1093 bp, Zea mays
  misc_feature (1)..(1): n is a, c, g, or t
  misc_feature (14)..(14): n is a, c, g, or t
  misc_feature (16)..(16): n is a, c, g, or t
  misc_feature (18)..(18): n is a, c, g, or t
ntcgtgccggcttntngngccgttttttttttttttttttcttttttttttttttttttttttttttttttccaccaagtgcaatttcaatcacaatatatggcaagaaggctgcagagaacaatataatagcatccggaatactgattcggcgacagaaaccttgtggtgttacattgtttcaggaactgcagattcaaatgttctgattcatatattcagttcccagctttctttctgagtatatatatacagtgtgtgagctctagacaacattttttacatatcacattctactgattacagaaggatgataagcccttctttctgatcactatgacagttgacaacaatacatctgtgttctggagaggaatcaatcaaatgtacaatctggtctcttaccagaatagatcatctatacccacagacgtcgatggtgggggcacttcctcctcctcctccatctctggttcaggttccatgccaaactccggggactcaatatcagcaaggttcttcaagtcaacgacggatagctcgtctagttgcttcaccacaaggtctgcagcgctaagctcgtagatcttgtgcttgcttgcgaccgcgacacacttcatacgtgcgtcatgcgcagcttccaccgccgaattggagttcccaaacacgatgcacctctccgggatgaaactgagaagctgagcagcgtacaggaacatttctgggtcaggcttgccccggtacacgtcttctgctgtcacaaccgcatcgaagaagctgcgcacgcctacagcttcaatggcttcctcaataaccttccgtgggcgtgtggtgaccacagcgatagggatcttgtaattggcgagggtgctcatgaactccctggaaccgttcctcatctggtggtaggagccaccacgaaggctgctgtggatctcgtccttcctcagggccaatctcctaagctcggagggatcccgagaccagcagagaacctcagaaatcgcctgctcgttcttcatcccttcgactctccgcaacacaaaagcgggaggcggcgacttgccctcctcctcggacgctgggtcgaccg

SEQ ID NO: 23724 - DNA, 1685 bp, Zea mays
  misc_feature (1679)..(1679): n is a, c, g, or t
gcaattccaatctaacaaccgctgttgacagttccaaagctttgaacctttttttcctttcttttttctcgtgacaactaataacatatccttggcatcaggacaagctatttacacagcccgttctcactctacaacccatgcgctcaaatgcacacccactattctctatccaggcagaagaacatacattagccggcggctcaacgaggacatcttcctcgcgggcgtatgccaaagaatcaactaatgaaacaccaataagaggttgacgacaatgctgttgagcgttgacaatactagctccagtcaaaacaaactccctctcggccagctccgcatgatttgcgcggaccaatatcattctgccgctgcccaatagatgatgacggacggcccattaattgatgccacgcgtagatgaattcgagcgtgaaggtgtcgtcctcatagaccgtactgatcttatggacttgtttacgaatggatgctccaacagtttggatgctgacggtctgtcttccggattcggttttacacaccggcttataaaatcgcgagcatccctcgaaagagtgtttggaattgctggtgattcccccttaccgatcctgtatagagcttgtgcccattcaaggtcaggatagggtatctggcgtgtcaacatctccaggacagtgcaaccaagactccatatatcagctgcaggtccatatgtctgctgcggatcaacaacctccggtgccatccaataaacagttcctttgcatgatttaagttcattgaatttggtaatctccttagcgagtccaaaatctgcaagcttcacagatccatttgcatgcaccagaatatttgcgcatttaatgtctctgtgagcaatatttctttcatggagcccacgcgtcccattaagaatctgtcttgtatatgcagagacttgagtatcacgcaggcgatacttatgatatagtgatgcaagggatccttgggtcactaattcaaggaagatgtaaagtttcgaatcttctttgtctgtcccatagtactgcactatattctcatgctcaaactggctcagaagtgcaatttcctgctcaagctgaaagatacactgcttcgcattgctccctttatcaaataagttcacttctttgacagcaaagaagacaccctcatcgctgatgccctcatagactgtcccaaacgagccactacccaggagcacccctcggctccatgacttgatcctcctcctaaacctcccgttcggtgaaatatagaacatggattctgtggtggtgcttgaggtgtcgtcatcgttggtcgttgatagcgaagaagtaccagtaaagctctcggacgactcctccagcctaagatcatccaacattaacagaaccgccgcacgctcgtcgtcatccttctccactgcatcctggtgtccaaaacgacggccagatctgctagcgggggcgtcatctttctcatcaggcgccaacgaccgcaagatatcccacgtggatcccacgccgcagacagctggtagggccatcgaaggcggcggcttgagcaccggtggcgggcgcacgcccttgattcctccctgcccaggcgccctcctggcatccggacccacgcgtccgcccacgcgtccgcccacgcggccgcccacgcgnccgcga

SEQ ID NO: 23725 - DNA, 1920 bp, Zea mays
ttttttttttttttttgctttttttttttttttcaaacaatataaggggttatttgtaataatatgatgcggacgaccgtcaaaactagtgctttaatatactaaagatatagatacagatatttgtccgacccgcaattactaaggtacatagacgaggacatacatactggatgctgttgacaaatcacaatcgatatagaacaaatgatgggcgacaataacttttgcattcatgcatgcaggaagcgatcgaaccattcgcttgctgccttcaccatgtcgattgtgattttatggccgactccaggctctgcaatgaacatgaacttctccgcgcaaccagattcttcgtaagctttagcagtttttgaaatagcttctcctaaaccacttattgggcaatgaggatcttcagcgccatttagaagtagcagcggccgtggtgcaagcaaaggaagtgaatagggggcatcaaattgcgagtccagacctggtgctatcttttcccaaaccttttcaacaacttctgtatctaattcgctctttcctaagtcaattcctgcttcttcaaataaaggccttatgctattcaccctagccagccacttgttgttgtcaatggcccacctgaatccctgaacaccgatgataggaacgacgacactgtaccgtgtgtccacaaaagcagcaaaccacgcgtgcatccctcccagcgattcgcctgtgatcccaaccctacagggatccacgtcctccctctcgccgaggtagtctccaagctttaccaagtcccacaccgtgtcaaaaatgaaaggcattgtatccccattccgccaagccgatttcagtgcctctatgtaagtggtttcattgctggccctttcgccgtgatagcgcgagtcaatagccacacagacgtagcccttggaagcatatgcctcaagcagtgggcgcagccactctttgcacttgtaagagctgtgcaggaacacgatagctggttttcttctaggaacggggtcgtcaagcttcagcagaagtacaggtactcgtccttgttcacctagctcagtgattaggtagaaattttcttcaaccagcttctccctcaagttctccacatctttactggggcacgactccatcggatttgcctccatggtggacggaggattctggtacatcgggtccttcaccggactcccttgctccaccgagagaggcacttggagatcgcggcggcggctgagcaggacctgcaggaactccgatctgagcccggcgccggcgtcggcgtcggtggcgctggcggccatttgtctcaccgggaaggcagaaacgcagcgccgaggctgctgtggcgcggtgtcacggctgctggggatgcggactgggcagtctgggctttgtagttggagcgggacaagtaaccgccgcccttcttcctccccgaggcggagcaatgtgatgtgctgtgctggcaggatggactgcgacgtcgcccccagatcacagcatcgactctggcttcttccgcggacatcgtcgtatcgtacatcgtcgtcacggacgtggctttggctgctagtgttgtgtcagctctgttgacgcccaggacatctacgattctaaaaaaacgggcatcttaattatactagtacgttcatattttctacagacgcgcctaatgcacggtcggccatcgccattgccagccattctgcccacatttcttctcctatttattcattttattatattttattatatctctctaaactctctctctacgtacagacatctccaatcttacatttctctatctagctcctactatacaatataactcagttatttaatatttttattaatttgcatggttttaaaaagggttttttaatttggtgcccttagttt

SEQ ID NO: 23726 - DNA, 582 bp, Zea mays
tgttctcgaaccaaacaaaggacatgaacaatccatccccagttatatctctaaccaaacaaaaaaacaaggatcatctcatccttccaaccaaataatatgaggaatcattccattcccaacttaggagccattctattctgtcctcatttgtcccgcaaccaaacgtatcctaatataataaatagagatagagatgtttgtccgaccggcaattaccaaggtacacagacgaggacataaatacttcaactaagggatgctgttgacaaatcacaatcgatatagaacaaatgatgggcgcgacaataacttttgcattcatgcatgcaggaagcgatcgaaccattcacttgctgccttcaccatgtcgattgtgattttatggccgactccaggctctgcaatgaacatgaacttctccgcgcaaccagattcttcgtaagctttagcagcttttgaaatagcttctcctaaaccacttattgggcaacgaggatcttcagcgccatttagaagtagcaacggccgtggtgcaagcaaaggaagtgaatagggggcatcaaattgcgagtccaggcc

SEQ ID NO: 23727 - DNA, 914 bp, Zea mays
  misc_feature (761)..(761): n is a, c, g, or t
  misc_feature (807)..(807): n is a, c, g, or t
ggcgattgggtttctcgaggccggccgggggcgattgggactctccccccccccgcggctgtgcatcgccggacggaaccaaacgccaaacgctgctgcgctctctccttctcgtcctgaccccccagagcgagagggaggggcacccagaggagcctgtcgttttgatcggtgtctctgcccccgttcccgcgaggagagaacaacctggagaaaatggcgccgatctccggagccacggcagtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgcctcctccgcctacaagcagctcttttaaaaccatccgctttgtaatttggcgccaattgagggtgtcattaacggtgttcgattattaatcgatccagtttggccccacaactagaaaaggaaaaaaatgcacacatcttatccttgctacttctaggatcttttcatatgtcttaatttcaatcgagggcgaggccagaagaagccaaattattgcaaaaaaaaaaaaaaaaaagttgcggcccccccggccgccccttccttacccctgggacaccttcaaggggaactcttttcctccaaagggggggttttttttccccccccgggggggggggggggggggcgggcggnggggcaatatttttttttttttccccccccccccccttgcgggggntttttttttttttttctctctccccgggggggggggggggggccccccccccccaaaaaaaaaaaaaaaaaaaggggggggggcccccccccccccctttttttttt

SEQ ID NO: 23728 - DNA, 774 bp, Zea mays
ggcgattgggttcctccccgccggccggggtgcatcgccggacggaaccaaacgccaaacgccgctgcgctctctccttctcgtcctgaccccccagagcgagagggaggggcacccagaggagcctgtcgttttgatcggtgtctctctgcccccgttcccgcgaggagagaacaacctggagaaaatggcgccgatctccggagccacggcagtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgcctcctccgcctacaagcagctcttttaaaaccatccgctttgtaatttggcgccaattgagggtgtcattaacggtgttcgattattaatcgatccagtttggccccacaactagaaaaggaaaaaaatgcacacatcttatccttgctacttctaggatcttttcatatgtcttaattccaatcgagggcgaggccagaagaagccaaattattgcaaatactcgttaagccttgtttagttattttcatttcatttggattaaatgggattgaaagaagttagcaggaattttgacttgctatagatttaaagctacctaatcttgttcaatccacatggattgagattaaatcgaaaaagcctttatggggacctttttttttagtttcaaaa

SEQ ID NO: 23729 - DNA, 648 bp, Zea mays
ggtgcatcgccggacggaaccaaacgccaaacgctgctgcgctctctccttctcgtcctgaccccccagagcgagagggaggggcacccagaggagcctgtcgttttgatcggtgtctctgcccccgttcccgcgaggagagaacaacctggagaaaatggcgccgatctccggagccacggcagtccttgtgatggccgtcgtcgccacgctcgccgccgccccgccccagcacctgctaccagtgacggaacaagtgtagaccagggaatcgcctacgtcctcatgctggtggcgcttgtcctcacctacctcatccacccattggacgcctcctccgcctacaagcagctcttttaaaaccatccgctttgtaatttggcgccaattgagggtgtcattaacggtgttcgattattaatcgatccagtttggccccacaactagaaaaggaaaaaaatgcacacatcttatccttgctacttctaggatcttttcatatgtcttaattccaatcgagggcgaggccagaagaagccaaattattgcaaatactcgttaagccttgtttagttattttcatttcatttggattaaatgggattgaaagaagttagcagcaaaaaaaaaaaaaaaaaagcggccgcc

SEQ ID NO: 23730 - DNA, 854 bp, Zea mays
ggagctcgagggccgctttttttttttttttttcaccaacaaaacccagtaaatatattaatctgaaagttgaatgggttacacgattcaagaaattcatccacttcatacttgaaagagtccaagaacagcccaagtgtaagcccagctttccagtaattaaacacggtaatcatgttcccgatcctaccgaggaatgcaaaggaggccctatacatcagcgcaccgataacctccacgatggcaacagcaagtccggccgacaatatgtcccagtcacccgtttgcccgatgacggtagcgaacgcggtagcgcagtagaacccgatcagaaagaataggatcttcactggcaaccctctccttgctttcttcagcttggcagacaactggttccagaatgaacggatcgcgctgaagaggcgagtgctgttgcctgattggtcaccgctgtcgtcggacatggttctgatagcccattgcaccttcctcgagtgcctgcgcaaggaaggagattttgccctcagcaaacagagggtccccggcttctcccagcggcaggagacggcagcttccctcccaacacggcgcgcagcagcaagcctcgatccagagcactccgaccagcacggcgagttggcagttccatcgcataaggggagagttgacatatgccgccgccggatattgaccaagcatctgccgatttgcgctgtagagtagagatgctcctcgtcaactggtgtcaaggccacggagccggcggtcggccgcggcccgtgtcggagagggatgaggtggttggatggagcggaccggagtggcggacggccgcgcccggccgcgaggtaccc

SEQ ID NO: 23731 - DNA, 1101 bp, Zea mays
aaaatagttttagcgtatctcagtcaactactccctttcatgcagcaacgtctctcttctcaattctcatgcgagcgagcgggcgggcccccacgagccccaccaccagactagccgttgcccgttgccctgtcggactcactcggtcactcctcagtcctcaccaccgccgcgccaccgccgcgcccccagcctcaacggccaaatcctccgcgccaccccgcataagtcattgggtacctccaggccggcccccactccaaacctccctctctcgacctcgacccctcgcccgcaaagccccgcaagccagcggcatcccgcttcctcggcaggcttccaagacccaacccaacagcttccgagcgagtacggcggcggcgacgatggcggccaagtcgcacacacgcaaggcgttcctcctctgcaactacgtcctcctgggcgcctcctccagctgcatcttcctcacgctgtcgctgcgcctgctgccgtccccgtgcggcctgctcctgctcttcctccacgccctcaccgccgtcttctccgcggccggctgctcgggctccttcacggcgcccgccacgcccgcgcagtggcacaacgcgcacaccgcgggagccgcgctcaccgccatcttccagggcgccatcgcgctgctcgcgttcacccgcacctccgacttcctcgccgagctccagtcctacgtccgcgacgaggacggcgccgtcatcctcaagatggtcggagggctcggcaccgccatcttcgtcctcgagtgggccgcgctcgcgcttgccttctccctccgcctcgacgaggatgacgacgacgacgacctccaggccaagaactggcaatcgtaccatgtctgatcccatccactgctggcctgggctccttcaaaatgagattctttgatgtctattctattattgtactattgctgtcattcttttgtactacggtgtactgttatgactgttcaaccaaaataaataaataccaaagcaaatatatattattgcttttgttaccaaaaaaaaaaaaaacatgtgcattcatcagatttgatgcaaacaggttgcaaaaattaatttc

SEQ ID NO: 23732 - DNA, 1468 bp, Zea mays
  misc_feature (1452)..(1456): n is a, c, g, or t
  misc_feature (1458)..(1458): n is a, c, g, or t
  misc_feature (1462)..(1465): n is a, c, g, or t
ctggaataagaggctccatcggctacgttgctccaggtgactgaaactatacgtgtgtttgggtttctattcattgttccttgtttcttgtataaaactggttggtttttgatcgattcttttttccgtaatatatataacagagtacggtgaagggtcttgtgtttcgactcttggagatgtttatagcgtgggcatactgttgcttgagatgttcacgggaaggagcccaactgatgagatgttcagaggatcattggacttgcacaggttttcagaggatgctctcccagagagaatctgggagatagccgatgcaaaaatgtggttgcacacaaacaccaaccatgtcgccacagttcgcaaacgttcctattcccagtcaactactcttctcatgccaatggacccccacgttccctccctccggagtccggacccacccaccagactagccgttgctcctcactcctcatcatcgccgccgccgccgccgacacgcctccaacggccaaatcctccgcgccagcgccaccccgcccgcccgcgcaggtataaagttcctgggaccccccgggccggccgccactccaaacctccctctctcgatctcgacctcgccccttcgaccgcaagccatcccgctccctcggtaagcttccaagcggagtccggcggcgtcgagtcgaatggcgggcaagtcgcacacgcgcaaggcgttcctcctgtgcaactacgtcctcatgggcgccgcttccagctgcatcttcctcacgctgtcgctgcgcctgctgccgtccccgtgcggcctcctcctgctcttcctccacgccctcaccgccgtcttctccgcggccggctgctcgggctccttcacggcgcccgccacgcccgcgcagtggcacaacgcgcacaccgcgggggccgcgctcaccgccatcttccagggggccgtcgcgctgctcgcgttcacccgcacctccgacttcctggccgagcttcagtcctacgtccgcgacgaggacggcgccgtcatcctcaagatggtcgggggcctcggcaccgccatcttcgtcctcgagtgggccgcgctcgcgctcgccttctccctccgcctcgatgacgacgacgacgacgacctccaggccaagaaccggcagccgtaccatgtctgatcgtccgctggtgttagctccttcagaatgatatatgaacaagattcgttgattctttgccgtctgttagtatgtactattgcttttttttggtactactgtgcctgttcaaccaaaattgttaaatgccaaagcaaatatacattgctttttgttgccttagcaactaaaaaaaggccccttcatcagatttgatgcaaacaggttgtaaaaacaaatttctgagaaaatctgtcatttgataagccacaagtgaaaaatatatttgctcgccccnnnnnanaaannnnaaa

SEQ ID NO: 23733 - DNA, 893 bp, Zea mays
tcgcgcccgcgccactccactccaaacctccctctctcgatctcgaccaccccccttggaccgcaagccagcccagccgtcccgctccctcggtaagcttccaagcgagtccggcggcgtcgagtcgaatggcgggcaagtcgcacacgcgcaaggcgttcctcctgtgcaactacgtcctcatgggcgccgcctccagctgcatcttcctcacgctgtcgctgcgcctgctgccgtccccgtgcggcctcctcctgctcttcctccacgccctcaccgccgtcttctccgcggccggctgctcgggctccttcacggcgcccgccacgcccgcgcagtggcacaacgcgcacaccgcgggggccgcgctcaccgccatcttccagggggccgtcgcgctgctcgcgttcacccgcacctccgacttcctggccgagctccagtcctacgtccgcgacgaggacggcgccgtcatcctcaagatggtcgggggcctcggcaccgccatcttcgtcctcgagtgggccgcgctcgcgctcgccttctccctccgcctcgatgatgacgacgacgacgacctccaggccaagaactggcacccgtaccatgtctgatcgtccgctgatggcgttagctccttcagaatgatatatgaacaagattcgttgattctttgccgtctgttagtatgtactattgcttttttttggtactactgtgcctgttcaaccaaaattgttaaatgccaaagcaaatatacattgctttttgttgcctttgctactacttgcatgcacattcatcagatttgatgcaaacaggttgtaaaaacaaatttctgagaaaatctgtcatttgataagccacaagtgaaaaatatatttgctcgcccc

SEQ ID NO: 23734 - DNA, 2289 bp, Zea mays
  misc_feature (715)..(715): n is a, c, g, or t
tactgatgcgtttgttgaaacaatttatgttaaccaaatgagaagtgttggcatctgatgtatgcctgtgcatcagcgctccaagagctactcctattattgcttaccttaccctaggctgcattactcaatgtaacttaccattgtttgattgctcacagaggcctttatgcaagtttgcacattgctcaaagcaggcctaatgcttgtgctaaagctttgaatgagcatttcaaacttaataggactgctgagcaaatttctaaccacttgaagacagtgaagaagaagtacgttaggattaatcaacttagggctgaaagtgggtccggttgggatgaagatttatttatggttacaatggaccatgagcagtacacaacccactttgcggtaatatattagtgctgtttttatccttcttttgcttgtattattgctatcatgtgagtactaacttggttgtttcatgctagaatgacaagaacaagggggatgatgagtacatcaacaaaccattaccttactatggcaatttagcaacaatatatggtaatagtacagcaacaggaaggtttgtgaagacctcaaatgaccctcttggagtagatgagttgaatacccaaaaagaaatggagaacattgggacaccaactaatggtttgaatgacaaggaaggcagcccacctaagagggacgaaggaggacctagtanaccatccaagagagctaagaaggatgaatgtggagcagatcctttggttcaagcctttcaaagtggtgctgaaactatagctaatgctattggcatgcctgcagcaagtaaaggtttgccaaacggattgtttgaagcggtggacagccttcccggatttgagcttgagcacaagtctaggtactactctcatatgcttggtgatcctaatcttgcaaatggtttcatgaatgtgcccgtgctttacaagatcacaatgatggccgatttcatgaacaagaatatgtaggcttcctaggtacttaagtagacctagttggatgattctattgagtagtcatggactcttgtggtatggatgattttgagacatgcatttgtatccatgaacaatgctctttggatattcttgcatgtcatggtggttgtattttgggatggtggttgctgccatattgaacattgattgtggctgctcattgttgacaatgtagttggtaatcacactatattagactgctcatatgttgagtattttgtgttgaatgtggctgttcatatgtaaccgcattgttgagaacattgtgatggtaatgagttgttgtatgttgatcatagtgtgttacaatttgaaattatactctagttccactcttgaaccaaacaaagaatggagccgatccgttctacttcactccagaaccaaacaaaaaatagagccgctccgttctacaataccaaacacagagcggaacggctccgctcctggaattggaatggagtggctctactccaacacactcttgaaccaaacacaccctaaagggtgcagcctgcctctctttacttgatatagcaagataagatgtagaagattctaccaactactactattgcagtgccatactggccataccatctactgttactgctaggccatacaagcatgctcctgtcactagacaggggaggcatagccaaaagaacataacactatctgctcataacgcatggaaggcaaaacagcaagagctagccagattaaacaacacaattcctgtagctgagtgcacctttactgcatgggcaaactgtgttttagcgagggagatcaggttagatttgtaggtgttgtttggcgcatggtttttaaagcggtaaggcggtccaaggcgttggagcaccgccaggacgcctaggcgaggtaggcgggcaaggcgcctagacgttagaccaccgcccggacacctaggcgacgccttaagaacagatgtttggcgtgtacctggcaccattgcaatcactgcaggccggctggccagccaatggtgctgggcaggagaggaagacaaataggagagataacaatttcagaatgactggtaactagaggtctagagcgccgtggtcttggtcacagatgagtgccaaatgtcatattggctttgtcttcaaagaggtaagagaattcaatggtcaagcttagattacattcagacgtgttatttgcaacataaattgaaagacggtgacatggccatatttccacggaagactggtctagagagctgtct

SEQ ID NO: 23735 - DNA, 767 bp, Zea mays
ttccccttttatcatatagtataaaaactataaatgggtgatacacgccataccgctaagttgccaccttactttgctacctatctgaaacacaacatgctaagattactgagtaaccttgatgttgtgggacagattcgagcaaaacttcttcaatagaaaatgcatgagcagatgtatttacgggaagggtggcctgtacacggttgttgaccatgtgatccgcacacccagtcatttacatggattgcttgcttccagcatgaggaaacaatggcagctattgtgatcacattttacaaatccggtaaagggtctcaactgatcttctgctgagatgcctcgacgtactgcagcgcgagcttcctcaccttgtcaccctccttgatcaaaaagtttgcatttttggcgtcgcggtggaagctcattaccttgtcagttgttttcgcgacagcccacttatattgatcgaccgtgatcaccgcactcttgcaaagtggcctgatctgctctttcacgaacatttcaaccttcttatatgtcgagtttgaggcatctgacgtatttttaccggcttgatcacgcggcctcttcttcggatcatctccaccttcagctgcaccacggtttggtttgtctcctttcggttctctgctgcttgctgatggtttgtcactgcaggatttctctttagtgagctctgagttctttggtttgctgatcacttcaccgtctcttgtcaaatcatcctcgcccgactcattaga

SEQ ID NO: 23736 - DNA, 2075 bp, Zea mays
gaacattgggacaccaactaatggtttgaatgacaaggaaggcagcccacctaagagggacgaaggaggacctagtagaccatccaagagagctaagaaggatgaatgtggagcagatcctttggttcaagcctttcaaagtggtgctgaaactatagctaatgctattgaaaaggctgcagcaagtaaaggtttgccaaacggattgtttgaagcggtggacagccttcccggatttgagcttgagcacaagtctaggtactactctcatatgcttggtgatcctaatcttgcaaatggtttcatgaatgtgcccgtgctttacaagatcacaagatggccgatttcatgaacaagaatatgtaggcttcctaggtacttaagtagacctagttggatgattatattgagtagtcatggactcttgtggtatggatgattttgagacatgcatttgtatccatgaacaatgctctttggatattcttgcatgtcatggtggttgtattttgggatggtggttgctgccatattgaacattgattgtggttgctcaaaaaaaaaaaaaaaatgggaatcacactatattggactgctcatatgttgagtattttgtgctgaatgtggctgctcatatgtaaccgcattgttgagaacattgtgatggtaatgagttgttgtatgttgatcatagtgtgttacaatttgaaattatactctagttccactcttgaaccaaacaaagaatggagccgatccgttctacttcactccagaaccaaacaaaaaatagaactgctccgttctacaataccaaacacagagcggaacggctccgctcctggaattggaatggagtggctctactccaacacactcttgaaccaaacacaccctatatgtcgcactagaagcaaggttcaatgtcccttgttctgataacgagtctatatatcatatagtataaaaactatagaatgggtgatacacgccataccgctaagttgccaccttattttgctacctatctgaaacacaacatgctaagattactgagtaaccttgatgttgtggggcagattcgagcaaaacttcttcaatttcacctgaagcacttgttcatcatgtcaaaatgcataagcagatgtatttacgggaagggtggcctgtacacggttgaccatgtgatccgcacacccagtcatttacatggattgcttgcttccagcatgaggaaacaatggcagctattgtgaacacattttacaaatccggtaaagggtctcaactgatcttctgctgagatgcctcgacgtactgcagcgcgagcttcctcaccttgtcaccctccttgatcaaaaagtttgcatttttggcgtcgcggtggaagctcattaccttgtcagttgttttcgcgacagcccacttatattgatcgaccgtgatcacggcactcttgcaaagtggcctgatctgctctttcacgaacatttcaacctacatacatgacacatagaaagaaagaaagaaacacgtgtcaaagttgaaaatttggtgacgcctacagaaagaaaaactgctgtggatcaaacaagtgggggtaccttcttatatgtcgagtttgaggcatctgacgtatttttaccggcttgatcacgcggcctcttcttcggatcatctccaccttcagctgcaccacggtttggtttgtctcctttcggttctttgctgcttgctgatggtttgtcactgcaggatttctctttagtgagctctgagttctttggtttgctgatcacttcactgtctcttgtcaaatcatcctcgtgagattgattaggtaaaccgattgctgccttttctatctctctcgaagcctccacatgcccagtaattttatcgggcatgttgcaatcaactgaaatttctataacaggtccatttgatttttcatgcttctcactgcacctatcgccttcagtcaggtttgcggcatttgttttgtttgctgcaacgtcctcagtgtctcccttgcctatcaacttatgttgcccttcattattaggttgtttggt

SEQ ID NO: 23737 - DNA, 2407 bp, Zea mays
tttgtaaggaactaaggagtgtttccttgttagaattttttcttggtattttagacataacaaagaagagtaggttggtgcagtggcgagagctgtttcactgagtacctttaggatgaagctcattagaaccattctgctactgctgtacccttgatgagtctgaaaaatactggatgtcttgtgttaaaggaaatctgttttggttgctgcaatggtatctggccaataatgctaacattgtatttgtatgcctattggtcagtctctctctctctctctcttgacgtcttcagtccatctaataacagtcttacattgtctgtcaattttttagcttctcaaaaagttttgtgctgtgccttgtattgtgaaaattaatatgaagtttagcagtacgatcatgagcctcaaggtttccagcctcaaggttttgtgctaacattgtatgaagtttaacagtcttacattctcaaaaagttttgtgctgtgcctttagggcttatttggttgtgaccctgggaaaggtgtctgggccaggcagctccccaagccatcgatttcagacgcctggtggccgggtacccctgtctggccggtattcccaggccaggtcaccaaccaaacgagctcttatagccgtataaaaaagagcccgatccggagttgggcaactgaaactacattcttgagtcatgtttcctgtttttctggtttaagttaaggtattgtaggctgtagcattgccattgccaatcttaatcattaggccagcattggttagtggttatatatatacttgttaatggatctattgtttgcaatcaagattgtcattattggcaggtttccgtagaagcgggaacatcgtgcttccacatttataattcactcaaatccaataatgcgtttgccgccgcggcggccttctcaacctatcctcgaacatacgatcttctccacgcatgggcagtcttttctgaccttgataaaagaggctgcagtgccgaagacctgctccttgaaatggatcgtatcctcaggccgactgggtttgccatcgtgagggacaagggcaccgtcattgagttcatcaagaagtacctccacgcacttcactgggaggcattgactgtcgtggacgctgagcccagcccagaatcagaggagagcgaaatgatcttgataatccggaagaagctgtggctaccaaaagcaggcccgcaggattccggcacgtagttcttctcgtacctgttcctctcccagcacctgcagctcagaagccaggcgcagctgcaccatccaaaatggttcgacacttgtagctcctgagatagagtcagtcatgatttctagccctaccgcccacatgaagataggttgtttacgaggatactgcaagtagtatgtagcaggcttggattaaaaaaaaggcccttttttgtcgcgacagatatggattggtgtttgttatctagtttggttaggaaataaacattctttttcttttaggtgtttcgtgtcctttttttttgaagtctgctatagtctgtagcaagtgtatttggtgttttcttgaaagaactactgcgcccacatttttgggatatgtgctttgccctagagcctcaaggctgcgggtcctcagctcgaaactactcgtgcaaatctcaaccgggagagcacttcaatataaacaggtaattttacagcacattggatgaaggtgctgttaatacgttttctcgtgagtgcatccgcacccctcaaatgtaaataggttcgtcacacccagatgctggaaagagaagatggcaaagtcatgaaaatgatggtggtcttagcacgtaaatctgattacgctgattaggttttgaacaaagtttgcaaattgagttttgacaactctcctgtttgaaggagcaccagacggttttgtagaagccggagctgttttggaagagctatcaagaacagaggagccctaccaaacaaagtcataatctgtcatttgtaatgacctatatagcgctccctccgtttataaatatataacacagttttttttgaagaatcagtagggggcccctactgagaaatttattaagtaagcgaaacgaaaacgttaagataaggtctttttacaaacgttaaaaagtaatgaaaagggaacactactcctatgcctgccacaggctcagccaattcgggatagaggtgtcaaatttcccccgcgctctgtgcatgatcaatcgcagctctttgatgaattcctgcgtacaacggtgcacagaaggatctttgtttgaaaacaaccactcgaaaaggcttttaaaaatgctccaagtcatgagaataataatctccaaagagaaggggacgttaagctggtggaaaaggttcg

SEQ ID NO: 23738 - DNA, 1843 bp, Zea mays
gcacgcgcctccacgctatctcttccttctcccaaccccgctcaaaaccctagctcaacgccacaggctcgccgactttcgcccgggccccgcccccggcgccgccggggacgatggcgaagcctcggcgcggccgctccgcgtctcgctcctcctcgggatcttcttcccgctcgctgtcccactccgtctcctccggctctgtctcgtcccgctcccggtcgcgctcccgctccttctcgtcgtcgtcctcccagtcccggagccgctcccctcctcaggctaagcgcagttcgcctggagcacggaaagggcgatcaccttcaccgccccctaaaaagggttcaccttcaaagaaagtccgttcgccatcaccaccacttaaaaaggcttcaccccctaggaaagtgtcgcctcctgctgaatcagctgttctctgcattgatcatttatcaaggaatgttaatgaggctcacttgaaagagatatttggaaactttggcgaagtggtgaatgtggagctatcaatggaccgaatggttaaccttcctcgtggctatggatatattgaattcaagaagagagctgatgctgagaaggctcttcttcacatggatggtggtcaaattgatggaaatattgttaagttgagattcactcttcaaccacgccaaagggctgcatcacctgtaaaagctccgccccctcctccaaaaagagatgctcttcagattgaaaaaggtgttagcagtgctgaaaaggatgcccagcagcgtcctaaggaatcatctccacgaaggaaaccagcttcacctctacggaaacgatctccaaatcgaagggctgaatcacccaggcgtccacctgacccatcacctaggcgccgtcctgattctccgcctatacgtcgccgaccagatccttctcctgtcaggcgtggtgacacacctcgcaggagaccaccatctccagttcgaaggcgttctccttctccaccacctaggaggcataggtcaccgatgcgtctttcacctaggaggggacgtggtagcccatcaccacgcaggcgctcccctgggcctcttaggcggcgctcaccacctccaaggcggttgagaagcccaccaagaaggccaccacctccacgtcgcttcagtcgctctcctcctcgccgaccccttcgctcccgctccagatcaatttctccaagaaggggacgagggcctccattgaggcgtggtaggtcagactcatcatattctcgatcacctactccaccaccaagaaaggggccaaggagggtatcaaggagccgcagccctagaaagcctcctagagcaggaagaagcgtctccagtgacagccgcagcagcagttcaccttcccctagacgcggcaggtagaaagaacccgtggcattgtgtatgcggcaggtaaagccttttatcccttgactctatctgtatcgtttgcctgtgcttgtgacttgctgtgagttcaagtattggttcgaggagaagatgagagaacgctacagcaatgctccaaacggatctgctcaacatgcctggtcgaccgccctagtttgtgtggtctaccctagacagaattatctgctgtgttggcttgtgtactttgattgtaccccaagtattttgaagttctgaacttatttctgctaattggtgtctgaagtggatatgttgaatgtattttgttttgttggatagagttcctcagcattgccaccgtatgaaagatgaatctattgatcaaccaatttgcaaaaaaaaaaaaaaaatattaacagcagagcctgtgtccgtcggccgggcccccgcta

SEQ ID NO: 23739 - DNA, 1940 bp, Zea mays
tcgggcccctcgcgcccggccggcaatctcttccgttccgtccttccccgaactcgctcaaaaccctagccaacgccacagggtcgccgccggtcgcccggccgcatccgctgccgccgctgccgccggggacgatggcgaagcctcggcgtggccgctccgcgtctcgctccacctcgggatcttcctcccgctcgccgtcccactccgtctcctccggctccgtctcgtcccgctcccgctccttctcgtcgtcgtcgtcccagtcccggagtcgctcccctcctcctgctaagcgcagttcgcctggagcacggaaaggacgatcaccttcaccgccccctaaaaagggttcaccttcaaaaaaagttcgttcgccatcaccaccccctaaaaaggcttcaccccctaggaaagcgtcgcctcctgctgagtcggttgttctctgcattgatcatttatcaaggaatgttaacgaagctcatctgaaagagatatttgggaactttggtgaagtggtgaatgtggagctatcaatggaccgaatggttaaccttcctcgtggctatggatatattgaattcaagaagagagctgatgctgagaaggctctactttacatggatggtggtcaaattgatggaaatgttgttaagttgaggttcactcttcaaccacgccaaagggctgtatcacctatgaaagctccaccccctcctccaaaacgagatgttgctcagattgaaaaaggtcttagcagtgctgaaaaggatgcccagcagcgtcctagggaatcatctccacgaaggaagccagcttcaccaccgcggaaacgatctccaaatcgaagggctgaatcgcccaggcgtccacctgacccatcacctaggcgtcgtcctgattctccgcctattcgtcgccgaccagatccttctcctgtcaggcgtggtggcacacctcctcgcaggagaccactgtctccagttagaaggcgttctccttcaccacctaggaggcataggtcaccgatgcgtccttcacctaggaggggacgtggcagtccttcaccacgcaggcgctcccctgggcctcttaggcggcgctcgccacctccaaggcgtttgaggagcccaccaagaaggccaccacctccacgtcgctatagtcgatctcctcctcgccgaccccttcgctccagatcgatttctccaagaaggggacgagggcctctcttgaggcgtggtaggtcaggctcatcatattctcgatcacctactccaccgccaagaaaggggccaagaagggtatcaaggagtcgcagccctagaaggcctcccagaggaagaagcatctctagtgacagccgaagcagcagttctccttcccctagacgtggcaggtagaaggaacccgttgcattgtgtatccggcaggtaaagccttttatcccctgactcagatcaagtgttggtttgaggagaagataaaagaaccctacggcaatgcttccagtggatctgcttaacatgcctggtgggctcactggcttgtgatttgtacccgagacagaattatctgccatgtgacatctggctcatgtacttgattgtaccccaagtatgttgaacttgtttccgcacaggagtctggatcttttttttttgcattaaaccattgtgctacttggtctaaagcgttactgggtctttcgtttcaggagtctggatctttttttttttggcattaaatcattgtgctacttggtctaaagccttactgggtctttcgtttcaggtgttgaaaggtttcatctactttgttggaaggagtttttcaacattcccattgtattatgattccgttgatcaagcaatttgtgtatgcgcaggcgcacgcacagcgtacaccttttctaatctgaaaagagttgtcattttgcc

SEQ ID NO: 23740 - DNA, 1332 bp, Zea mays
cttttttgaatcaattacatcaagctttcccttttcattgatctgaattttcatgcaaaatacattttccgtgtatatatgaatatgaaaactgattggagtgaaaatgatcatcgtccgtctcctcaatgtagagtaagcaataatgatccaacttggggaaaaatcagtaaaataattggccagttcagcaagagctgaaactcaaggtttgcgtgggaacttggagaaatctgggcgtcgtctctccatgtacgcgttcttcccttcctttgcctcctccgtgccgtagaatattagcgtggcattcccgccgagctcctgaaggcctgcgtggccatcatctgccgcgttgagtgcagatttcagcacgcgaatagccacggggctgtttcttaagatctgacggcaccatttgacagtttcctgctccagttcagcaagcggtactacggtgttcacgagtcccattttgtcagcttcgtcagccgtgtagaaccgtgacagaaaccacatttcacgggctctcttgggtccaaccaaccgggacattatcgaagatccataaccagcatcaaagcttccaaccttgggccctgtctgcccaaatatcgcgttctctgctgcaattgttatatcacacaccatgtgcaaaacatgtccaccaccaacagcataaccagcaaccatagcaatgacaggctttggaagacggcgaatctgcacctggagatctaagacattgaggcggccaaagctatcgaagtccacatatccatcagaatctcttaacgcctggtcaccgccactgcagaacgccttggttcccttccctgtaagaatgatgactccaatcgaactatcatctctggcatcgttgaacgcgcgcattagttccttcacggtcagcggacggaaggcgttccttctgtcaggccggttaatggtgatcttggcgatgccctctccgacggccttctcgtagatgatgtcgacgaactccttccctgactcgtctgtggcggtgcgccactccggtggctccgacggcacgtcgccgtgcacgcgcctgtagctgtcccccgccggcgaggacgacgacgaggacgctgccgcgggagaaggcgcgaggggaggcccggtggcgtgtgggaccgggaaggacggaacgaggtgggcagcgacgcgagccagcctcctctccgcagcgtccatggcgagagccgagagctaagctagcacgggacgggcacgggtgggggtggggcggtggccgccggccgcgggcgcgtggcgcgagggttgtggctgttggctgggtatttcggttcg

SEQ ID NO: 23741 - DNA, 1385 bp, Zea mays
ccaaatagtttgtgttttttttttttttttttttaacataaaatgggaaacttctcagatatatgtagcagctgcttaatgttcctttctcatgtacaggacaagttataccacatactgtatgctaaaagaactatgatgaccgaagcagttcagaaaatctctcgaccagaggtagacaagtagccgcaggaaggattacatttccaatctagtatgcttctggaagcaattacatgtagcatttacctgtgccagatggccaataatatctccagtcattcttgaattgaattagcccaaataatatctggtgtcaatcaataacaagactggggaaaagctccaagcaagcaagctgcgggcactatgggtaagcaacatgaatcaggtaaagaacaacaagctacatgttctcaaagatactgacgacctctcgagtgtctacaccacatgcagtaaaacccttatccagtgtttgtcgcttgttgcctctcacactgctcgtgttccaaacctgttgatctaccaaacacctgatctcagtccttttcttgttcatatctattattttctgccgcaatgccggtattgccttcacaaggtcttcaaatccctgcattaacttgtcttcaaacaacttttgtatctcagagattgaagaatcaagttttcttttgtgcatactttgcctttccaatgacgacatctctctttcaagattttcagactccttgttagcactttcgagctttctccttaaggagtcaagttccaaatccaaatctgaatctgaagtcccatttttgtgtgattcttttgcacaagaactatcattttcatcggccacaaaaccttcaggtacatcgaagcaatgtcgaaggcagaatttctcccagttggccattctcttgtccagtcgatcctttacgacatggtgaacagcatttaatccccgctggagatccatggccttctctgcagccttggcggcgccgacgacccctggtgcggccgctgcctggagacagtactcgaaggcctcggcgctgatgtcggcgatgatgccgtggacctcgttgacgaaaagctgcgggctcagccccagcgccgccgccgcgctctcgtcgccgtcttccatcaccccgcttcttcttccgagtcttgtgcggttggattgtggatttgtgggggggcctggcaggcagatctgagtgcggagtgccgggttgagggttttcaaaatttgcgctcgggagaaactagctctgttcggactttggaatcgtcgctatccttccaatttctcattaaacaaaaagaaactaagacaacttgattctgacattacatcatcatccatatgttgtaaagatgttcattat

SEQ ID NO: 23742 - DNA, 1168 bp, Zea mays
acgacttttattctttttatttttaggtcggtaagatgctggcgcccatggcgatctggttgttgatctggatgaaccctgagcacagcatgttgtagcaccctgtcgcctggtacgcatcactagtccagtacgtgaagagcctcgtgttgttatccccgtagaggtcggggctaacctgccatgcagcctcgatgctgttcagatcctccccgaatgagccgcccaagatccagagctgggacaagctgaactcgttgggctgttcgatcttgggcgcccacacattgatagtcgccttggcgccgtagtacttgtcgccctggacgtacgctatggcatgctgatggccaccctcgttgagcatggtgggactgacggacatcgggttcgcggcggcgcgccgcttcctgccgtaccgacgcatcgagcttgccctcagcaggtcgtccttcctcgttctcctgatggggaccgtaccttcggggcacctcccgttctgatgccagagctgagccataggcctctcgccactgctgctggaggccttggattcctcgtacagcccttcggggtggtagttcggcctcatctggatcgtgtggttcttgaggtatgggtgatcaaacgctggctggtgtgagatgtgcacgcagtctatcatgtccccgtctggactctcgatactcttcacggccggcttgttgagccgcttgaggtggcggtgcagcctcgccgccggcgacctcacggcggcggtagcggcggcggcgcacgacaagcagatgaccgtcacgagcaggcacacgacccaccgcgcggcgtccatgggcggcggcgcgcctccctcagccttggcacctccactccaccactgccgcgcgtcttttcccctccccggttccctcttccggcgagcttacagcgaggcaaagcaggcctcgacttgcctcacccggaaagagggccctccgtccgccggcggcggctgcgctgccagaaccaggggccgattcgagatttttgaaacaatgcgggtgcctgactgcctgcgtggtgggatttggggaaacgggagtaatggctcgtcgccttgggcggctcgtcgtctcggttgggagcggcgcgtgcgtccactagccgcttgctgcgccccgcccggagggta

SEQ ID NO: 23743 - DNA, 1017 bp, Zea mays
tcgcgatctaaaaaagaagaaggagaagaagaagcacggcgagggccacgaccacgaccacgacggcggccacagtagcagcagcagcgacagcgactgagatctggtgtcgcagcacaggtgcaacacaagtatgcttgctggatggaggattcataccagctgatgctgatgtagtgtttcactggtgtcatgcatgcatgtatcgtgctattataatcaaaaaaaaaaaaaaagggcggccgcccttttttttttttttttttgtaggacgaacaagtgaatctaccatataggaaaaggaggcaggccaccacaacaagggtagggtagggcaccaccaccaccacatgccatgcttctcttcagaagccatcccggcacggcggcactaatgactaatcggaagaagaagaagaaactaccacaaacaaaggtgaagccagcagcacgcacatcactacctagctagagagcccaccagttactggcagctggagctcctcccgggcccgccgtagtagaagtaggtgccccagtcggcgttgctgccgctctgcacgtcgtagcagctggactgctccgtgaaggtgcccaggccgcccctgggcgccccgaggttgttgctgctgtccaccacctgcacccccttgaagtagctcgccctgccgaacccttcctcggggaagtgcccgctgcccatctgcgtcgacgtgtgcacgccgtccgcctgcgagttcaccacctccccgccccactccaccatcgacgcgctgtccgccaggtacgagaagaggaacgacggccagtaccccagcacgtagtccttgccgaactgcatccaccagttgccctccttggggtccttccagatcaagtatgctgccatcacactgggagccggagtagctcgaggtcgggaagattgtggcgcccatggcgatctggttgttgatctggatgaaccctgagcacagcatgttgtagcaccctgtcgcctggtacgcatcactctac

SEQ ID NO: 23744 - DNA, 639 bp, Zea mays
tttttttaggacgaacaaatgagaatctaccatataggaaaaggaggcaggccgatacaccacaagggaagggtaggggtagggcaccaccacaccacaccaccacatgccatgcttctcttcagaagccatcccggcacggcggcactactgactaatgagaagaagaagaagaagaagaaactaccacaaaggggaagccagcagcacgcacatcactacctagctagagagcccaccagttactggcagctggagctcctcccgggcccgccgtagtagaagtaggggccccagtcggcgttgctgccgctctgcacgtcgtagcagctggactgctccgtgaaggggcccaggccgcccctgggcgccccgaggttgttgctgctgtccaccacctgcacccccttgaagtagctcgccctgccgaacccttcctcggggaagtgcccgctgcccatctgcgtcgacgtgtgcacgccgtccgcctgcgagttcaccacctccccgccccactccaccatcgacgcgctgtccgccaggtacgagaagaggaacgacggccagtaacccagcacgtagtccttgccgaactgcatccaccagttgccctccttggggtcctgcggggtcgtgccg

SEQ ID NO: 23745 - DNA, 721 bp, Zea mays
taggggccttttttttttttttttttcaacacaacaaagatgatgatatattaagcatttaagcccagttctaatacacagagatgcggaagcacaggtcactcgtttttttttttttggcaacagatatatgtcgcttcaagcctaatgaggaattaaataaatctttggtatgacaacagatgtcgtcactaatatgcggaattttgatgttagacgcactaatctaaaggactttcaaggtctggtctctggtccatcgtctttgacattgcaccattagggaaagcgtctggataggtagctgctagcctagctttcatctctcttagctttgtgaaaatatggtcgagatcagccttcatagacttgagaaggcgagttttactagcaaaatcaccagacacttctacaaagcatcgttcggaatactcattaaaatgtgtgagaactgcattgctatcttgcaatcgccccattatgaggtgctgcgtctgcctgatggaggcgacatcatcggggtcgacgagcgacctgaaccgctccgccacctcctccgcggctgccgagggggcgggcttcggtagcggctcctccatgtctccaccgtccctgttgctcccaccgctgctgtggattactccggaggagggtcgaagcgctgcaacctgtgagcgattgggcctttccgggtggggattggggagcccgagcatcagtt

SEQ ID NO: 23746 - DNA, 2037 bp, Zea mays
cgtcagaatgcactggcattgcagaaccatgatgagtactgagtacaaggttatttcaaactccttttacaaaagttatcaacgagcaagtatacacaacacgtttcatgatcccttccctttgtatgtatttgtcaaaacttgcctactactgcataagtctataacatccttgttattatgctttggcaaaaaaaaggggtattacctcaacttaccatatgtattttctatacttatacaggtaataatctacatagactgtgttgtagaaagaattagtttgatcaggtctcaaagaatcaatagaatcgttggttgttgaagactcccttgaaagtacgatctatatgtcaccctgatgtggaagctggtttgccaggacgccagaaactctttgtagccacaagaaattgctgtttcacgacgacaatttcatagtgcagagacttcaggattgggcgtatcttctttatcatctctaacgtgtctttcaacacaaaccatcttccaggtctcagtattctgtcgatttcaaccaccacgtcgatgaggtcacacctgtttgtaagatttccaatgagattactcatgtggagaagatcataggtacgagggtaggtgctgaaagattcgcaccagtcatgatatgccccaatcaaacctctgttgaaaataagtggcaaggtatctggttgaccaattggcacagcattcataacccataaaggttgatcaatgagtgctgcggcaaaccctccaaacccagcattcatgtccattacattgcgaatgcttgaccaattaagtgggaagtcattgaaatatacttctgaaatgagctgtttccaatactttgtatcagcttcaaacttctctttgttagaagcagaatcatcaggtacacttgcatagctaacatcaagtctttcaggccatggaacaggccaattatatctttcatctgaagtggtaatggcagttgtgaaaaggcaactatcaagaggagcataccaaggaaagcgtgatccatctctctcggagcatagagggggctcattggtctttctttcagcatagcaagaattcgatgctggcttttgatatataacaactcaaattccattgacatcttgagactttaccactgttctccagcagattgatttagtcagagtaaccattgcattccagtcatcttggtctctttgctcttgacggtagacaggggttgcagaccaaatgaaatatcctccaggcctcagtactctattaagctccaacaatggttttccaccatttgcataccaatggaccctgcaccttgcacagtgtacaacatcgaacacattatcaggaaacggaagcttttgtgttccaattactgctagaaatgctggaattccacgctctagggcaaactgtatctgagcctcatgctcgtcttttggggcaaatgacatagtaatggcattcctgtcaagcaggtatccaccaaagctggcaacaccacatccaacatccaagacagttcttgtgcgccctcccccttctatcgctggctttacctgttcaacaaactgaatgtatcttcccacgccatctttgaattgagttccacctccaggaaaaacaagataatcaccagatcttgtaacccagttctgatctttcttatactccaccagctttgggtgagggacgttgttgtaccaaatctggatgtgcagtgaaatgaaacaaaatcagatagtctgccacctaatggcataacaaaaaaaaactgtctggcaaaggtaattataaagagtaattcattaactgatacatcagacacttgaaacaagtagccccataagttatttgttaaaaaagtccacgtgcagaatattttaatatgagaataaaaaaaaattggatcccgatccatggcttgtacttcctccattccaaattataagtttttttttgtagagctaaagcatattactttaaccaaaattatagaaaatagaaatcttgcttaacaaaagtcaa

SEQ ID NO: 23747 - DNA, 4536 bp, Zea mays
ttccgggtgaaaatgaactgattcctgtgaaatgccctctgagattccgggttattacaccggcccagattacatttcttgtgtttaactgtcactttcactcgttttttaatcgagctatagtggtgctatactatctatcgattctaataattagtcgacactttacctaccaacaatctagacagttttattcagtgtcacagattgcatgtccccctaaagtcacaatcagcgatgagtttataaaagtttcttgactttgatccggggtccgggccgttgtaggcttgtagctaggcagcgctgggcgcaagaggagcagaaaacaggatagacctgttgtcgacctgcactgcactgcactgcacccgtttctttctgtcagcagatcgcgtgctccgattcacacttgcccgagagtgcagacacagcagcgcaatagggttcgtgagaccgatccatatggagcagcgatcgagctagcgctgcatcatgcacacacgcagcacagcacagcagttgacggcggtgatcagctctagtgcgcagacagggatggcaacgggcgggccctgctgcagccagtacaacctggcgcagtgaactggatgggtttgctccgtggcatgaattagactgtcttcagcaacgtttaaagaatattctctgttctttacagtactctttaaaagatcttatcctctataaccaaactctcccacaacatactctaaatttgatcctctatattatattctatattttttttcaaccgttgcacaacaaccatactgtttattcatttttcgttcttaagtggtattacgtcgactagctagcttgcgtccttgcagccacctctgtctacattcacaagcggcgagacgaagtccacaacaagtatgcgcccgcagcaacgaagcttcgttggagccgctgcactgcagtagatgcgcaccgctgatgctaccaccggcacgcgatcgcgcaaccactcacttgttgcagtagggcgggcgaaccatgaacggcgaagaggagcggcgttgtcgaccttgcttcctctagtgaagcacagaccatgtctctatgtaccttaccattctcctatgccggagccttgacgacgaggctcttgagcggggcagatctgaagtggaggccggatcttgggcggcgtgtgcgggtgctgtggcggacggccgtgccgtctcgtcggcaggagccgcgtcgactctaggccagcagctttgggcacgccggcgcggatgccccaaggcctacaggttcgagcacgtccgagcgcgcgtgggaaggaacggtcgaaggcggcgtataggacgcacaggatgactctacatgtagcggacgactgtagcattcgctaagataacgaatctgataccgaactttgttggacgcatagagaagacaagaaatcgctatatttagcggacagaaccgtttacccgctcttgctgggacaaccttatgatgattgatgagcccaaactttgccttgtgatctcgcgtggtcgccatcaaatggggccacaaaaagaaaggagagggatccgcggacgatgagcagcctccgctccgctctgctgctgccaacaaaataggtctagttattattatctttgtgctagctagctagcgagaaggacgtacgcacatctgaatggcggcaccagcacgtacacacacgcttgcattaattatgatatactccaatatatatagagagatacacacatctagctctagctaggcactactgaaaaggaaaagataactgtcacgctcatctcatcttgtgcactacactaacaaggcacatatcacatgcatgcaagctggtaaagttacattacattacacacgtaggcatcaaaccggcgctgcaggaggtactgctatgtactactgccttccactagctgctagcaatagcatcatcatatatacacagtccactctaaagcatatggcactcgggcatgctctttttcttcttttacacatctcattctcatcatccatcgccgccgggccacgttacgttctctgctacaaggtaaggaaagctaagataagatatatagtacagtacaatctagacagacgatcgggcaacttctcctatccccaggccacgtgtctcatcctcgtcatctcacaccgcgtgacgtggaaccaccctcgcctccagcggtgcagccatctcacacgacagcctcagcacctcggacaggtcgacgccgcggcacggcggcaaccatttgaactcgtggagcagggtggccacccagaacccgacggtagccagcgcgagcgacttgccggggcagctccgcctgccggacccgaagggcgcgagccggagatccgagcccattatcatcggaacgtcctcggcaccagcaccagcaccagcaccagcagaggcgcccacgaacctctcgggcctgaactccgtcggctcggcccacacgctggggtcatgcgttatggcccacatgttcaccatggcggtggtgcccgcgggcacgtggtacccgcctacgcgcgcgtccgacgtggccaggcgcgcccaggagagcagcgggcctggcgggtgcaggcgcagcacttccttgatgaccgcctggaggtagacgagcgaggcggtgtccgactccgtcacggatgcggccgctggcccggtggccccaccacccggtccagctcctcctggaccttgctctgcacgtcctggtgcagcacgagacgcgccagcacccactccattaggacggccaccgtgtccgtgcctcggaagatcatctcctgcgagcgagtgagcagcacaaatatattagctagagggtggaagcgatgcaacatttatgcgacgacgtacggcgtacccagagaacggcgaccatgtcggcgtcggagagcttgtcgacgccctggagggagagcaggacgtcggtgaagtccgtgacgccgccggtgtcgccgaggccgaggcgcgcacggtgctcgtcgatgatgttgccaacgaagcggttcacccgcgggacgagcgcggagcacctggcccgggtcctctgcaggtcgaagcgggccagccacgggaggtggtcggaccagttcagctgcccgaggaggtcgtagccttcgtccaccagcgccttcagctcctcgccgtccgccgccagcagcagcaggtcgtacctgcgcccgaacaccgaccacatgacgttgtgcagcgacgcgcgcttcaggaaccggcgcgccaccacgacggcgggggcgggggcgggggcggccgtggtcacggcgtccaccatctggcgcgcgatgaccgcgcgctgcgcggaggaggccgcgacctggcgcggcgagaagaggtgcgccgacgccacgcggcggagcgcgcgccagtaggcgccgtgcggggcgaagccgatggcgcggtggaagaggagcccgtacgcggactccttgacggggcggtcggcgaaggcggcgctgccgagcagctccctcgcgacgtccgggtcgccggtcaccaccgcccgggtctcgccgagggagagcgccatgagacggcggcgcctgctgctgccctgacccccggccgccgccgccgccgccgcgagcttgcggtgcgccaggccggtcatcagccccatgctgccgaccactggcaggccccggggtcccgggatggcggcgcggacgatgcccagcccgcctcgcctggtccaccagtaccgcccccaggcggggccgcccgggcacgcccagtgcaggagcgacgttacgacgcaggcgccgacgaagaccgccgccaagccgagcaggcggctagggtcgccgcatttggcggccagggagaggtacagcagccagccgcagtcctcggtcggcggtgccgccatggctgactaacctcagctctttgtggattggatgcaccactgcgctcacgactcaagtttccttctgctgtggaagaaagtaggacgaccagagaccagagagggttgcgtggttcaagtcttggaggactggaaatggcggccccgtgtatttatagctgcggcgaggagccggtgcggagggttgccttttggcgcaataatggcgggagcaagctcctctatatattactagtctgttaacaacggtggcaccggactgacgacggtgcgagaccacagcgacagagatggccatgatatttctaccgggcccgaatggtgcttggttagctgcggtggccatcaggcaacgacgtcaaggccagccaaggggtgcacggcatgtgggtgggacgacatgggggcgcgtggagcctgcgagctctgccgggacccaaaggaggtgtcgcccgcacgtggccggcgtgccacgccgaggttcatcgcttggtggacgacggacgggacacctgatcctgctgcatgctagttttttatgtcacagcgcatagattctatgtcattgttaaatgtgactataggttatctgttagaa

SEQ ID NO: 23748 - DNA, 1151 bp, Zea mays
  misc_feature (763)..(763): n is a, c, g, or t
gccgggaccccaacaaataaaagcactgctgcttgccagtattgctgctttgccttgcttgcccccacacgccctctctctcctctctctctctcaaaccgaaaagaaaagaggaaagtgggatagctcaatctcttcttccttcgtcattcctctcccgtaggttctctctccctccctccctccctccctcagcacacataaactcgagatacacatatatatcagtaggagaggatggatgtgcaaacctagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggggtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgggcagcacctgctgcaggagcaaacncttaacaacaatgctcgtcgtaaggctcccttccccgtataacagattcatcaaggaagagatacgcaggatcaaagcgaacaaccccgacattaaccccagggaagccttcagcacggcagccaagaattgggcacattatccaaacatccatttcggtttagacgactccgggcgagagggcaagaagaagctcgtggatcatgaggcggcggcgtctgtcgtcgcagtcgcagcagcaccgacagctgctaaaaagatccagggtttctactaatggtagcagatagatgggtagattgattgatacatcatcggccgggtggaagaattgataccccaaaaactgctatatatatatgtactgtgagtaaacagttaaaattaa

SEQ ID NO: 23749 - DNA, 1948 bp, Zea mays
tgggtacctcgaggccggccgggacaacaaataaacgcactgctgcttgccagtattgctttgctttgctttgccttgcttgcccccacacgccctctctctcctctctctctcaaaccgaaaagaaaagaggaaagtgggatagctcaatctcttcttcgtcattcctctcctgtaggttctctctctctccctccctccctcccgcagcacacataaactcgagatacatatatatcagtaggatggatgtgcaaacctagcctgctgcctttgtagctgcaaattaaactgagctgtacctgttggccttcctcctcgctcctcttggttctcgctggttgccgggagctggggtcgagagtacttctgttgttcgcacggcgaggcggcggcggagaccggtcagaaggaatgtcttcgtcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgggcagcacctgctgcaggagaaaacacttaacaacaatgctcgtcgtaaggctcccttccacgtacacgccgacgaccatgcatatgcatgcctcaatttgcataatcttctttttttagcttaattagcatatccacatgcatgcaatcatacgccaaataatgataattaactgtactacgtcgggcgaccttgcttcgaactaaatgcgccgcagctccggagaagaggcagcgggttccgtcggcgtataacagattcatcaagtgagtgtttctgtttcaccgcccttgatttccttactactacgtatatatagtatgtatatatgtccatgctcatggatgcaatcgatcgacagggaagagatacgcaggatcaaagcgaacaaccccgacattaaccacagggaagccttcagcacggcagccaagaatgtacgtaaagccttgttctagctagctaattgctacagtacctacttgtcgtcgtcgtggtcgtcgtcgtcgtggtgggcgcctgaactggttgttttacatatatatacactacgtacgaccgttgttgcatgcagtgggcacattatccaaacatccatttcggtttagacgactccgggcgagagggcaagaagaagctcgtggatcatgaggcggcggcgtctgtcgtcgcagtcgcagcagcaccgacagctgctaaaaagatccagggtttctactgatggtagcagatagatgtgtagattgattgatacatcatcggccgggtggaagaattgataccacaaaaactgctatatatatatgtactgtgagtaaacagttaaaattaaacttgtgagatataccgtacatatgaagagctagctagtagtgagtgataaagtgggaaagtgaagcatatatagtcgtaaaaacaatcacatgaattgctattaggcaccatatatatgcacttaattatattggttgaggagacctaataaatcatttgacctaccatgcatattattgcagtgcgaagcaccatatatatatatgcagtggcagcatgcagaaaccaaaaaagtgtataggtacagtaagtaccagcagctaggctcagggctgaccggccaggcacaaggcgacatggcattattattaacgtatgtacgccgggcgtctctgggcccctgcaggcatgcgcgcttgctttcaccc

SEQ ID NO: 23750 - DNA, 667 bp, Zea mays
cccgggcttttttttttttttgcaatttcttggttgaaatgagatagcggctcctgagaagaggcagcgggttccgtcggcgtataacagattcatcaagtgagctcgctcgatgatcgacgacctcctcagatcagcagcttacgtttggttcattctaccaaataattaaacgctgtgtacgtgtgtgcagggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagagatcagcgctcgtcgtcatcaactggccggccgggtgtggaagaattaataataccacacaaattataaatgtactgtgatgagtaaattaaagagttaaagtggggaatgaagggagagagagatatatagcaatacgtatattaccttaccttattaatgagtgcaaaaaaaaaacacttgtgaaggtttctactgatgcatgagtgggaagtgaagcatcatacaatcacatgaattatattgctactg

SEQ ID NO: 23751 - DNA, 971 bp, Zea mays
gggtacctcgaggccggccggggcgttatctgcgggtggaaggggagctttgccttgcttgcccccacacgccctctctctcctctctctctcaaaccgaaaagaaaagaggaaagtgggatagctcaatctcttcttcgtcattcctctcctgtaggttctctctctctccctccctccctcccgcagcacacataaactcgagatacatatatatcagtaggatggatgtgcaaacctagcctgctgcctttgtagctgcaaattaaactgagctgtacctgttggccttcctcctcgctcctcttggttctcgctggttgccgggagctggggtcgagagtacttctgttgttcgcacggcgaggcggcggcggagaccggtcagaaggaatgtcttcgtcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgggcagcacctgctgcaggagaaaacacttaacaacaatgctcgtcctccagagaagaggcagcgggttccgtcggcgtataacagattcatcaaggaagagatacgcaggatcaaagcgaacaaccccgacattaaccacagggaagccttcagcacggcagccaagaatttgggcacattatccaaacatccatttcggtttagacgactccgggcgagagggcaagaagaagctcgtggatcatg

SEQ ID NO: 23752 - DNA, 1435 bp, Zea mays
ccacgcgtccggcatttcccctctctccagcacattgctgcttccacagttccacacacataaggccaccacagcaaataaaggcactgctgcactctctctctctctctctctctctctctctctctacgcgaaaagaaaagaggaaagtgggatagctcaatctctccttccaccgtctctcagttctcactctagcgctctctctctccacatatatatcagtaggatggatgtgcaaacctagcttgttgctgcctttctagctgagaactgagctgtagctgttggtacggttttcctcctcgctcttcttctccttcttcttgctgctggttgccgggagctgagatcgatcgagagcactgctgttgttcgtgcggccggaggcggcggcgcgcggcagggggcggagacgacgaccgatcggtcagaaggaatgtcgtcggcccaaatcgcgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaagatcagctccagcaggagaacatcagggtccatggcacgttgcgtgagcatcatcagtgcggcggcggccaccatctggagctgggctcttcgtcgtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagggatcagcgctcgtcgtcatcaactggccggccgggtgtggaagaattaataataccacacaaattataaatgtactgtgatgagtaaattaaagagttatagtggggaatgaagggagagagagatatatagcaatacgtatattaccttaccttattaatgagtgcaaaaaaacacttgtgaaggtttctaccaaaaaaaaaaaaaaaactgatgcatgagtgggaagtgaagcatcatacaatcacatgaattatattactactggcatggtgggcgccatgcatggtttaaattaaccgagaagacgacttaataaatcattatttgacctaaaaaaaaaaaaaaaaaa

SEQ ID NO: 23753 - DNA, 1711 bp, Zea mays
cgcctctctctcctctctctctctcaaaccgaaaagaaaagaggaaagtgggatagctcaatctcttcttccttcgtcattcctctcccgtaggttctctctccctccctccctccctccctccctcagcacacataaactcgagaggcgcaccctccgcgctggccggggatggatgcgcaaacccagcctgctgcctttgtagctgcaaattaaattgagctgtacctgttggtcttcctcctcgctcttcttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcagctcggttcttcttcgtcgtcaaggttccggcggcttccagtgatgtgttcgccacagaacgagcagcacctgctgcaggagcaaacacttaacaacaatgctcgtcctccagagaagaggcagcgggttccgtcggcgtataacagattcatcaaggaagagatacgcaggatcaaagcgaacaaccccgacattaaccacagggaagccttcagcacggcagccaagaattgggcacattatccaaacatccatttcggtttagacgactccgggcgagagggcaagaagaagctcgtggatcatgaggcggcggcgtctgtcgtcgcagtcgcagcagcaccgactgctgctaaaaagatccagggtttctactgatggtagcagatagatgtgtagattgattgatacatcatcgaccgggtggaagaattgataccacaaaaactgctttatatatatgtactgtgagtaaacagttaaaattaaacttgtgagatgtaccgtacatatgaagagctagctagtagtgagtcataaagtgggaaagtgaagcatatatagtcgtaaaaacaatcacatgaattgctattaggcaccatatatatgcacttaattatattggttgaggagacctaataaatcatttgacctaccaaagaaaaaaaaaaaaaaaaaacccgcggccctcgagttttttttaaaaaaaaacaaaaaaaaaaaaaaaaaaacaaaggaaacctaaaaataaaaaataaaaaaaaaaaaaagaaagaaatagttctataaaaaaaggaacaaaacgaatgccaatgaaaaaaacttgccacaagaataaaggaaccggggcatcggatcatgcttaacatatgagaacgcgcaactggtactgttggttgagaatgcaaaacaaggggacattgacaccatagacatggtggcttttgcatggaacgttagtgaggcttttcaggaactaggagagccacgattgcactgctgatcaagcacattgttgatgaaaaatttgtgggatttaaccatgcaacgacaagttggtaaggttatacaatgttgcgcatggcacacttgaagagc

SEQ ID NO: 23754 - DNA, 999 bp, Zea mays
  misc_feature (914)..(914): n is a, c, g, or t
  misc_feature (950)..(950): n is a, c, g, or t
ggccgcttttttttttttttttttgtgaaagtaaaatcccgaatttcgataaagtagttcaacacaaatcattgggatagctattcaccaatcaccagtgcccctagactcaaagtagaacagacaatgatagtcagatatcgtactgaagctaattgaatggttccatgtaaacagttgaactagttgggatgccagatgcagtcatgccaccttaacatgctaaagacacgatcttcagttgtcacaataacatttatgtagataatataacaacacgatcttccaaaacgactttggtgccttgacatagaaatcacgctttactgtcatctcaagaaacaaatacatgatggtggatatatccatcatcaactaactgtatacatgtttgttacatacactatcaccacagttcaaaacttttcaatcacctatataaccaacccccatgaatgagaaacacaaatgaaagaacagccgatgccaccatctggcagcaaagctaatatttaacaacatttgctccttggagttcttgataaatcgaccaagaagcttgtagtaggtcactggctaaggtgacatcattcatgatacctgataatttttactaacaggaacaggactataacagtaaggggttgtttgtactaaggcattgtttggtgattactaacaaggatagggccacaacagtaaggggttttgtttggatgaaggcattgcttagtgatttgtcaaggatttggattatatttcccctttactcaataagggcctatgcatttagggattagtattggccatgacctgaggacctcttgttagaacttctgtctaaggtaccataacggttttgtgattggttttcgattaggatgttctaggtaatggtctcgtgcctccataangtcgctgctgccattgttgacccccatatggtacangctggtatcccccagaataaccaccagcatatgctggggggtatgcccc

SEQ ID NO: 23755 - DNA, 777 bp, Zea mays
gcacgaggagagagctaggctcagtttttttttttttttttttttttttttttttttttttccaaactctaattcagagacatccaaacaatagagtttgaattacatctaattttaataccatagctgatttagtattgaacccaattcaattcatacctttcaatatcgacatccaaatagagcattacagattttacgggattgacatcgtgagatcttattagcgccacatgggcaaatgaacatgcaggagtgaagagctaataacggccacttatttcttctctgggatcttcttcaataactcatccagaacctcgaacagatcagcaaccagtccgtaatctgcaacctgaaatatgggggcatcagcatctttattaacagccacaatgaccttcgagtctctcattcctgccaagtgttgtattgctccggatactccaaaagccatataaagatccggcgcaacgattttccccgtctgaccaacctgaaggtcatttggaacataacctgcatcaacagcagcccgagtcgcacccactgctgcgccaagtttctcagcaagctgctccaacaatttaaaattttcagcactttttaaacctctgcctccggtgactactacgggtgcatttgcaagatcaggccgctccgtgtcttgtgatgtcagattcacccatgtagatttcccttcactgaggaaagagagatcaacctgggtgataggtgcaacctttgtttcagacatagcctcagtagctggggaaa

SEQ ID NO: 23756 - DNA, 761 bp, Zea mays
ccaaactctaattcaaggtcatccttctttttgtgtttgttttacatctaattttaataccatagctgatttattattgaacccaattcaattcatacctttcaattcattacagattttacgggattgacatcgtgagatcttattagcgccacatgggcaaatgaacatgcaggagtgaagaactattaacggccacttatttcttctctgggatcttcttcaataactcatccagaacctcgaacagatcagcaaccagtccgtaatctgcaacctgaaatatgggggcatcagcatctttattaacagccacaatgaccttcgagtctctcattcctgccaagtgttgtattgctccggatactccaaaagccatataaagatccggcgcaacaattttccccgtctgaccaacctgaaggtcatttggaacataacctgcatcaacagcagcccgagtcgcacccactgctgcgccaagtttctcagcaagctgctccaacaatttaaaattttcagcactttttaaacctctgcctccggtgactactacgggtgcatttgcaagatcaggccgctccgtgtcttgtgatgtcagattcacccatgtagatttcccttcactgaggaaagagagatcaacctgggtgataggtgcaacctttgtttcagacatagcctcagtagctggggaaaatgaaattgatctaatactcactcgagccgaatccctctcccagtatatttcacagaacaaa

SEQ ID NO: 23757 - DNA, 835 bp, Zea mays
cgcacctgcacacaaacaccccccacggaccagcggagatgtatcagctctccctgttcgctttggcctccgcttgccccctccctctcgcgtctctatacatcgccgctgttgtgttgcagttcagtttgcatcctgagctctctcctggaccagccgagatttctcgctctgcgcatctctgattcatcttcgtcgagaggagctgttcctcttctttgccgcctcgaatctgggactggtcggttttctggatccctgctgcctgtcgggttctcgagaggtgtaaaatccaatggagggtgtgtcatcgttgaaccagccgttgatcaacgacgaccggcagcccgtgcccagcagtatcgccaagggtgatcaaatccaaggcctgttgtcgggtgaatggacaaatgagcggcacagctcgtacataagctccatggaggcatctttcgtggagcaactccgtagtggttccaaggccatccaggagggcttgtgccagagcatgaggattccgagggatgatgctcgcagccatgacgtccctgagagtccgtgggtggtggtgaggcgtttcaggccacgcggtgtccaccatggcgatggaatggaagtggaacctttggtcgatggttatggatcaggtactgacacggcccgagagaaggtccggacccacgcaagagtagcgaaggcttctgctattattgaagtcacggaccagaattttcctgaggaggggattcaatccagtaacggtgcatgcaagagacagaaatctactcctggcaatgcatcaaatggccagggtacctcggccgcgaccacgcta

SEQ ID NO: 23758 - DNA, 2802 bp, Zea mays
  misc_feature (25)..(25): n is a, c, g, or t
  misc_feature (1410)..(1410): n is a, c, g, or t
  misc_feature (1445)..(1445): n is a, c, g, or t
  misc_feature (2390)..(2390): n is a, c, g, or t
tgttttggtcccttataggaatctnacataggaatcttacgggtgaccaacattagcgtccacctcaagtgaattcacaacaaaatgttattggtcatgtctcaagaaaagcacagctactgactctgttcttgtccctatatatcagaatcaaattgaagaaacacatcttctcacaagacatggtctaaaaaagacaagaggaagactttgaaccctccataatatacctctaccaagaaatgcacatgttggggatccattgagggtttaggtttctaaactagagaaacgactagttgtcgaagtgcatctgtatgttattccacaaagtgggtcggcggtagcttacgtaatcacacatggttgctcacgcaaaccatcagccctgtatcaaataaaatatattaacataaacctcacgggttattatcttggcataagctgcccaattcacctttagaaacgttacaaaggcttcctctgcccctattccttctccggcaacatacaggctaccataactctccatggcatggagaaaccacaaagaggttataataaatactaggtgtgatcttcccgcccacattagcatcaccatcattcgtcatatgtaagcttaatcgaaaagatacagtaaacatggcaaggtggtattggccttgcgccaaggagtagctctgacctcctgtttgttcagtcttccatccatggccgtcctccagtgaggagggcggtgctacaggcctacagcggcctaggtctttttgaattgcagcagctcgggcacttgtactgctttatgctctccgccttcgcgggggtgatcttcacgcacttgccatggtaccacttctcgcacacatcacacccgatccagaactcgtctgcgctgtatattccaccacatgtcccgcacaaggtttcgctgtggtagccgtcgtcttcatcgtagccctcgtcaggctccctggcattattttctaaccgtggctcgcttgtttgctggagagacaaatcaagttcagtatcgtaacatgagaacataagaggtggtaaaatcagtgatggattcttgttacctttgctgacagtttatttctaccactgttgtcagtaccggatctgtccctttccttagattgcttcacaccaccggagacgacttcaaaaacagttggcaggtcattcatcatgccaaacaaacgcttcctgctcaatttgagagcaaaagcgttacaaaaaatgattactgcaatacccaactactctaaacgcagttaaattatatactccctccgtcccaaaatatagttctttctagcccactttttttcgtccatattcattcaaatcataatgaatatatacatacatggaaactacattcatatgttagtaaaaganacaaatcaaaagtattattgtgccatggactactngatactactactacaccccaaaacagttctagagtggaatatgaaatgtttcacttccattgtaattcaagtcaaggctgcttaataccttttgactttgttgattgactagtcaaaggtaactgtacgaacattttatgaagaaaacagagtcaaacttataagttgcgagtgtcgacattaatgtttggttttagtggtttgctgcttacaatcgcaagcgaattcacttggtgactaagatcccaatgctcatcatggtataaaatatgaattcaatcgtaattttttgactgagaaactcaatcgtaagttcacttgtactcatcacttacagctctcaaaaacccttggcctacaacaaagtttattcaaatgaagcattcgaaaagaacaaatgaagtgctggaaatatccaaaagctactccacatatttttaaaatcacaaagtttagttaaacataaacttaatttgacatcattgcacaggaattgagcagttggatctacatgctatttatgaaagtactggagtgcacagcattgtcccaaagtcctcaaaagatataaaggagtatggtcactcaaactagcttgcatatgtgaagatggaacacttaactctcattaaatactcatggagaatgttccttcaacccaatatacaaaatattaacagtttgacaacaagcccaaaagttaaataatgtgaatgtatttctagtacaaaatataaatggcactagtaagccaagaactttaaggatgatctgcttggtccaaataaactccatacagttaccaactcttagttcatatatgataccaccaccgattcatatttcaatcagaacttagctaattcataagccaataaatttgaaactacataacaaaatgaaacttactatacaacctacataaggatgtataatccgacatcnagtccaaacaattttcattcagtatccatgtcttttacacaaaatggagtatgcattcaggtagtatagaaagatgggtgattacatgtgcaatcatttgactgcaagaagcaatacaatatgtatagttgtgactcttctttactaatcagtagatattatgcatcatagcaatgaataatcaagaggtttgctccagttctactctatgagaaagatttatgctgatcttaaaacagaagtggttattgactatggcaaaatgcgtatattatttttttggttttatacaattattccctaaaaattactcctctccctatactcatcatgattctttttcactgttagagactaagaaacgatctcaacaatcagcaattaacttagtcttgcacaggagatactgcag

SEQ ID NO: 23759 - DNA, 1294 bp, Zea mays
ttttttttttttttttgtatcaaataaaatatattaacataaacctcacgggttattatcttggcataagctgcccaattcacctttagaaacgttacaaaggcttcctctgccctattccttctccggcaacatacaggctaccataactctccatggcatggagaaaccacaaagaggttataataaatactaggtgtgatcttcccgcccacattagcatcaccatcattcgtcatatgtaagcttaatcgaaaagatacagtaaacatggcaaggtggtattggccttgcgccaaggagtagctctgacctcctgtttgttcagtcttccatccatggccgtcctccagtgaggagggcggtgctacaggcctacagcggcctaggtctttttgaattgcagcagctcgggcacttatactgctttatgctctccgccttcgcgggggtgatcttcacgcacttgccatggtaccacttctcgcacacatcacacccgatccagaactcgtctgcgctgtatattccaccacatgtcccgcacaaggtttcgctgtggtagccgtcgtcttcatcgtagccctcgtcaggctccctggcattattttctaaccgtggctcgcttgtttgctttgctgacagtttatttctaccactgttgtcagtaccggatctgtccctttccttagattgcttcacaccaccggagacgacttcaaaaacagttggcaggtcattcatcatgccaaacaaacgcttccgatcacttcggttgagccgcgcggcgtagtagaatgcgacggatatgagccacgagtcggagtggacggcgacgagcgcgagccagtcgcgacggttcatcccgtcgcgcgcgaagttgatcccgagcgcaggctccggcagctccgtgggcacctcctccgccggcagcgccacctcccacgcttcgtttgcgtacccgtataggcacaggttctccttctctggatcgcacagcgcgtagaactcctcgacgtcgtgggtgagggcgcggaggacggcggagcggcgggcgcggtagtccttgtagatgtcctcgacggagcggggagcagaaccgcttccggcaccggcgcggcggtaggaggcatccatcgcccggcggtggcgcgtctgatctccggcgagaacgagacgcaggagatgactgatcgcgatgcggtcgggagccgagcgacgagatgatagtacactaggacgagtgctgccgggcaaaagggaagatgtgcaagatcttgcgggctattttttc

SEQ ID NO: 23760 - DNA, 707 bp, Zea mays
  misc_feature (7)..(21): n is a, c, g, or t
gaacccnnnnnnnnnnnnnnntagagtactctcgagtttttttttttttttttttttttgaccatagacctcaaacgcagaaatgtaaattttgggtccaaatacgtagacctcaacagcatacatagcagagaccagagaactgccagtcactactctaattagcagcaaaaaattgctactggtgcatttaacatgaggaactaaaatatactacctcattcctcatacaaaatatctcgatataaccagctactaatgacaaggttgaactacatctgcatatcacaatactataaagtacagcactgatatttgtgggacgacttgtaccagtttaaaaggattctctcttcttcttgttcttcgattgcttggccaggagaacagaaagcccagtcaatgcaaacttcttcctcttccccgaaattcttctgcgagcagccacatcctctctgcacagaacaccactcctgtttatgatctgaccgagcgagatctccggtatctcgcctgttttgtcatcccaaacactcttgtcgtacccatcaggtcccattagcttcatgctcagtatctgtccgatcgacaatgttggtttgggtgggctgtctgaagcatcagagatcatatccgtggcgtgcgaatcttcgcgacggtgagctgccgcccttttgaatcttggggagccaccaagagaccgcctc

SEQ ID NO: 23761 - DNA, 1079 bp, Zea mays
ctcggtacccctgtttgttttttctatggctgcatccatgtacttcacacagtcacaaaggaggaactaaaatatactacctcattcctcatacaaaatatctcgatataaccagctactaatgacaaggttgaactacatctgcatatcacaatactataaagtacagcactgatatttgtgggacgacttgtaccagcttaaaaggattctctcttcttcttgttcttcgattgcttggccaggagaacagaaagcccagtcaatgcaaacttcttcctcttccccgaaattcttctgcgagcagccacatcctctctgcacagaacaccactcctgtttataatctgaccgagcgagatctccggtatctcgcctgttttgtcatcccaaacactcttgtcgtacccatcaggtcccattagcttcatgctcagtatctgcccgatcgacaatgttggtttgggtggtctgtctgaagcatcagagatcatatccgtggcgtgcgaatcttcgcgacggtgagctgccgcccttttgaatcttggggagccaccaagagaccgcctcttgtgcccgctctcagatttccatctacgaagaatctcttccaccgcaaacttcccatggtttgcagcctctaccctcctcagggcctcttgcagcgccttcttgcactcctcgacctccactctggcatcctcgagcctcttgacagactcggactctgaatcgtcagctgcgtctacctgcagcattgcgttctccactttcctcctggagctttcgtcagcttccagagctcgggagcacagcttgaaatactcctccatcgagagagttacccctcctccatcggaagcggtgtctccttcgaaagaacttccgctgctcactagcgctttgatctcggccagcgcgagggcctctgctgctctagcggcgtcttccatcttcctggctgcaatgcacctgacctcagccgtgcaaatgctggcctttacctgctcgatttctgcagccaacaccattgcctcagatttcgaatcgtctgccatgctcctgagctgctgcacctc

SEQ ID NO: 23762 - DNA, 694 bp, Zea mays
agaccatagacctttttttttttttttttaattttgggtccaattacgtagacctcaacagcatacatagcagagaactgccagtcgctactctaattagcagcaaataatcgctaccggtacatttaacatgaggaactaaaatatactacctcattcctcatacaaaatatctcgatataaccagctactaatgacaaggttgaactacaactgcatatcacaagactataaagtacagcactgatatttgtgggacgacttgtaccagcttaaaaggattctctcttcttcttgttcttcgattgcttggccaggagaacagaaagcccagtcaatgcaaacttcttcctcttccccgaaattcttctgcgagcagccacatcctctctgcacagaacaccactcctgtttataatctgaccgagcgagatctccggtatctcgcctgttttgtcatcccaaacactcttgtcgtacccatcaggtcccattagcttcatgctcagtatctgcccgatcgacaatgttggtttgggtggtctgtctgaagcatcagagatcatatccgtggcgtgcgaatcttcgcgacggtgagctgccgcccttttgaatcttggggagccaccaagagaccgcctcttgtgcccgctctcagatttccatctacgaagaatctcttccaccgcaagct

SEQ ID NO: 23763 - DNA, 2226 bp, Zea mays
  misc_feature (4)..(16): n is a, c, g, or t
tggnnnnnnnnnnnnnggccgcttttttttttttttttttctgacttgatacagatttataactaaattaaaacatgatgtagaacatatccaagccatactccagtaacacaacaaaattcagatcagcaaaaaaaaggctcaacctacattctatacacagccaaaatgtggcactacggtatcagctaactattctgccctaaaatttcatttttcatgcctacactagtgcttttgttcagacatccttaaatcaagaagtaaataatggatcaaaagaatacatgaatcacggctttcgaagggctgatgctgcccccattatcacagccattacaattcccaggcccgcgcccagagatgcacctacagcagcagctgtaacagagccatctcttttccggggcttctgcttcacttgcagggacgctgctttctctgacgctagctccttcaacaatctctcacgagcaagttcctcaaatgctgtttcttcattgttgaggactacttgatgtacaagttgacgaagggaactaacaccctccacatgcataacaatgtccttcctctgaaatgatgacaatccaaagtttacaggaagataaccagatctatttgctggatccttcttcaacttcccagtagctgatctgatctgctgcaaactgtttctagcacttggcatcagaaatggggaagagttaacaacttttgtcatctcaggagaaacttgatatgcttccatagctgagctgatcaatctgttctgctcatgcgcactaacagagaatttgttggttattgcaagaatccaaggaatgcttagcgccttagcttcatccaagagaagtgaaagagcaggctgaggctgagaagtattggaccgtggatactgtggaattcggtgtgctaggttatgcaccgcaataacaaggtcagtcttcctgctgatatcatggagtcctaacaacagttcttctttgaaccgcccaacctccaaaggtagctcctgcaagtttaccgttgtcgaatctatgtagcacaatccatttgatattcccttgccatgcaaatcgacatgtatgcattcaagaacagtgctatttctttctttaacttgtcctaacattgctttaagcagggatgttttgcctgccccctctaatccaagcaatcgcactctccgagtcctaacgtggacctctttacgtacagttacaaaatcacttgtcccatatattagaaatccactcaaacccttgcagcaatctttatcttcaaaaaatgactcaaatccaaagtcgggtgttgaatcagcacctgccatcacaggaatcatgaaatccccactaatgtaatttggaggctgctttagtggttgtccaacaagaatccgcattttctgtaatgtgggttgcagttctccatttggtgagtatgaagtagctgatggtagagtctctattactgtggaataccagtttccatttatttgtgcctggaaaagagtgcacatttgtaggtcatgcccaattatatcaactttcagtggctcagcatttttaccaccagggagtccagtccatccaagcgcgggcctcgtaggggcaccccgggtaacaggagggtccacgatatctccaagttcaacagaatcagtagctgttagaccaattaattcttgtagatgtgaaaattgtggcaattgctcaatgccagtaaaaatgggagcatttgcacacatgcatgaatcatatattttttgaaatctagccctataggacttcattgagtgcgactgcaaacgctctcttaactccgatataacagactgcacctgcacatgccgacgtcatcttggagtattctgaatctgaaagtgtattgactgatgaatctcccaataggtaaagctcaccaaatggcacatatgaaggcaaagaaggtaccctgctccagcgtttagacccccctgcttcagatgcatttattttctcagtcctattattatcttcagtgttccctccatctttatccgataaaggggtaagagcaattccttgtgaactttcttgaatctcaagagattgaggtggttcttctgattcatcaacctttgattgcaaatagctatccaattgtgatggtgccttcccaaaaacatttgtttgtttttgaattgcacttaagcttttccgcaccccttccaagggaacaagt

SEQ ID NO: 23764 - DNA, 1277 bp, Zea mays
aatagagcacaaatcattgttactatgttttctctgacacataactaacaagtttatattgttacaaactaacagacatgtctcaatctggtaccacacttgcctgaatgttgaattgcttcttgattcttcttcggaaataaccagtatagatcgctatcaagaggatggagacaatccctatatatataaatatatgatgcctcattgcaaaaaaggaaattgggttgattaggacaacatccaacaaaatgcagcaaatcattccttgaaaggaatttcatctagcattagctaggtgaataagagtaagacatcaaaattaacaacatattagggaggcacactgaaataaacatgtaattaacaaaggaaacttaaaatcaatgggaacaagattgtaacaacaccacgactatggtatgtagcagatagagtggttagagacatgcactttatgcgagaatcatcagcacccttaatatatatgaaaggggacatgttggaacataccataatatccttttatcactttgttaaggataataaactaaccatataatgcaaataatatttcacataattgatgctgaatcagatgagaggagaaacttcacaacacttttgtgaaagaagcactaactgagctaaagctaaaatcaagttggtctttcaaggctgacaaagtggttagaagtaaaatatgattgcaccagtctgtccagcaagtccaacttgcagtctgattctctccaacaaaatatttagaatggctggcgcacattttattggagcatacactctatgcatcatcaaataaaaagacaggtcattaagctagatcaggtctaaggcataccacaaaaataagggattatccaaaatgatgttcagattgccaagtcaattaaaaaactgcacatcaagcactatatggtataaggctgagaaaatattagctttcttagactgtccaaataacatgcatggtggctgcttgcatttcacaccttattaagaagacaacaagaaacatagtacctcggccgcgcccaccctacctacacaacaatatgactacaatttttggatactaaagtaacagcagaaaaagcacgaactgattctctggtgaatgggttatctgtacctgaaggaagcaagatctgagattggctctctgcatgttcttaccaaatcgatagcatcagcagctgtaaacagttgcaagcaaacaataactttaaaatgaatcgcaacaaagtttagtcatagtc

SEQ ID NO: 23765 - DNA, 2885 bp, Zea mays
  misc_feature (310)..(334): n is a, c, g, or t
acaaatcattgttactatgttttctctgacacataactaacaagtttatattgttacaaactaacagacatgtctcaatctggtaccacacttgcctgaatgttgaattgcttcttgattcttcttcggaaatacaccagtatagatcgctatcaacaggatggagacaatccctgaaggaaacaagatccgagattggccttccccatgttcgttattgggttgattaggacaacatccaacaaaatgcagcaaatcattccttgaaaggaatttcatctagcattagctaggtgaataagagtaagannnnnnnnnnnnnnnnnnnnnnnnnaggcacactgaaataaacatgtaattaacaaaggaaacttaaaatcaatgggaacaagattgtaacaacaccacgactatggtatgtagcagatagagtggttagagacatgcactttatgcgagaatcatcagcacccttaatatatatgaaaggggacatgttggaacataccataatatccttttatcactttgttaaggataataaactaaccatataatgcaaaaaatacagcaaaacagaaaaaactaaaaagctcgctcgaaatacgtgcctgagcttaagctgttgcaccagtgcgctgagagcgcccacgcctgtagcctggccagaaataaacggaaacgagtggcgttgatcaaatagccaggtcgaggaggagctacagggtaccaaacacactgatatatccttcattttctctcaaataaaggggagagttgcatcttcaataatatacctttttttgctttggatagtggcttatgatcaagtcggccaactaagatctagaatgtctaattatgaagtttataccctggagcttggttagccggcaatgcaaacagctttaatttgtgacgtgtgcaagtctcggcagttggcacatcccagtccttaagagattctccatgtatcttcagaatttcaatagattccaagtgggtgctacctttttgaagagtaaaattttatagatgaagatatcatagttcaatgtaaatgataaccaactttcattaaaccatttgtacaccttaagcctcaagacaacatcaatcacaagtttagtaaagtactccttgtcttgggaaagtatttttcaactaagagtagtcatagaaatattcatgagatcaactctgagcttatcacgagatcgggaaaataattcacttgtattttctttgttgtccatggtcttttgcagcaaagcatctctagcacactcgagagacattctgtaacctaaaatttacaaaatgaattaaccggagacattgaatctcaccataaagaacaatgattgaagctcagaatacatactaattatctcggtataaaacaggtgttacctcggtataaaacaggtgacccaagatagattagaatcaaaacatggtgcactacctatacattattattattattactaagaaaattggaaggtaaatctcgaaaacatgaattgtaaaaattaatccgcatctcaaattgtgaatggctcaacagtggaatccatcctaagggaagcaaatctgttgctcttcatctcgaacttggtcggcatcctcctatcccgacgtgcaaggagcaccgaccaaggtggtggctaagccgagggaacaaagaggaggtgggggatctggaagagagacaactgcttgagccgctagctccctctgcgcgaactcgcccaggtacacgtcacactcagtcacggacctcgaccgacgatggtacctgacggcggggagcactgcgatgacgtccaggtcgagcccgcctagggtctcagcagcctcgtggtcggtgaagaagaccacggagacgcgctccacctagtggtggtccttgcggtgcgcatgttggtcaaataggagcaagaggcaggcaaaacaggaaccaccgccatagatgaagcagaccatagcgagcggtcggggtcggtggggcgcacgccccagcagcgcggccacagcgcgccccgcgcgatctgcagcgccgccgtcgcgatgggcaggtcgaatgcggaccgcagccccacgcgcgaccgccagtccgggaacctgggccccgacggcaggcccgcggtgaggacgacacggaggttcttgatcttccacgcgcgagggagacaaaggcagggcatctgcgtgtcgctggggcaagtaattcatgaacggcggtggtggggtcaagggcggttgcagcggtggtgtcagagcagctgcgacagcgacaagaatggcggatgcgacgggtgcgtgtaggtggctgcagcggcaacgtgaaggacactagcggcggcggcatgaaggcatcagcagcgacggcaactaaaaagcttgtccctgcacctaaaaaatctctacaccgaaaaggattgtgatagcgacgtcggtgtgaagagcgacaatgcaggcaccacgcccaagtgctcctgtccgtctgggggcaaggaaagcccgctggcgcgaggcttcaacagcgtgttgtggccgccggcaagcagcaaaatcaatggcttcgtggcgaggaaacttgaaatggaataatggagtcacaaatttgtggaggtccagcggcgacggactcaaccttctaggcgataggcaaggtgtgttggacagtgtcgttcaccaatggtagacattgctaatgttgatttcgattccatgtcagaagtaccttactcatctagtgaagacccatacattgagtaggatcaatctgcgagtggcaacccatttgttaatggtatgtgaatcaaatgcttatgaatggaatcttgtgtgaccattttgatccaaaaaaaaaaaaaaaa

SEQ ID NO: 23766 - DNA, 797 bp, Zea mays
  misc_feature (236)..(236): n is a, c, g, or t
aaaggggatgttcttcaaagccattaaatttgggaacccccgggtttttcccgtccccacggtgttaaaccccggcccatgaattgtaaatcggccccctataaggggaaatgggccctctaaaagcaaggtcgaacggcccccaatttgatggaaatttgcaaaatttgccccttttaacggcccccccggcagggaaccctttttttttttttttttttttttttttttttttnacctttttttgtcccctttttttttttttttttttttttttttttttttttttttttttttttttttttttttttttttttttttttttttttctgggaactgggaagggtaccattcagcttgcaatccatgtgtcccttaacataaacacaaactaccagcaaaataagaagactaggagaggtatgccaaagaagcggcaatacgctcttgatacgagcagcgtagcaaaaaaccccgcgccattggaggtttcaatcaccatgtctatagctatgtacacgagtctaatgagcttgggcgtcccaaacatcatgtcttgctaacgactacacctacttccccgttgcatctctgttcagcattaccttcatccctgggatgcttcccccgcattgttcgcttgccatcctccaccaaagctgacccttcatcagtcatactaacatcccttggacgcttccctaaaaattgtcgcttgtcatcctccgccaaggagaggcttatctgtatacaacttcggattgcttgttgcttctatttgtctgtatttcattgga

SEQ ID NO: 23767 - DNA, 2731 bp, Zea mays
acccctgcagttcaagggatcatcatagcgatcataacggatcatcatgatcgactgcaccaaaatgtagacacaccataccgcgcaagtgtagatagtagatacacccacataaattgcaatacaagccgagcaagggcgatgatttcgttctggaaaaggatgaatgagtttaactgactgaggcggattgaactatacccaaagcagaaaacaccggcagataatatttacctttttctccgtttgctttggtttttttccgggaactgggaagggtaccattcagcttgcaatccatgtgtcccttaacataaacacaaactaccagcaaaataagaagactaggagaggtatgccaaagaagcggcaatacgctcttgaaacgagcagcgtagcaaaaaaccccgcgccattggaggtttcaatcaccatatctatagctatgtacacgagtctaatgagtttgggcgtcccaaacatcatgtcttgctaacgactacacctacttccccgttgcatctctgttcagcattaccttcttcatccctgggatgcttccctataattgttcgcttgtcatcctccgccaaagctgacccttcatcagtcatactaacatccctgggacgcttccctagaattgttcgcttgtcatcctccgccaaaggagaggcttcatctgtcatactaacttcggattgcttgcttgcttctatttgtctgttatttccattggaggttgcttgggtagctgtaaactcaggcacaggtttatctccattagaatttgcctcgggccctgcaagctctatcttaggtactggtttatctccactggagtttgcttgggtagctggaagctcttgctcaggcactggtttatctccatcggagtttgcttgggttgctggaagctcttgctcaggcactggtttatctccatcggagtttgcttgggtagctggaagctcttgttcaggcactggtttatctccattggagtttgcttgggtagctgcaagctcttgctcagatgcgggtttatctccactggagtttgcttggatagctgcaagctcttggtcaggcacaggtttatctccattggagtttgctcgggtagctgcaagctcttgcttaggcacaggtttatctccactggagtttgcttggatagctgcaagctcttggtcaggcacaggtttatctccattggagtttgcttgggtagctgcaagctcttgcttaggcacaggttgatctccattggagtttgcttgggtaactgtaagctcttgcttaggtaccgctgcatctccattggagtttgcttgggtagctgcaagctcttgctcaggcattgcagaactgctggagcccgtcacaccaacagacagtgcatgattatcagtttgctttgcttggatactatctgaaggtatctgtgacaacacatctgactttgtttcaatatcaacccatcggttcttgacccaatctttagagattctaatgttccttagctggcacgcacggaaaaagttctctcctggaaaatatacttgaaggctatctgccacaatgttgtccaaactgacaacaactccttcccaccaaccactaaattgccagacatcaacagcagttccaggtaaaagagcagccccatcaacaaaactattttcttgaggacgtggcctgattcttagccggtcttggcatctcagtcccagtttatcaggaagagccaatgcagaggcaggtaccatctcctccaatctcccactatcatcagcattttggagatcatcatactgaaccttcaatctgttatgattagtgcatgacttcagaacagtgcacctgaaccagcaaccaataatgccactgtcttgagataagatctctaatctgtcaccagtattatatgccggctttagttgattctggggcactataatcgtggtgcccgggtgcttcccaggaggctgctcgttacttaatatttgataagatggtatggagtctgcctgggggcttcgacaaattttagtgcccaaacattttgaataaagcctctctaattgctttggaaatttagctttcccaggtgtacaatattcactgtccttttctgactcagctggaaatttcatggacctaacaactgcttgactaaaatatccacgcaacgttcttaaatcaaaatacttgaacttatttttactatactggcgagagcagaaacggatcccagtcataattgacattgcatgggagcatttttcataatgatcacgagttaaaacagttgcaatatcatcaacacattccacactgattacttgtgtgaaaggagtgatgaaaacttcgcaaggatgaggcggaggaggtatagcgcaagcaatttcctggttttgatgaaaccatcgcactttgatcttcttctgtcccttcttatcttcatacatgtcttccaagtatgcaagatagcggttttgttcctctgacaagaccagcacaaaagtgtgggtagatattgtggttccattgcgacaaaaagcttgatagtgccgaagctgcttgctacatgtccagaaccgaccgcgccggcggacgcctgggctgcagtctttccccagattttggtgcaaaaaaccatttgtttccccgtatccatctgacccaatgtcattatccgcaaaagatccatattttgagaattttg

SEQ ID NO: 23768 - DNA, 5862 bp, Zea mays
  misc_feature (5032)..(5032): n is a, c, g, or t
cgccttgccttcgatttgcagctagctgattgcttccaaagtcgcataccagggcgcagcatatgttctatcttttcaactctgttttgacccaccatgagtttgatgagtttgattttttgtttgggagagggggtgttagatgcagagtcacacctaattagcccatagaataggggcttctttgtatatttacacaagtgtatatttgctcatttagctcatgcggttttctgatattgattgttgatgattcttttccacaaaattatagaatttaggtttccaaaacaatgttttcaagtcgtctagtcgaacctagtcatatagtcacgattagttgtcgaccagaccgactaatcaagcctaaagcagcctaatgcaaggagagcagagcaacaagaagcacactaaccatctcaaggcgagctcatcttttcggtgcttgataccagcggatacacaagagctaggcctgtatgatgaaccttgaagactgcgggcgtcgcctggggcggcaacagagcagcacgggtggcttcttggaactggatcttgcgtgcagcagtggcattgcggcagcacgtgcggccacctagaaattgcgggcggtactgcagctgtgcggcagcagggcagtcgcctggaactggatcttgtgggtggcgggctggcagaggcactgcagctgtgcggcagaatgagtggttctaggcgatgcgttcttgtgcagttgtagttggttgcctagtttggcaatgctaaaaggccacaatagcagcccatgagcccacaacttattgcgattaatcgtgattagtctgacgacttgaaaacactgttcattgctggcctgcagcaagagtagagtgttgtggacttgtggttactaatcatgctaataggatttgcaaggtactttgaaatgtttattgctattatttgttcatttcaacaggtagctgcctgcctatgtatcatccatttaataacaaagttgtcaaccggtgatactgggagcttgtctttctcattcatgaagaaaattcagatcatatcaacaaaagtaaggcatctatgagactttgatgttggtttgttggcatcaccttgtttacactgtcttgcttctgtttgttttctagaaaagtacttcacctccaatgttttttggtgtcagttgtatggaaaaattagactaggacatggtaaaaatatctgcgagtgtaaaagaaggggtgaggcctctattggagaattccatttcgattgggatgcccactatatcacaccacatcaccaaagtagtccctttcaagttctggtaggttagagatcaaaacttgatgagagtggtacaaaccaaaagaagatagtaatattgtaaaactaacaaataatagtgtgaggcggatggtgtggtatcgagcttggagacctgcattagggtctaggggagcatgctcatgctggagtgacaccgaaggaaggctgcaagagtggaccccactgcggcggcatctgccatagtgtctgccttggatgcaaggcttgtgaggctgctgtgtcatgcactcatgctgtcctggccaggtggcagatcaggtagcaccttgctgcaggcatgcaagcgagaaggcagtggtgggctagggtgtggcggatacatgatggtggtgagaggtcggggaggtgtggatggggaactcgtggtactgtggtagggccaccactgtggtttatttttcgtttctttaattctgtttccgggatgccatggcatgtgcataagctcagacctctgtaacccacaatatccacccaacctaaacccatctagctcatgtattgatggatgggtcaaaaatctattctaaatccagccttgcacaggctaaacaaaaatgcttatgaaaaaaatacttttattgtttgtttaggctagtggttatacttaatttgttcggtactttttttagctacttaccgtttgtttatgcagttgttgcagcaccatgcatttttagctctcctgtcacagtattccctgcatggatacaggtaaccttcttagttttgtgaaatctatggttgtgactatttttgttttattctgcattaggcgttattcactttatagctcaaacaagaattccatttctgagtctgcagacattttttttctgagttcggaatattgtcagttcccctatcttatctataactcgtgttaaccttgatggagtagaattgacttgtatgggactcctttatgaatctgttattgttttggagaaagtgagatgcatgaagtggtaatcaagaacttactgattttattatctcctgtcgacctgcagcggtgaacaagaacttaataatttggttctcaatgatctttattaccttatacgtggagaactcgaaggacgtcagattagctctggcccttttcaggagttgctcagttttcttcttgggtttagaatttttgaacacaatcccttggagcaactacaaaacacatacctgatggcaaatgacaaatttttatttgatgtggagcacatacatgacgagcttggagttgatctctggactgattcagacaagaggtctaaagaagtagctaaaaaaatgctggatattatgagtaaagcaaatttaatgaagtattatgctgatgcaaaactttctgcattgatgtccttcttgaaatttttatctgtctacaaaggagcggtaatttcatttaccaattgagaactgagatactttctttccttgattatattgttgcaccatactgtttctgttacgaaccatagttcattgatcgctttgggggagactagactgtaggacaaggagttcagtggcttgcatagacaatattcttgctgcccattccttttatctatggctcgtgtttctgaaccaattcttctataggatcgccagactggactggactacatggagacctgaaccaattcttcttaattgcttgagtcctgtatgctcattcctctctttatatagagttggctcctaacaaattctacaactttatcttctatcaaccttatatatttctaactgtaaattaaggcctaatctctccaagtaacaatggccacccagtcccaaaacatgtttttatttcatgtgtccataaacctgtcggtcccataagcatgtcctaccatgttgttaggtccgttacttaagtgtgcggggtggggggttgtcaggaactcaggaatgatgtatcttattcactgatgaccggtttggaaaatatatgagcctacccatgttgacttgagctaaatgtgaaatctataatttacttgaatttttgtttggcagctaatcttagaacttctacagatttctaacaaaaacttggacttacctgatggaggcatatcagtagcggccacacaatcagcaattaaatgtgcatgtaaatcatttgagtcaactgttgattcactgctgcctcaagctcatacagatgaggttttgtttcccctcttgtccgggcaagtggaattattgcttactttggcccgaatattgtttcatcaagcaaagaacaagaaatcaagccatctctgtccagatattgtacttctaatgaaaacttcaggtgccagcacttgtttgtttgttgatctcatgccatctgctcatgctcttaagcaaccagtgaagacacttcttgttctgcttttgtcgtcatatgagggcatgtacagcaaggttgacataaaagacctaccaaatgatattaacatttttggcgaattagcccttttaagtgtgagcttgctacctatactgtgcaaattggcagagaatagggaatgctctgatcttgctgttgcatcaatggacctaatattgaagggatctgtaccttctaatgtatggatgcctattctgcaaaagcattttcatctccagactatactgcataaatgccagaatggtgatttattatctactcaagttatacttaatttcctcttgaccttggggcgaacaaaggatggtgctaaagttcttcagtctgccaatatttttgcattcttaaagttacttttgagtcagttgtctctggatgactcctgtttgagaaattccttgagcgcccaagtgaaggatgtgaacctatggggcttgggtctcggtattgttgcgtccctgaaccattgtttggatgatgacatttctcataacaatgtcgtgagcaacactatcagcttcctttcaggacatgtgcctttggtgtcatcatatctgtctacacagagtgctactactcatcagagcaagaaacgggcattgtcgcagaagtcacagacatcgctttcagcccttagtcttactgagaatattctcatacttctatgcatcttggcaaaataccattttccacgggacactggaaagaaggaagtagattcagaactaagagagattattatccacctgctagcatttataagcaaaggaagtgtaaagactggcaatgcctctaaatggaactcatcgtttttctgccctgctgttatcaaagaggaagtagcgcttaatgagaaaccaccactcatttgtagcaagtatgggtggttcagatttgcagcaagttgtactttgtcaactgcaggtgtttcagtttctcccagtgcagctttatcagtggtgagacgggacaagacttcaggagattctgattctataaggcagactcgttttactgagatattagctgttcagatatacaggattgcttttcttatcatgaagtttctctgtagtcaagcaaaagaagcagtaaaaagggcagaagaactggagtttcttgacctcgcccattttcctgagcttcccatgccagatattcttcatggtttacaggatcaagtggtttgtattgtcactgaaatattcgaggcaaatgggtcaagcactctaaatcccgagacagagaaggtatgccagctcctattggtgacacttngaaacgtcactttacatggaactatgtgtatcccaatcatgtggcatcaggccagtacttggtcggcttgaagatttctgcaaaggaattaaggctatgcttcaagctatagagaagcactccaggctcgagccctttgcctggtccatcctaatcgaaaattctcttttgtatcccgggcttttgcataataaccttctcatgtgactcttgtaaattgtcactgttaaagagatgtgttgttggctaactttgaattgagccacatatggacttgcatactcagttgacgtcacccgaggaagcttcgttttcgcacgttactgtcaccaaagtaaagtgggttccagcggctacgaagcaaattcgcagagccagggcaccaaatcaaactgaaggcgacgacgcccgaggaagcttcgttttcgcatcacctttgttcggtttcacagccgaggctcccaaagtggccagagaatcttggtggacttgcctttccgggactccacactgccgaccacgcttattcacccgtgtaaattatgctgggattctcctttgctggctcgtctggccgatgtgcgtcccatcatcacagagaactagaaacaaatgatacatatgtagatgctatgcgttcttgatcaatcagacacgcattttttttctgtagaggaatacatgttcggcgcgttgcatctttacactaccatttgtttgccttctccatcctgtttaagccctgtttcaaaacgctaccatgcaaattaaccctaagggataatttgggagccgtaaaaaaaaaaaaaaaaaaaaaaaaaaaaaagggg

SEQ ID NO: 23769 - DNA, 1904 bp, Zea mays
gtgaggcgccacgcaacaacaatggcagttggcacagaggcgcaacgcaaaaaccccccaccgccaccgctctataaattccccgccccccgccccccccgcctcctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaactttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaagtggttgtgcttgtgcagtttatcactgagtttacatggcatgatcatggtaacgcagccagtgcagcatagatttgttcgtttgaacagtttaccaaggctgtaaccctagtaagctccagattaaggaacctttgttttcaccattctatatttactagatgaatgcccgtatgttgcaacgggaatatataatattagtatactacaataacttatatacaaaatgtgtgttataccattatgag

SEQ ID NO: 23770 - DNA, 1621 bp, Zea mays
ggtaccctcgggttcggccgggagtccactccaccaccgttcatgcatgaccatggagagatctcaaccgcagcaccagcagtctcctccgtcgccgtcgtcctcctcgtcctgcgtctccgcggacaccgtcctcgtccctccgggaaagaggcggcggagggcggcgacagccaaggccaataagagggcccgcaaggacccctctgatcctcctcccgccgccggggagaggagctccgtatacagaggagtcaccaggcacaggtggacgggcaggttcgaggcgcatctctgggacaagcactgcctcgccgcgctccacaacaagaagaaaggcaggcaagtctatctgggggcgtacgacggcgaggaggcagcggctcgtgcctatgaccttgcagctctcaagtactggggtcctgaggctctgctcaacttccctgtggaggattactccagcgagatgccggagatggaggcagcgtcccgggaggagtacctggcctccctccgccgcaggagcagcggcttctccaggggggtctccaagtacagaggcgtcgccaggcatcaccacgacgggagatgggaggcacggatcgggcgagttttagggaacaagtacctctacttgggaacattcgacactcaagaagaggcagccaaggcctatgatcttgcggccatcgaataccgaggtgccaatgctgtaaccaacttcgacatcagctgctacctggaccacccactgttcctggcgcagctccagcaggagcggccacaggtggtgccagcgctcgaccaagaacctcagcctgatcagagagaacctgaaaccacagcccaagagcctgtgtcaagccaagccaagacaccggcggatgacaatgcagcgcctgatgacatcgcggagcccctcgtcacggtcgacaacagcgtcgaggagagcttatggagcccttgcatggattatgagctagacaccatgtcgagatctaactttggcagctcgatcaacctgagcgagtggttcactgacgcagacttcgacagcgacatgggatgcctgttcgacgggcgctctgcagttgatggaggaagcaagggtggcgtaggtgtggcggatttcagtttgtttgaagcaggtgatggtcagctgaaggatgttctttcggatatggaagaggggatacaacctccaacgataatcagtgtgtgcaattgattctgagacctatgcgtggcgtgcgacaagtgtcctgtctttgggtatacttggtttgtccaatgccacggtgccactgctgcgagtcagctgaacttcttgtagaaagcacatggcagcttggcattagacaagtgtgttggtgttccttaattctttggatatgctttaggcattgactaaccttaagggttcgtcactgtctcgcttagcttagattagactaatcacatccttgaatctgaagtagttgtgcagtatcacagtttcacatggcaattctgccaatgcagcatagatttgttcgtttgaacagctgtaactgtaaccctatagctccagattaaggaacagtttgtttttcatccatacatataacacgctttcagaagc

SEQ ID NO: 23771 - DNA, 5282 bp, Zea mays
  misc_feature (126)..(126): n is a, c, g, or t
tcaatgatgaatattattcgggcagataagtgacgggtacggatattatttgccggatacatgtggatacttgatacttgttggataatgcatgaattgcttatttattaactagaatctagttcncgtgtaagacagttgcaccaggagtattgtataggccataaatcagtatgacaatatagtccatgtccaacacaatagttcgactgtaatgacaaaattcgaatcacataataatctaatatagcataggatattttttttcaaatgacataagatagtctaatgcgacataagatagtacaacacatatgatatatagtctttaataagatatggggtattggagttgatatgtgatgtatagtctgctactttgatgtaaactagacattatttaaataatttcgacatgaatatgttcatacaaaaatgtaatgtgctacaaagttgtagatctcttcaagttatacaactttcatgtaaactatctttgtctgagttcatatgtaaaagttatgattatataaaatattatacaagaaaaaaatgggtacccgaaatccgggtaaccgtatttgacctgatatccggatatttaccgggtagttctcgttccgaatccgacccgaatttgaagctgtcctatctgggtactagttgtattcgtcctaaatataaaagtaaccaaatttgtatatgaaaaatttgtatttgtataaagtggcgaaggtaataaaagtaaccaaatcaagaggatgcacatgactttgggatgtatagtaataacttgtgatgcatatatagtgaaattgagtctaaatcactagttttacaaaatttcgtgggtacatgtgcatcctcaaattattacctttgggatgtaagtaataacttgtgcatatatggtaaaaattgagcctaaatcactagttttgtaaaatttcgtgtgtacatgtgcatcctcaaattattacctactttcgctcctgtttatataattcatatcgttacctgacgggtttgttatccgttacctgacgggtttatttgggagcttgtttgaaagcaagtgtaataaagggaattgaagggatcaaaatctattactattcaattttgaatagtaaaatattttggtcccatcaatcctctccattaccattggccccaatcgggaggccgagaagtacaacatgtgcattctcaaattattacctaccttcgctcctgtttgtacacaattcgtcaattcgtgtccgttacccaacagacatgttttcaccctagggccaaggcccaaatccacactgatgaaacagtcaggatcaggaacttggaacacaacgaagcatttctgagataaagctgacaggccactcttttcttctcattttcctttctccacaacacaatgacaccatggaaattatacagcacaacacactccagagagggtaagaaagaactattacaactcatattactgcacacacgccaatgcggaacgaagaaaacgaaagaatgttattgtgacgagatctacatgctgtgtactgtaactcttggggatacggacaaaccacaccgcaggcacccccttggtacatacccggggtgcccgtctcgcctggcctggcctccccgagcctctggtctggagcctctcttcggagagaaaaagcccatccagtcgctcgcccacctgtacaacgcccaccggtatcgtctaaaatctttgtagctacagtgtgagtggagcagcacgagtcagtcaccgcaaggagttcttcagcgaccgaacggtcatcacgagctgctgccgctcgccttccacctccgcgaacctcaggctgatctccgagtaccgttcgtgcagctccttcagctcctcctcgatcgccctgttcttctccttcagtgaggccagctcctttgctgactggtcagtggagttcctgacgacacagacgagtcgttgcaagcagaaagaaatatcagtcagattagtcgtggttcatgggtttctgaacttaaaaggtgtctgtgtcagctacgttcaaatgagttgatgtacctcatgtcaggaccattgcagtcaccgtcttcgccttgtctgttggtgcctggcagcgcagcaatgctcccagtggagccggtattgtgcttggtgcgcttgttattagcatgctgattgtcctgcaaaaaaaaaaacagcactctgtgtaactttctgggcaacaaagtgtattattgcaatctagtaagcacttctatgtaaaggtcgcccaatgatgtaaagcaatataacgtgttctcgtcagcggggccctgtatggaataaagctattccacgagctatgatgatatgggagccggtggatagaactaaagaaatttctgtcttcccatgtgcaaagagacagaaatcatgtcattttttcgcagacatatgtgctcatacttttgttggggccttgtgtgatcaactgctcattgtactgacttagatagaaaaaggaagttacagcaaccggttcagatggcaatcaggaagcaaaagttgcaagggttaatgtttccattttttagatggacttttttttgcaaataaagtttttgagcgttgcagttattaacatctatatcagcacaagacctttaggttattgatatgccagaagagaagaattgaagagcatctcagcagacaaaccaagtaaaaggacaactgtctgcactggaactggaaacgtatttgctttgcagaatttaccttcacatctgaaatttgaccatttgccttcgccctgtcccgggtttcaagggatcttctcagcttcagaacctgagaggcaaggctgtctttctcagactctttcttggacagcgaagttttcaagttgtcacactggagtttcagtgacccaatatctatttgcagttttccaattgtttcctccctctcgttcttcaaacgttttaaactgtgcagttcgtccaaatgcatcttcacttggtccttgaggaatacaagctctttatttagtgaagtaatctcagcagttttgtcttgcaattgcatgtccttttcgctaattccagctaattccttttctttctgctcattcttttcgaatagctcatttctctcactggatagcttgtcgatcttggaattgagtaggtcgatttcttctgacagagcattcagctttgcctcatcacatcttttttggttatggaactcatcactcttgcttttgagctccatcagtagcctgtctatctcctttgacttgaaatccactagggttattaactgctggaccttcacccggtgctgatcctgaactgatccaagatctccttgggccttctggaagtaactctcctctaactggctcttctgcagctgcagctccgcaacctcttttcttgcttgcacaagctgttgttcgtttgcactgaaagcagaagatacttgtgaagacaacaccttgaattcctcctgaagtcgttctgcggtagttgcattattccatcttatcttcctcagagaatcctcagccttaatggcccgttgctcttgttccacctttgcactcattatttctgctatgtcggcctcaaactttttagcctgtgtctggagttcattatccaagctctccacattggcctcaagatcacttataatagccaaatgagctgaacactcatattgcatccttagctgctccctcagttgtgtttgctccagcctcgaagatatgtcatggttctcttgctttagaatctcataatcaagtgcaagttgctccatttgcatctcaatatcctcacgatctttcttgtacaactcgatttcattgctcagctcaaggattttcttttcaagctcagaggtagagatgtcatcacgcttctttgccagtgcatccagcataagctcatcttccttctcttggtatgaactcgtttcagataaggcaattttgcgtccagaattatgcacatttgacagtgcatgctcatattctgcctcctgtggatcctcttgtgtatcctcttgcaaaatggaaatgtctctgttcttttgctccaacatctcatcaagatctttcacagccagaagcagctcagagttagattcctgcatcttttgcagttgtagacgaagatctgcatttagattcttctcatgattcagatcttgcttcagttcttcaacctgtgaccatgggtcatacccatctgagagccgtttccctgagccatttgaatcatggatcatcttctttgcccctctcagtccttcatattctcttctgagtgcatccctctcctccctgaggctactcatctccttggagagatcttgcccacgccgactctccttcacaatttgctttcggagagtctgcaactccatatctgagacatccaatttcctggttaaagtggctatttcacttcttagcttctccacgtcgtcatcctcccctcttaaccctgcctcaccagaattgctcgttgacccatctgtactagcatcaggagctgagcttcctgaccagtcacccgaactggtcaatgggttcctcccagtgccattgttggcaaatggtgagagagcattgctactatcctgaagatatgagttgtgcatggtcgcactaattttgggggtatatctcccagaacttgcatctgaacctgacaccgagacagcatcgaaactgctgccattgtggagatggcccactgggtcaacagacataggcacatttcttcttgatggaaacctcatgcctggaggttttgttatcaacaatccatcttgcacaggactcatcgcatccgtggccgctctagccttctcgccgtcctcgtcctcaaaccggctcagctggttctgcagtgtcgttcttctctgtggcgtctttgccaccggcgaggcgtcgccgctctcactcgcgtcgtctccgtacccaccggcgccacccaccacccgctggatggtcacgtgcagcagcgtgccggggctgcccttgagcgggagcgtcaccgccgacggcttcaacgcgtcggcgtagtccgccaggttcaccgtggcctcccccagcaacgccgccttgctcgacccggtctcatagacaaggaactggtagatcttgtccttgccggcggggagcttggtggcctccatgataggggccgcccagcggcacgtgccatcggtgacctccgcgggctccgaccgcgccgtcggccgg

SEQ ID NO: 23772 - DNA, 836 bp, Zea mays
agatatgcagcgccatatccgtgcagtctactccatttttgttcccctctccggtggcggcctagcgggggtgtggtcttcctcgcgtcgcctcccctcgctctcatccggtcatcagtttgaggtttcaacctatttcaccagagctgattggactcatggatgggaacaaagatgaggcattgagatctgtcaagcttgcaaaatctgcatttgcatctggggataggcagcgcgcagaaaaattaattaaaattgctcaaagattggaccctggtcttccacttgatgatttgctgagcccagttgagaaggttggcatcctgaatatttctacttgcaaagacaagactgaaagaggacaagctcttttatacccaaaaacaacaaaagaatctgttggtcctttaaatgttgataaggcttacactgaggagaatattagagtggttcaggatatcaggaaaaagaaggattactatgcagttctcggagtagagagaagatgcactgtggaggaaattaggaaggcatacaggaggttatcactgaaggttcatcctgacaagaacaaggttcctggggcagaagatgctttcaagatggtaagcaaggctttcaagtgcctaagcaatgatcagtcgcggaggacttatgatcagacaggcaccactgaggaccatgaattcaatgagcaacatcccaatgtcatgaggcggggagctgctaggcggagaaggccagcaagaagtggcttctataactatgaaggagattttgatccaatggagatattcaggtccttttatggcacccatgataatatgttccatccc

SEQ ID NO: 23773 - DNA, 1173 bp, Zea mays
acggacatggtggctctgaagtcatctgttaaccgatggatttggtcgtcgaaagcgtcgttcatgggcgcttacccgtcaggccatcaaggtttcctcttctgcccggctcgttgccctccactaccgtggcactgagtgctgccttttccggacgtccatgcccacccattgttcgtcggaatgccccagcggtggtgccatttgccaagaagaagaggaatgaatatatcgaagatccgccagatgaggaggtcgcagatgatttcaccgacgagttggaggaggacttcgacgacgccaaagaagacgaaggcgatgtaatggatgatgacgaagagtatgaggacgactatgactttgaagatgattttgagagtgatgatgaacaggatctttatgctggagatggaggtgctggtggcggtatatcccttgctggtgcatggtgggacaaggaagcgttagctttggcagaacaggtctcagcatcattcaacgacgacttgaaaatatacgctttcaagacagctgcaaatttgactattagagtacgcattgagaagatgtccaccaggtatggttctccaacgatagatgacattgaagcatacacaattgcatatcgtgcaaagttggacgaagcagagtcagcaggaaagataccgaaaaacatatcgttggaggtgtcatcccctggtgtggagagagttatccgtatccctgaagagctcgaacgattcaaagaaagggcaatgtatgtcagatacactacagcaagcgatgaggcaaccacacctcaggaaggtgacggcgtgctaacgctaatttcctatgacatggacctgcgagagtgcacctggggcatagctgatgtgaagataaaccggcagcagtctggcaagggcaggcccctgagcaagaagcagagggaatggaggctgcagacaccgttcgagtcgctgaagttggtcaggctgtactctgaatgttgagatgccagtttttgagtaaattttgagtttccatttgttgcactccttcggcagtttatccagtctcgctgaactctgatatgccactggatgcgcagctcatactaggtagaatgatgttgtactaatgtactatctgtcacaatcaattagttttttttctttgctaacaaaaaaa

SEQ ID NO: 23774 - DNA, 1370 bp, Zea mays
  misc_feature (1225)..(1225): n is a, c, g, or t
  misc_feature (1295)..(1295): n is a, c, g, or t
  misc_feature (1305)..(1305): n is a, c, g, or t
  misc_feature (1311)..(1311): n is a, c, g, or t
  misc_feature (1313)..(1313): n is a, c, g, or t
  misc_feature (1320)..(1320): n is a, c, g, or t
  misc_feature (1346)..(1347): n is a, c, g, or t
  misc_feature (1350)..(1351): n is a, c, g, or t
  misc_feature (1361)..(1361): n is a, c, g, or t
gcccccgtctgccctccgcccccctcgccccggccgtttcccacagccgctcgccccagcctcctctgcccagagacttttctttgccgccgaaatggatgactcggagaacaacgcaccctcgacgccggggtcccccgggttcagcaccgaccggctgccacccaacaccaccaccagccgcggcgccaccggcccggcgtcttactccgacgacgatggcgaagctgaggtcgatcctcacgtgctacccgatgacgacgaccccgccgctgtagcggctcccgacgaggacgaggagggggaggacctcttcaacgacaactacctcgatgattaccgaaggatggatgagcatgatcaatatgagtcagttggtttagatgattcactcgaggatgagaggaatcttgatgaaatcatggctgatcgaagggccgcggaagcggagcttgatgcaagggaagtgaggactggtgcaacagctgataggaagctgccacgaatgctccacgatcaggatacagatgatgatacgaatttcaggcgtcctaaaaggcacagggctagttttagacaaccaagtggaccaagaacaccaagaagtgatgatgatggtgatgctgccactcctagttcacctggaagatctcatcgtggaatgtcatctggtggtgatgtgcctatgactgatcagactgatgatgacccatatgaggatgaatttgatgaagaagatgagatgaacatgtaccgtgtccaaggtacattgagggagtgggtcacaagagatgaagtccgtcgctttattgcaaagaaatttaaagaatttcttctgacatatgttcatccgaagaacgatcaaggagagtttgagtatgttcggcttattaatgagatggttttagctaacaagtgtagcctggaaatagactacaagcagtttatttatatacatccaaacattgccatctggttggctgatgcgcctcaatcggtgcttgaagttatggaagaagttgccaaaaatgttgtttttgatcttcacaagaattataggaacatccaccaaaagatctatgttcgaatatcgaaccttcctgtctatgatcaaatacgcaatatcaggcaaatccatctgaacacaatgattcgaattggtggtgttgttacccgacgatctggtgtattccctcagctgcagcaggtgaagtatgactgtaancaaatgtggaactatccctgggccctttcctccaaaacccctacactgaggtgaaagttggatcatgccntgaaatgccnatcaangnccatttnacagtcatgtcgagcagaccaataannagnnactacagaanttaccttcg

SEQ ID NO: 23775 - DNA, 1250 bp, Zea mays
gtgcgaggactgcaagttgatttgcgagaactcaaagggtgtttgtaaaattgaggccaacacgcatcgtcacatggtggcattttgagacttgacacccgtgaaatgccaagagcgagtgaattgggatcatcttttaaggaacccgattagaaggaatcatttagatgttgcgttttttagtctaaatctctgaagtagtctggtttttggagtttgacaatgtaaatataaaaagcactgatatattcagcatatgcgtataccttcctaaaccctatggtatgtaaatgataggaattaaggtagtgtttggttcactctaattaataggaatggtaatggaatgggctgcaggtgctatcggtttatagtgtaatgattacctggatttgtttgttttatttgaacagcgccattagatcccttaacggtgtttgttaatcgcgttcactactcactgaaattgctacaagcgtgtattgttgatgttggcaaatggcgctactcctgtgctcatgcagatatggaaaacatatacctgatacattacatgtaaaaattatagaaacttgtacaagtcaaattcaaaggaaattaggccgcttttttttttttttttttctatatatacgacaaattagaaagcacactacacagagcaagagaaatctacggtaccgggctggggaagaataagaacacccgtggtaagcagtcgtgctcctcctcccgtcctatcccctttccttccctttctttctccctcgcacaaatccttgcgcccgtctcctcccagcaacgtggaagaagaagaaaaatggatgtagcagcggatcttgtgagagtatcaccaggagcaggcagcgacggtggattgtgcgatggcggcgcctccgatcgtcgctctgcagtcgcgtggagaagagctgggtggagtcgcgtggtggagagtcaagacacgaccgtcgcgtcgagggatctgacgagcggcggcgaagacgggaggcgggatggagcttcgagcggctgagccccagtcagcgccgaagaggacagatatgtggcggcggcggatggctcccacttccggcgcccgatgaactggtgaagtggaggcaggaggaggtgccgccggtgtccggtccggacgcggacgcggacgcggacgcggcgtggggaagatgaattggggatgcccggctgaaatttcctgggtgggccggttcccggccggcctcgagggtccc

SEQ ID NO: 23776 - DNA, 791 bp, Zea mays
ttttttttttttttttttttaattacaccgactgatgcagccttccaccttttattatttagatatatacatacatcatgataatgggttccttttacaggccattcacacactactcttgctaccaggtatgttggaccagactgattgactgatgcaacaaagcacaaacaaacacaacgtccacactaccaaacatgtcctgaccaaccagtacacaccgacagtccacgcataatagatttcagtttcacaccacaccagagggcaggggagatacttgaatcgagcagagcacaccgagatggggaagggcgggcgggccacggacttctggcatcacagccagctgcgctgcgcagagccaccaggcttctccatatttttgcagctgcgaggggcagaggtactagcgtcagcgttgttggccggcttcttgccgagtcccacaccaccatccagcatgaaaggcataaagttgcccccatgcacccggccttcacgggccgagggcgccacgtggcgaggatcctccaccgtgtgcatgaagaagcttgtttcggcgcctccctcagaaagggtggaaaacccaccaaacgatacacccccgtggacgctgtggtcgtccaccagcgggttgtgtcgatcgcaaagcccctttctgcctcttgccagacggtcgcaaggagcgccacccgacccgagatgtccccaccaacagcgcctgcctccaccgtgcgacttgcagaaatcggtgcttccctgtgcgctcttcccacagccagcggagt

SEQ ID NO: 23777 - DNA, 2527 bp, Zea mays
gctcgcgcccgcgagactcctcccaaaaccctcgcatcctctcccacgcatgtcacaatcgccatgaccgacagaaaccccgccgccgcctcaagcaagcgtcactgtgacctctccctcgacgatcccacgccgtcggccaagctccagcggtgctccgagccgtcagaaccaacgccggcggggaaaccgaacggcggcgcggcgacgggagaggagagcgagatgatggccggcgcacggaaccctagggcgcagaggtacctggtcgccgtggagtacattggcacccgcttctccggctcacagaagcagcccaaccagcgcaccgtcactggggtcctcgaggaggcatttcaccgatttattgggcagccagtttcaataatcttttctagccgaacggatgcaggtgttcatgctttatcaaatgtttgtcatgttgatgttgagcggataagtaaaaggaagcctggcgaagttgtctgtacacaaaactcattttttttcttaacactgattaccgaccaggccttgtctacatctcttgacactctaaacttatttctttttttgatctttgcatgataagtatatttgtgacagttgttgttatgcctgatttaaatcttctaggttttccaaaataaaattctacaagcaatagaattaccttttctcctgaccttgcctctaaatcatctattttgtccgttccaaatcataattcactttagctttgccttaagtcatatttaaccaagtttaaataaaaatgcaccaacatctacaacatcaattagtttcattaaatttctatatgaaatgtcttgatagttcacaaaatgttgatgtcgttgaagacctggcggctggcgccactgctgaaacaagtcgctgtagtctgggcgtctggattgatgtattttggtgggagagttgtttggtaggttttgaactgtttgttgtgagtgttgttagtagttgagagtgattgttggtagttaaactatcacaatgttgattgtaagctggtaacatcagcagtggatatttgactattggtaagctttctaataaagctgggtgaatgcttttgatctaaaaaatgtcttgatagtgcacttgattggactttaagattttaatatgtttttattcctaaaaacttgttcagttagaggcatttgacttagaaccaaactaaagtgtcctataatttgtaaaagaggaaataaataaaaatatgttttctagaacagcgcctcttataactcctgctgctgatttgcttttccctttttacagttaacacctcatgagcctggagttgtaaaacgtgctgtgaaccactttctactgaagagtgaaggtgacataatggtgactgatgtctgctgtgttgcaccagattttcatgctagatacaaatctctagagcgcacatatcactatcgcttgcttgctggacctgaatcaacatctgtttttgagaaaaactctgtttggcatatatctgaagatttggatattcagtcaatgaagaaagcatgcagcatacttgttgggcatcatgatttcagttcatttcgagcggctggatgtcaggcaaactctccagtgcgaactctggatgaacttagtgttacagaagtattccctttcatgttttttccttcaagtgtagaaagatcagagttggaattatcaaatgtctctcttgtttattcaaggaaaccagacatggaatcttctgggaaaggatctgatggttcctgtaccagtagtgtgaaatcagattttgagaatggaaaagattttggaaagcggtcaaggcaccgttgctttgttgttactgcaagggcacggtcttttctttaccaccaggtaaggttgatggtcggtcttctaaaatctgttgggactggagatctaacaactgcagatgttgagagaattctggatgcaaagacggttactgctgcacccagtatggcaccttcttgtggtctgtaccttgctaacgttaaatatgatctgaatacctgaagacaagttttatctagtggcttctgttggtgggcctccagattttgtcagctgttggctatcaaaggaattatatgctgccacttgccaaagctttcagttgcctgttttgtccactgaatcttgcatggtgattgaaaacctagaattaagtttatctgtcagcacaagagccggcttcattctcttcttgtacacagagctcttctgcatgttcagaaacaaaataggtagcttcattttagttaagttcaactatccactctttaaatttcagctggatccacccgattttgttgggtgtacgtagatttgacctggtaggggcaaaattttatttcttggttttctcatgactgtacttggttcttgatatataattaattagccaaatgcgttgtgtgcatattgaaaataaaaaaaggaaacaaataaacgaaaaatacggtaccagacctcgaggggggggccgggtacc

SEQ ID NO: 23778 - DNA, 2256 bp, Zea mays
cttgcatgcctgcagcgcaggcagccccgggtggagatccgccccaaaacagcccttaattttatgagatttcccctaagaaactttttcgacgcgaagacatagatgcagagctattcttcaatagaaacttacatgttgccatctctaatcgaaagcaagtcgtaagcaaacttctctacaaccgagctgtagagaatttttttcattcctcaaccgcaatctttcttttggcctgtttatttcagtttcttggagattctgtacttcagattttagacttcctaaaagtcaaactcccataagccaaaatccaaaagctcactacagtgagcttctaaactttttcttgtttccgggagctttttcacttcgtctctgtaatcgacctgccacctcaactaataaactatgacgtcactgattttgactagtattagggtatttcaatagtttagggtctagatacgcaattttttttagttttgtttctcgcattctttttacccttcaaaaatctaaacacggatcaccgcgttaacaacttttgataaaaaaaatgccttcaaatttacagcatgcaatctttaatcatggtcacaacacagctaataacaacaattggaaaaataaaggtgaacctaataatcgttgccaaagcaaagcttaattaaatattttccacactacgccacatagcactacgataagtatcacatatcatcttcagcagcactagcagcgcttagatccacgctgagatcaacagtctttccggtgatctttgtgtaaagggaaagtacatccataacagtggactcaaagtgtgttgtggcatcataacttgttgagatgaaacaattgtctgctgatgagtcattggtaggttcatatctgtcatatatgtcgataaataactcgtccaccttcccaagaagatcgatccctggctttagttccttctctggattatcagtctccgcttgtgctgacacgaatgcgatgaatttgccttttgatgcgacattatgagagtaggaacagcagaaaacatacatgtctgatctgcggccaagttgcttctgtggtaatatgatctgtactgagtgagattcagcagtatttgggatgggatggctcatgatagcaattgcccgaaaaacttttccaatttttttaaccttgtcaggtaggtaggaaggatcacagacaacctttttgcattttgcagtctccccttctgaggtaacaccacaaactttgccttcatcatcaaattcgaccttgcactctggcttactcaacatgtaggtcccaccataaacagcgctaagtcttgcaaaaccctgtggcagttctcctaaaccatacaagggataaatatatggtgatcctccttgaaagcgagccactgattctgcataaagcttcatccgttttacagtgtcaattgcaggttctgtcaagtagctatcatctctatgaagagccactgcatgcccaatgaagtctatcgtattatcatccaaaccatattttgagataagttcttttgtcgttagtttagtaaggttgtaacccttatgagtacttgggtcattttccttataatcttggacataaaggaagaatttcccagctcttcgcttctcaaacaatcccatcaggggagacttgagagcttccatgtcagtagaaggaaccttgtggatctttcccttgttgaaaacatagcttccatccacagctttgaaggacatgtacttggtgacaccagtatgaatgagcacacgaaccaaggtaccatttgccatcataaactttggaaccatatcaacgttgtagtctctgctagctcctatgtgcgcaggcggtgtttcttcacccttgaaccgtttccagagctgattgagattgagcgatgtggagtctccgccgtagtagtcattcctgtccatgtgcaacaccttgaggcggtccacagagaggaggccgctgaggatgcactccttgagcccggtgcccagcacgatcacgtcgtactccacatccatggcgcgcgcgcgggcggcgtcgccctcgcccggtcgagagatcgagaaacgatggagggaggaaagtgtggatctccaacggctcgagtcacggtcgcccaaagaggtctggacgtctggttgccgagcgggctgcgggccggcagaggagcccgcacggaccaccgagtgggagggatgaaatggaaaaaggaaaccgacc

SEQ ID NO: 23779 - DNA, 4254 bp, Zea mays
tgaataatttttagtctctctattttattctattttagtcgctagtgcactagaaatcaaacaaattagttcctaaaaatttacttcctaaaaatcaaacacccctttagacagctaccttaacataatacatatacactagtgcactagaaattacactctagtttgaaaacttctttttccaaagcaaattagtctattttctctttgaaaaaaataaaatttctttaaaaaatgtttcggcatccatccacaaaagacacagaactatagaagcgtgcgacaccgacacccacttcacaacagcagcagcctgacaatgtttgccgaagctgcacagtagattgtttagctgtaaaacttctccctgtccagcaactacaggtaagaactcggcgatgttcagcatggttgtgccaccaacggtgactgagatgagccccaacaccaggcagatcagatgttagtaatcctatgcggagctacagcgacctgagatgagccatttgcgtgttgctatttcctcctgtaaacgtggcatctaaatcttgcacgtatataaacgtgctactgaattcatgccagagcaatgcatgtttgcttgctttttccgcatcttgtgtttactgtcgtattagcgcggtgacatatcataggagtattattcagtcgaactctcagtaacagtttcaggtctgaacttgatatcacaggcagcatctcagtgaaggcaacacttgggcaagggggaaagcagtaaacatacaactgctgtggtgatacaatcatgaatgttctgcgctatgatgtaaagacatccggatgcagatctcctctacaaaaagatcagcagcgcgggaaagacgagtctggaaattatctgaaataaaacacgcttttccatctactgacagttaaggctcttgtgtatgtcttaataaagacaccctttccggtcactccgaggctgcaggctgctctttctccgcctccgaggggccattggcggtggtttcttggctctcagcaggctgcttggcgccgtttgctggggctgccgcgccgccttctttggcgccgtcctttccaccacctttggcgctgccatcctttgtgccctctttagcagcaggtgctggtggtggaggctgcaacatatgtggcggcggagcatgcttcagcttcaccaagatatggcgcatccgggacaggtcggtgggcttgccaggcttggggccctggacaactgtgatggatggcttcttgtccttgtctttcttcccccgcttctcgatggtggctatttcatgtgggatgagatctgaaatcgatttccagtactgcttgtctgcgccggcgtggaatttctcctggctggctacaaaaatcttctaccacaggagcaattagtgtccaacatagagatagattagctttacaagcacagacgagagccctagatgcttatatgatagtcgcataccttctccctctctctgttgttcaccatgtttgacgcacagttctgtatcctcttctcaaaaaaggctttcttgaattcttcggcttcagcaattatttgggcacgtagctccctctccttctgttcttttttctcaagttccatagcattttttctaagacgttgttgaaaaaggaaacaacaacaacaccagattaaaactagagtgacaggaaaataagaaaatgtcattgttcgatttgagggcattaaaaaccaggacaggaaattggtctgcaccagagcaccctcagactccttacaaattgactttagtggactttccacaatataagcattaaatcaaaatcgccgaacatacaaatctactactgctttgagccagggataatgtcctgatgaagcagatcataccgaacacaccttaaattatgacacagcgcaactccaatattcatgaacttctattaattaactacaaaagtaaattccgaaagtaaatgtaggcatgcactaaaccataaaataaacaaggctgggccggcgggccttcgtggctgactcgagatcatgttaggaagtgcacacattttgcaaggtgacaaagttgagcggtaacaacttctctgggaggtacaccttcactgatttgaggatttcaagaaaaacaacagatgtgaacatcttaaaaaataaatgtgtccacctacacctagtggttacttggtcaggactgatgtgatatcaacaaagcatacagttggaagaatgcaagtcaatatgaaacattgagtggttgcagaagttcactgatgcaaaactaattattacccccaaacaatgcatcaaccacctggaagagaacaatcatacagtaggactgttaagtctgtaaactacatctgattctgagagtataggtaatccaacaaagaacattctccaactaatatgatatttttagaagtcaaaatgattgcctgccacaaattcatattctagtttggcctaccttttacagtttaacctccattcctctggtttctgtgagacttggttcatacaagtttgatatataggtaagattgggacaaatacaagatgaattccatcgaggtaaaataaaatagctaaggaagattcgtttggaattatgtcatgctagcttaggttaaattttactttctattgaatagcacaccaattctagatataaaaaaactcggccaagaatggaatgaccgccctcccggcataatattaaaaagagaccgaaacaatgaccccgtccgagaaaatctccgaaccctgtcctcccatcactaacatgccggcgtcataccgtccactctgcaacggataaactaacccgagagtggataaggcacaacgaggggattttttaaccaagcccgaaagttcgcccccgaagggaatcgaacccgggacttggaggtgctactcggaagcattaaccactaggctagaggcccttttgccaccaattctagatatatatgcttaaagtttttttttaaaaaaaactttcctaggttgtaggctccttttggttggactatgtcaaatagaaaattgagcaatatatagttccattctaatgaaatctagctaagagaaaaacacaaaattccaaggaaaaagtgtcattgtgtaaacactcactccattccgaatggcaagtcgttttggcttttctagattcgtagtttttacaaagtatcagacagtcactaaaaagctacctaaaaaactaaaatggattatagtttggaacagagagagtacctctcaattgctgtaataaaataatttcaggggtaaaggcacaagaaagcaactttaatcactgggaccataggcgctaagtggtcaaggaaaattactgcacactgctgtattcgcagtttcatgttttatggtgatctccatacagtagctccatacaatactgtcaatggcactgatagtatggcaaaaacagagatactagaagatccaactacagttactgctatatggtagtatcaacgattcaaacacttagggctagtttggcaaccctattttttttcaagggatttccattttcccaagggaaattagttcagttttctttgggaaaacgagaatctcttgggaaaatggtgttgccaatctagcccttaatggagaacaatacccaccctagaaggcctgcagctatacccaagttctcagcattgaaactagtccgtgactggctattcccttaacacaaacttctagcgtctcctaatacctaattaacctaagtaataaaaaacaacattttcctttgtggttcattcacctccgtagagcagaagaaacagttaaaattagtcgaaagatcgccaaaaggcgttagatctgactcgaacagccggaaacctagcccacacgcaagcaagcatacaggcagcaaaacggcgtgtcccccaagcagatcggaaccagcgccggcggtcctcacctccgccactcgcggaggaggattccctcctcccgccccatctcggtgggcggcggcagggtcgggccgtcgctgccgttgggctcgaggtcgggggagaatggcgagggcgagtatcccccggagacgtggcggatcgggacgccgtaggactcgtacgcgctgtagtcttcccgtcgttcgcacgctcctcgacgccaccgttcggcgtacggaggcgtaccccgccggcgtctagcgtcgtcggctgcggcggcgc

SEQ ID NO: 23780 - DNA, 1418 bp, Zea mays
  misc_feature (18)..(18): n is a, c, g, or t
gcttattgcacatcttgngaatactgtcgtattagcacagtggcatatcataggagtattattcagtcgagctctcagtacagtaacagtttcaggtctgaacttgatggcgctcgcggccgctcagtgaaggcaacacttgggcaagggggaaagcagtaaacatacaactgctgtggtgatacaatcatgaatgttctgcgctatgatgtaaagacatccggatgcagatctcctctacaaaaagatcagcagcgcgggaaagacgagtctggaaattatctgaaataaaacacgcttccatctactgacagttaaggctcttgtgtatgtcttaataaagacaccctttccggtcactccgaggctgcaggctgctctttctccgcctccgaggggccattggcggtggtttcttggctctcagcaggctgcttggcgccgtttgctggggctgccgcgccgccttctttggcgccgtcctttccaccacctttggcgctgccatcctttgtgccctctttagcagcaggtgctggtggtggaggctgcaacatatgtggcggcggagcatgcttcagcttcaccaagatatggcgcatccgggacaggtcggtgggcttgccaggcttggggccctggacaactgtgatggatggcttcttgtccttgtctttcttcccccgcttctcgatggtggctatttcatgtgggatgagatctgaaatcgatttccagtactgcttgtctgcgccggcgtggaatttctcctggctggctacaaaaatcttctccctctctctgttgttcaccatgtttgacgcacagttctgtatcctcttctcaaaaaaggctttcttgaattcttcggcttcagcaattatttgggcacgtagctccctctccttctgttcttttttctcaagttccatagcattttttctccgccactcgcggaggaggattccctcgtcccgccccatctcggtgggcggcggtaggatcgggccgtcgccgccgttgggctcgagctcgggggagaacggcgagggcgagtaccccccggagacgtggcggatcgggaccccatcggactcgacggtgatctcctcgtccacctcctcgacacccccctcggcgaaagaggcgtacccgccgtatccgtcggcggcggcgacgtcggccgcggcggcgccgaagtcatcggagtcgaaggggtgggaagtggtgcgtgggaggtcatcggtgccgtcgtcggcgaagaaggaggccatggttggcgaaggggacgcagagattcgcggcccggcctggtggacttgacttgtcactggtggcggcgttggcgggtgcgggcgcgtttgtgtgtatccggccggatcccggccggcctcgagggcccccctcgagggtcccaa

SEQ ID NO: 23781 - DNA, 1360 bp, Zea mays
ttttttttttttttttttttaatgcaagattgctgtttgttgcacagcttcagattattattagggcagtaccatatcatcgtaacagtttcagacctcaacttgtatgagatcataggtatctcagtgacgacacaactggacaggggtgaaaacagcaaagatacgactactgtggtgatactaaattatgaatgttctgcgctcatacgaaggacatcctgatgcagatctctacagaagatcagtacgggataaacgggtctgcgaaatcatcagaaacaaaaacacgtttccatctactgacagtcaagcctcttgtgtttctgtaatgctacgctttcctttccggtcactccgacgccgcaggctgctctttctcggcctccgaggggccattggcggtgctggtttcttggccctctgcaggctgcttggcgtcgtttgctggggctgccgcgccgtctttggcaccaccatcctttccaccttctttggagccatcctttgcgccctctttagcagcaggtgctggtggaggttgcaacatatgtggcggtggagcgtgcttcagcttcactaagatatggcgcatccgggagaggtcggtgggcttgccaggcttggggccctgaataactgtgacggatggcttcttgtccttgtctttctttccccgcttctcaatggtggctatttcatgcgggatgagatccgagatcgatttccagtactgcttgtctgcgttggcgtggaatttctcctggctggctacaaaaatcttctccctttctctgttgttgaccatattcgacgcacagttctgtatcctcttctcaaaaaaagctttcttgaattcttctgcttcagcaattatttgggcacgtagctccttctccttctgttcttttttctcaagttccatagcatttttcctccgccactcgcggaggaggattccctcctcccgccccatctcggtgggcggcggcagggtcgggccgtcgctgccgttgggctcgaggtcgggggagaatggcgagggcgagtatcccccggagacgtggcggatcgggacgccgtaggactctacggtgatctcctcgtccacctcctcgacgccaccgtcggcgaaggaggcgtacccgccggcgctagcgtcgtcggctgcggcggcgccgaagtcgtcggagtcgaaggggtgggaggtggcgcgcgggaggtcgtcggcgccgtcgtccgcaaagaaggaggccatggttggggggacgcggagattttgggcggcgccggcctggtggactggtgctgctgctcgtgctctgcactttgctttcttctgcttgctccgcccggccgg

SEQ ID NO: 23782 - DNA, 1025 bp, Zea mays
  misc_feature (977)..(1004): n is a, c, g, or t
aacctggcgtcccagaaggactccaacatgttcagcacggtggtgccaccccgggtgaccgagatgagccccaggtgaagcaaccgccatgtaattttgactaattccttccttgcgttttgtcaaccggcggcgactatatgatgtagtgccaagtgtgttttcctcctgcaaatgcggcagctagatcttgtacatatagattagtgaatccatgccagacccagagcaatgcaagattgctgtttgttgcacagcttcagattattattagggcagtaccatatcatcgtaacagtttcagacctcaacttgtatgagatcacaggcatctcagtgacgacacaactggacaggggtgaaaacagcaaagatacgactactgtggtgatactaaattatgaatgttctgtgctcataccaagacatcctgatgcagatctctacaaaagatcagtacgggataaacgggtctgcgaaatcatcagaaacaaaaacacgtttccatctactgacagtcaagcctcttgtgtttctgtaatgctacgctttcctttccggtcactccgacgccgcaggctgctctttctcggcctccgaggggccattggcggtgctggtttcttggctctctgcaggctgcttggcgtcgtttgctggggctgccgcgccgtctttggcaccaccatcctttccaccttctttggagccatcctttgcgccctctttagcagcaggtgctggtggaggttgcaacatatgtgacggtggagcgtgcttcagcttcactaagatatggcgcatccgggagaggtcggtgggcttgccaggcttggggccctgaataactgtgacggatggcttcttgtccttgtctttctttccccgcttctcaatggtggctatttcatgtgggatgagatccgagatcgatttccagtactgcttgtctgcgccggccctcctggctggctacnnnnnnnnnnnnnnnnnnnnnnnnnnnnccatgtttgacgcacagttct

SEQ ID NO: 23783 - DNA, 2496 bp, Zea mays
  misc_feature (2486)..(2486): n is a, c, g, or t
  misc_feature (2489)..(2489): n is a, c, g, or t
  misc_feature (2491)..(2491): n is a, c, g, or t
  misc_feature (2493)..(2494): n is a, c, g, or t
cccggccgcgcgagtgcgcaccacgtcaacccgtcgccactcacataaaacgtcttgacctccctgctcgccgccggcgaggagacagtagcccgccgctgcacgcacgcgccgcgaggaggtctggagcggctagctcgtctagagctaagtcagcgaatctcccggaccgtcccttctcagttctcatggccgtccgccgcaggcccgcggctgctgctgccggggacctgcctccgcaggcgccaccggcagatgcagcgccgacgccggcgccagacgaactggtcctccggccgccaaacctccgcgtggccgctgtggcggcggtgctcttcctcgcgcccttctcttatctctcgttcgtgcgctaccgcttgggcgccgatctgcagcgatccatcttaaaatgcggcgccatgagcctcattgggttctgcgtcgcgctcaagctcatccctgtcgcggccagctaccacctccgccgccggatgttcggctacgacatcaacaagaaaggcttgcccacgggccaaatcaaagtgcctgaagcactaggtcttgttgtggggattatctacttggtcattgctattatatttcagcagtttcactatgccccagactccatttggcttgttgaatataatgcagcgttggcatcagtctgttttatgattcttcttggatttgtcgatgatgttcttgatgttccatggagagtgaaactggcattgcccaacgtttgcagcactcccattgctaatggcatatgctggtggcacttccatcatcattccaaagcccttaactccttatgttggactaacggttttggagctaggtacgtgtatcccctttaaacaggttgaaagtgtatatttactctttggtggttgcagcacttgtgtttgttttttgctgttataaaaccaagagacggttaagaaatccacaggcatagcagatctcactatgaaatccttatgcatttgttagtcattcaatcttgattataagttataaaatagaatttgtttgtcagtgtctatgtttttcaacagtcaacaccatattttatctagtgtagtgtcaatcaagttttgcctgctgatactggtttattttgttcctcatttttatggcagaggttccctgtacgtctttgatctttagcttttttccattgtccaaaataagccacccactttggatttttgtcaaagtgtgccactccttataggtacattaacttataatatttctggaaaactttaaatgtttttatgggatatttttacattatgtagtattttggagatttgtgggactttagaagttgactttattatatcatcaggatccatatgcttaccatctcttgcaactctgttatttgtatttttaagacactcacaacctgtttactgacattttgtttagtatctgacattttgtattgactgagcatgataattctgtaatagcgtaacattttgcttcattccaaagcccttaactccttatgttggactaacggttttggagctaggtttattttacaagctattcatgctcttgttagcagtcttttgtacaaactcgataaatatacatgctggtctaaatggacttgaagttgggcagactattgttatatctgctgcggttttgatacataatgtaatgcgcatagcatcttctacagatatcgaaactcagcaagctcatgaattctctatttatcttgtcttgccattcctaaccatttcattagctttgctagcttttaactggtatccctcgattgtttttgttggtgatacctacacctattttgctggaatggctttggctgtgataggaattttgggacatttcagcgagacattattgctcttctttttacctcaagttcttaatttcctatgttcagtcccacagctctttcactttgttccttgcccaagacataggttgccgaggtttgatcctgaaacgggtctgttgactggtaccaaagatggtaatctggtgaacatattccttaggttatttgggaagtgctcggagaaggccctttgcataaggctccttatttttcaggctctatgttgcgtattctgcttctggctaagatacatgctcaccggatggtacaaatgatcacctgcgaaaggctctccatcttgtcgcccagctcttgggaaaacccggttgcgtctgatggctattgtttcctcgacgtactttatcaggaacatgggatctgcagaggagcaattggaaggctgaaagagcagaaggttgagcgggaggagtaatctgattaattgaattttgtttgtgattaggccttattgggcctggggtttgggccgtctggccttgtaaggagggtgtacttaaaccctgaatcttctggtaattggcaggaagaaaatagaagaaaaaccaccgaaaaaaaaaaaaaaaaaaaaaaaaanaananannaa

SEQ ID NO: 23784 - DNA, 2341 bp, Zea mays
ttctttttcaacaagaaaggcttgcccacgggccggatcaatgtgcctgaagcactatgtcttgttgtggggattatctacttggtcattgctattcgggttcagcagttcactatgccccagactccatttggcttgttgaatataatgcagcgttggcatcagtctgttttatgattcttcttggatttgtcgatgatgttcttgatgttccatggagagtgaaactggcattgccaacgtttgcagcactcccattgctaatggcatatgctggtggcacttccatcatcattccaaagcccttaactccttatgttggactaacggttttggagctaggtttattttacaagctattcatgctcttgttagcagtcttttgtacaaactcgataaatatacatgctggtctaaatggacttgaagttgggcagactattgttatatctgctgcggttttgatacataatgtaatgcgcatagcatcttctacagatatcgaaactcagcaagctcatgaattctctatttatcttgtcttgccattcctaaccatttcattagctttgctagcttttaactggtatccctcgattgtttttgttggtgatacctacacctattttgctggaatggctttggctgtgataggaattttgggacatttcagcgagacattattgctcttctttttacctcaagttcttaatttcctgtgttcggtcccacagctctttcactttgttccttgcccaagacataggttgccgaggtttgatcctggagcgggtctgttgactggtaccaaagatgggaatctggttaacatattccttaggttatttggaaagtgctcagagagggccctttgcataaggctccttattttccaggctctatgttgcgtattctgcttctggctaaggtacatgctcaccggatggtacaagtgataacctgcaatcggctctccatcctgacacccagctcgttgggaaaaaaaatcagctgcatctgatggctgttgttttcctcgacatacttgtagactaaccagagtaggtttttggattcatttcctatgtatacttgtgctaactacagtttccaagtctttgtaaccatatatatgcaatgcctttggcttcaaggaagtcttcggtatacttgtgtaccaagagcctgtttcttctctgatatcctgtttggttcaaggagtaggatgatggaattggaaagagtaaaatgtatcttaatggttagtttgaaaactccaatctgaggggatttagatggaaattagttcattttttgacaaatcctcttcaatcctgaagagaatttgagtttccaaactagccctaagagctagtattgaaacttaaatcttctccgggattcttggggacagaggaaaatgacctaaattttcactcaatctccagaaattctggagaggatttaaatttccaaactagccctaaacatttttttcgattcttttttgggtccataaactcttaagtccactcgtggacctcgataacctatccagcatcaatttggaaccgattgcatatatcactttgagaataactttgatagttaaaaagagacctatgagaatgcgagaaaagttcagaaacatactgtgaattttactcgattagaaatttactatcatttagttattggagcacatagctgggaattggaatcaggtttcctaaattatgttgtttggttacatgtggaattgaggtttggaatcagagatacaattccctggaattgaactataactaaaaacatcatcttccaatacaaagcctcacccctcggtattgcgtggaagtagatcgtataattccaaactccaattcagtgacatccaaacaaaagaattggaattactcatttcaataccatgcttgatttggtatttaatccaattcaattccatcctcttcaatgtcaacatctaaacggagtataaagacaggctaattccagaaaaactcatgtatttggagaattggttcgtgttaccaaatttggacagtgcgatgttggatgtcttctttccatccaaagatggatgttgacattactcctccgtcagtatgccctttctaatttctacggatatgtaacctgttttaaaaaattggtgttaggtaaaatgctatcaaaaaatgtttttactaccaaaaaaacgctcagctgcaaggatactagaagatattttatcaaagacacatctatttcggtggttccaaagaatccaggcacctaaggtagtgaatgcttatcttccacgtcagactgcaggcatgca

SEQ ID NO: 23785 - DNA, 1409 bp, Zea mays
agcattgtctctgcttcatgttatgttcatagagtagtagaaggcgcatctttgttggccctttggctgtagtcgaacagaaacactttgggttcacatgctcaatacatgacttcagtagatagaagagctgaaaggtttgccgattacctaattatgcgggcgcccggtatggtactcagtaaagacatctaaacttgatggaataaatacatatgaatgattataccaagctaaaaggactaagtagaaataactatagagatgattattaatatgagtatcacaatccaacaccccatcgcgatggacagaagagggctcatcgtcaccgcctagaagtccatctgcaaccacttcttgtagtaaacgcaggtgctgggtgagatgatcccctccggcgagcactcatgagtcctggggcaaatcccacaatggattccctccatcatccctccctgcggagccccagtcaccagccgatagcacattgtgccggccttaacggcgctaaaatcccgcgtgccggtgctcttgacctcttcgagcaccatggtcttgatgatatccttgaccttgtcgatagtgtacccggccctggggtcttccttgagaatgtcgtggtggatcatctgcgcggtcgcggcgccgagcctctcgacctgcgcctggcagcagcggcgcgcggtgcttacggcgtcggtgtctaggcgaccgtcgtggtaccaggtgcccccggtgatctcggcgaaggactggaagtcggtggccatgaagatcttcctgctgcggtggcgcacgtcgctgacctctttgagaagcccgcttgccacgagggtgcgcacgaccttggtggcgatgttgggggccatcagcaacttcttgaggatgtccagcatccacaagcccttgttgcccgcctcgattatgatattgtatactgcctctggtggtaatccgaccttaaatctcaaattgaggttgcaaaaagaaccttctggtacagtcagctgtaaacatttgatcatgtaagaataagttcctacattgtatgagcattcttgaagaaacacaaaatcacatctacttctaaagcaacacaatagataggtaaaatcacacaacccccatcctcaagaacatagaaacaattagaattggtgcctgattggttgttaaagactaaatctgctcaaaggtagctatgagatgcttttaactactgaaactaactacaaccacatcaaggacatacattatgctgtgaccagaagtcatttttatcaagcagctctctcagcttcatccatccgtccaagctcaagcaaagggaaggacgaaaacaaactaaccgtgaagttgaacatacaagcatgagaaatctctctttctcacttagaaaacatctg

SEQ ID NO: 23786 - DNA, 1513 bp, Zea mays
ttttttttttttttttgaagctttatggaattttttcactgcatctaaaaaaagtatacaaggatgactaaacagccattttcagtgcacctaaaaaaatgataaaatgacatatgcacaagtgtaaacatttaggtctcaacataaaaggtgtgttttgttggttaatagcaaccatgcagttaggactggaaaaaactcagagcggctcggctcgagcggttcacgagcctcgagcgaaccgagccgaaccagatttttgagctcgttggggcaacgagccgagccgctctagctcgcgagctgcacaaaatcaaaatcaacctttgttggtcctttggctgtcaaacaggaacactttgggttcacatgctcaatgtcaatatataacttcagcacaagagctgggattttgccgatttaccagaatctgaaactgcactatgactatcctttcagaggttccaattgaacatttgaatccagcctagcgtgtgatgagtgtgatccaacagccccaattggtcaatatgaaactgagttccccaatggactccaacactccatcatatatacacatacacaggtacaggtacagcagaagacggctaaccgcctagaagtccatctgcagccaattcttgtagtaaacgcacgtgctcggtgagattatcccctccggcgagcactcatcaatcctggggcaaaccccacaaggaattccctccatcgtccctccctgcggagccccagtcaccagccgatagcacattgtgccggccctgacatccctgaactcccccgtgccggtgctcttgacctcctcgaggaccttgtcgagaaccatggtcttgatgatatccctgatcttgtcgatagtgtacccggccctgggatcgtccttcagaataccgtggtggatcatctgcacggtggcggcgccgagcctctcgacctgcgcctggcagcagcggcgcgcagtggttacggcgtcagtgtccaggcggccgtcgtggtaccaggtgccgccggtgatctcggcagagggctggaagtcggtggccatgaagatcttcctgctacggtggcgcacatcgctgacctccttgaggagccgccgcgtcacgagggtacgcacgaccttggtggcgatgttggggcccatcaacaacttcttgcggatatccagcatccacatacccttgttgcccgcctcgaagatgagcttgtacgccaggcgctcctgggggggcagttgggcgaggatcgccgccgagatgatcggctgctcggaatcgggggagggtttggagggttcggacggatgtgcttcaggttgatgcttcgaggaaggggagggctcatccggcggcagcgccgggcgctttcgcggtggcatggcgcacgagaggctggcggcggcgccgcggggcaggggagcacagctgcagaaggggggaagaccggaagaggagtgctttttttcccggcccggccggcctcgaggtaccca

SEQ ID NO: 23787 - DNA, 1466 bp, Zea mays
cttactctgcccccttcgtcgtgacacctatcacggtttccaagcatcattttgtactttatttcacaatctaagttctgttagtgacacctatcacaaagttgaatagaaggcgcatctttgttggccctttggctgtcaaacagaaacactttgggttcacatgctcaatacatgacttcagtagaagagctgaaaggtttgccgattacctaaatatttaggaagttgatatggtactgagtaaagacatccaaacttgatgaaataaatacatatgaatgattataccaagctaaaaggactaataagtagaaataactatagagatgattattaatatgagtatcacaatctaaaactgaactgttgttatacctaacctttcagaattcagaggtcccgactggtcaatatgaaactaaattctccaatggactccaacacccccatcgtgacggacagaagagggctcaccgtcaccgcctagaagtccatctgcagccacttcttgtagtaaacgcaggtgctgggtgagatgatcccctccggcgagcactcatgaatcctggggcaaaccccacaagggattccctccatcatccctccctgcggagccccagtgaccagccggtagcacattgtgccggccctgacggcgctaaaatcccccgcgccggtgctcttgacctcctcgagcaccttgtcgagcaccatggtcttgatgatatccctgaccttgtcgatagtgtacccggccctggggtcttccttgagaatgccttggtggatcatctgcgcggtcgcggcgccgagcctctggacctgcgcctggcagcagcggcgcgcggtggttacggcgtcggtgtccaggcggccgtcgtggtaccaggtgcccccggtgatctcggcggagggctggaagtcggtggccatgaagatcttcctgctgcggtggcgcacgtcgctgacctctttgaggagcccgcttgccacgagggtgcgcacgaccttggtggcgacgttgggggccatcagcagcttcttgcggatgtccagcatccacatgcccttgttgcccgcctcgaagatgagcttgtacaccaggcgctcctggttggggagttgggcgaggatcctcgggttgatggtcgactgctcggaatcggggtcgggtttggacggctgcgcgtcaggtcgaggcttcgaggcaagggagggctcctccggcggcgacggcgggcgttttcgcggtggcatggcacaggtaatggcgggttggcggcggcggcggcggcggcgcggggcagggcagggcaggtagcacaaatgcaaaagggaggaagaaggaggaggccggccggcctcgcgggtcccgggctttattaggctcatgcgtaaatcaatgtgcaatatatattctatttggccatctcgagctgaacaaaccatttgcatgtatgtgc

SEQ ID NO: 23788 - DNA, 1495 bp, Zea mays
  misc_feature (1462)..(1462): n is a, c, g, or t
cattgggtacctcgaggccggcgaggccggccgggccgggggaaccgacccggcatcgtctcgcgagccgcgactcgtctcgtcgtttccatcgaacgcccagatcccacattcccacctagctctgcgcgattcatcccggccgccacgccaaggaggccctcgcctgacctcggatcaaagcctccatccgccttcatcccggccggtggttcgggccgtcacgggaggggtccgtcactggttactcggtggagagctcggggctcggctcccatctcacgattctcaccccacacgcgcaccgggtcacctcgattcggcagcctcgcgagtccttgttgcgtgggtcactgcctcactgggttctgaggcaaggaaaagaaggcttcagtagtcaggtctgggtcaagccatgatggagagatcgctgctggaggtgctggccacggcggcgcaaggagggaccgaggggacgtcagtgctgagcatgctcaagtacgccgtgctgcccatcgccaaggtgttcacagtctgcttcatggggttccttatggcctccaagtacgtcaacattctccagcccaacggccgcaagcttctcaatgggcttgtgttttcccttctgcttccatgccttatattttcccaattgggtagagcaatcactatcgagaagatgatacaatggtggtatattccagtaaatattgttgttggcgcagtatccggctctttgattggatttgttgtggcatctatcatcagacctccatatccatacttcaagttcactgttatccatataggaataggaaatattggaaatatacctctggtcctcattgcagcgttatgtcgtgatccttctaacccatttggcgactctgataaatgcaatcaagatgggaatgcatatatctcatttggccaatgggttggtgcaattattgtttacacatatgtattcaaaatgcttgctccaccaccaggacagacctttgatggttctgaagaggatggaatcccaatcaaggcatctggagagaatacagtgccccaagtaggaaaatatcctatgaacactaacagtagtactgtaccagagaatgaacctttgttatctgctggggaagttcaaaaggagcgtgccacttctgtaggaacaaagataatgggctatgttaaatgtgtggttaagtttctgaaagacaagcagcttctccagccaccaattattgcatctgcttttgcaattgcaatcggtgttatcccattcttgaagaattttgtacttacggatgatgctcctctgttctttttcacagacagctgcctcattcttggagaagctatgatcccatgcattttacttgctgttgggggcaatcttgtcgatggccctggtgaaggagtaagaggcttggcgtgcgtaccactgttgctataatttttgcacggntggtcttggccctcttgctgggttggattacca

SEQ ID NO: 23789 - DNA, 851 bp, Zea mays
  misc_feature (9)..(9): n is a, c, g, or t
cggccgggnaaaaaaaaaaaaaaaaaccgacccggcatcgtctcgcgagccgcgactcgtctcgtcatttccatcgaacgcccagatcccacattcccacctagctctgcgcgatccatccccggccgccacgccaaggaggccctcgcctgacctcggatcaaagcctcctccatccgccttcatcccggccggtggttcgggccgtcacgggaggggtccatcactggttactcggaggagagctcggggctcggctcccatctctcacccccacgcgcgcaccgggtcaccacgattcggcagcctcgcgagtccttgttgcgtgggtcactgcctcactgggttctgaggcaaggaaaagaaggcttcagtagtcaggtctgggtcaagccatgatggagagatcgctgctggaggtgctggccacggcggcgcaaggagggaccgaggggacgtcagtgctgagcatgctcaagtacgccgtgctgcccatcgccaaggtgttcactgtctgcttcatggggttccttatggcctccaagtacgtcaacattctccagcccaacggccgcaagcttctcaatgggcttgtgttttcccttctgcttccatgccttatattttcccaattgggtagagcaatcactatcgagaagatgatacaatggtggtatattccagtaaatattgttgttggcgcagtatccggctctttgattgggtttgttgtggcatctatcatcagacctccatatccatacttcaagttcactgttatccatataggaataggaaatattggaaatatacctctggtcctcattgcagcgttatgtcgtgatccttct

SEQ ID NO: 23790 - DNA, 2558 bp, Zea mays
attttatcaagctcgctcgccgtcacactgcgccaccagcggcgatcccgccatggcctcctggctcaaggtcgccgaagacttgctcgaagtcgtcgaccggagggccaagatcgtggcaacagaactgtcggatgagcagtctacctctcagccttcaggaccaaacaaccaagaagtgcaagcaaagaagggaaagccgagggagaagggtccattgaagctcactaatgccgatggtggcaacaagatatctgctcagaaggaaaagaggagtaggcaacggccgcgagagcggatgaagatcgagaagatcaggccttcgccacctgcaggttcatcaagtgttgataccagtgctagtgaaccagaagtcactccgatcgatgttaaggaagtgggtaatgagggtacattggagaaaggagagaaaggtactgatggccttaagactgatgggtctgggattgttaataccatggttgaagttcaactgatgcagaaaaactctgacaatgccactctggatggtgttacacataccaattcagagattgctgttgaaagctatttttcagttatggatgcaaaaagtgagtcgagcagcagtaaccagacttccgagattggttcagtgattaatttggaggagagagactctactgtggctgttatccaggacacaaatgcgtctgaattgccaaatacagaggttactggcaaactgcaggaatcaaagaaagcgagtgtttcagattcatcagaaagcatagaagatcgacgcaaacaaaaatctgatacaatttctgtgaaagaacaagaccaacttgaggaggctcagggattgttaaaaagtgctgtcaagactggccagtcaaaagaagctaggttagctcgggtttgtgctggactttcatcccgcctccaagagtataagtctgaaaatgcacagctggaggaacttcttgttcaagagagagagaaatctacatcgcatgaagctcatataaagcaactacagcaagagctatcaatgtccagagtagaaggttcaagagccgaatcgaatatggttgatgctttgactgcaaaaaatgcagagattgaatctcttgtcaaatcattggactcttggaagaaaagagcagcagcttcagaagaaaagcttgcttctttagaggaagatatggatggtctcaagaggaaccgggaacttactgaaaccagggttatacaggctttacgggaggaacttgctaccgcagagcgtagggctgaagaagagcgcatttctcataatgccacaaagatggcagctgttgagagagaagtagaactagaacatcgagctgttgaggcatcaaatgctctagctagaatccagagagctgctgatcaaagctcatcaagagtgctggaattggagcacaaggtggctgtgcttgaggtgcaattgtcttcgctgcaggttgaatgtgcttcattgcaacaagaactacaggagatggaagctcgtaatcgccgcgtacagaaaaaaccttccgaagaagctaatcaagttcttcagatgcaggcttggcaggaagaagttgagcgtgcacgccaaagccaacgagaggcagaggcaaagatatcatccttggaggcagagttgcagaaaatgagagttgaaatggctggaatgagaagagatgcagagcattattctagacaggagcatgttgaacttgagaagagataccgtgagctaactgacttactgtaccacaagcaaacacaattggaatccatggccagcgaaaaggctgcgttagagttccaactggagaaatcattgaaacaatttcatgaagtgcagattgaggcagaaaggagtaaagctactcgcagatcagcatcgtcgtgggaagaagatgctgatatcaaggcattagagcctcttcctctacatcatcgacacatggcaacagcaaatcagcagttacaaaaggctgcgaagcttttagacacaggagctgtgcgcgcaacaagatttttgtggcgacatcccgttgcacgagtcagcctgctgttctatttggcacggaccacataacttgagcttcctctatgtttgcacttctctttttttaacccaaattaagacttctttctgactataaatctgctttcgccacaccaggtgttcgtgcatttgttcttgatgcacttgttaaaccgccttcaggacttcagcacttcgcgtccagagaaggaacatcagccatgggggatctggccagcgcgaacctgccatagcccatagtctctgtgcccttcttgttgattcaggcattccccactgattcttggtccacatgccttcaaagtttcatttcatcctcctgtttctttttttttccgtcttccccatcttttgtaaagtagtagtgttcgttgtttggccatgcgctgtataatccattcttttacattgactgatgagtcagattgagtatgtaccaagtaccttgacatgatataccaagccaattgagcccaattgagccagttcttgt

SEQ ID NO: 23791 - DNA, 2612 bp, Zea mays
  misc_feature (3)..(3): n is a, c, g, or t
  misc_feature (10)..(14): n is a, c, g, or t
  misc_feature (17)..(23): n is a, c, g, or t
  misc_feature (28)..(31): n is a, c, g, or t
  misc_feature (39)..(49): n is a, c, g, or t
  misc_feature (51)..(54): n is a, c, g, or t
  misc_feature (71)..(71): n is a, c, g, or t
  misc_feature (74)..(76): n is a, c, g, or t
  misc_feature (80)..(81): n is a, c, g, or t
  misc_feature (83)..(83): n is a, c, g, or t
  misc_feature (88)..(91): n is a, c, g, or t
  misc_feature (97)..(100): n is a, c, g, or t
  misc_feature (103)..(109): n is a, c, g, or t
  misc_feature (114)..(117): n is a, c, g, or t
  misc_feature (126)..(127): n is a, c, g, or t
  misc_feature (133)..(135): n is a, c, g, or t
  misc_feature (151)..(152): n is a, c, g, or t
  misc_feature (155)..(158): n is a, c, g, or t
  misc_feature (163)..(164): n is a, c, g, or t
  misc_feature (169)..(174): n is a, c, g, or t
  misc_feature (180)..(180): n is a, c, g, or t
  misc_feature (187)..(187): n is a, c, g, or t
  misc_feature (191)..(196): n is a, c, g, or t
  misc_feature (204)..(207): n is a, c, g, or t
  misc_feature (209)..(209): n is a, c, g, or t
  misc_feature (212)..(213): n is a, c, g, or t
  misc_feature (218)..(221): n is a, c, g, or t
  misc_feature (227)..(227): n is a, c, g, or t
  misc_feature (233)..(248): n is a, c, g, or t
  misc_feature (259)..(262): n is a, c, g, or t
  misc_feature (272)..(273): n is a, c, g, or t
  misc_feature (276)..(278): n is a, c, g, or t
  misc_feature (283)..(288): n is a, c, g, or t
  misc_feature (290)..(292): n is a, c, g, or t
  misc_feature (296)..(297): n is a, c, g, or t
  misc_feature (301)..(321): n is a, c, g, or t
  misc_feature (324)..(325): n is a, c, g, or t
  misc_feature (327)..(328): n is a, c, g, or t
  misc_feature (333)..(334): n is a, c, g, or t
  misc_feature (342)..(345): n is a, c, g, or t
  misc_feature (352)..(355): n is a, c, g, or t
  misc_feature (360)..(364): n is a, c, g, or t
  misc_feature (372)..(372): n is a, c, g, or t
  misc_feature (376)..(376): n is a, c, g, or t
  misc_feature (379)..(384): n is a, c, g, or t
  misc_feature (393)..(399): n is a, c, g, or t
  misc_feature (401)..(401): n is a, c, g, or t
  misc_feature (405)..(408): n is a, c, g, or t
  misc_feature (411)..(414): n is a, c, g, or t
  misc_feature (427)..(428): n is a, c, g, or t
  misc_feature (432)..(432): n is a, c, g, or t
  misc_feature (441)..(445): n is a, c, g, or t
  misc_feature (447)..(455): n is a, c, g, or t
  misc_feature (462)..(462): n is a, c, g, or t
  misc_feature (466)..(466): n is a, c, g, or t
  misc_feature (470)..(477): n is a, c, g, or t
  misc_feature (485)..(486): n is a, c, g, or t
  misc_feature (489)..(494): n is a, c, g, or t
  misc_feature (504)..(506): n is a, c, g, or t
  misc_feature (517)..(521): n is a, c, g, or t
  misc_feature (523)..(524): n is a, c, g, or t
  misc_feature (541)..(541): n is a, c, g, or t
  misc_feature (543)..(563): n is a, c, g, or t
  misc_feature (565)..(565): n is a, c, g, or t
  misc_feature (568)..(573): n is a, c, g, or t
ccnccccccnnnnnccnnnnnnnccccnnnncccccccnnnnnnnnnnncnnnnccccccccccccccccnccnnncccnncnccccnnnncccccnnnnccnnnnnnnccccnnnnccccccccnncccccnnncccccccccccccccnnccnnnnccccnnccccnnnnnncccccnccccccncccnnnnnncccccccnnnncnccnnccccnnnncccccncccccnnnnnnnnnnnnnnnnccccccccccnnnncccccccccnnccnnnccccnnnnnncnnncccnncccnnnnnnnnnnnnnnnnnnnnnccnncnnccccnncccccccnnnnccccccnnnnccccnnnnncccccccncccnccnnnnnnccccccccnnnnnnncncccnnnnccnnnnccccccccccccnncccnccccccccnnnnncnnnnnnnnnccccccncccncccnnnnnnnncccccccnnccnnnnnncccccccccnnnccccccccccnnnnncnnccccccccccccccccncnnnnnnnnnnnnnnnnnnnnncnccnnnnnncccccccccccccccccccccatttgggtgtgggatcagaccgcgatgaccttgtactccctgtgcggctcgtcgacgttgctccagcactggcgatggagccgggcttgccgcgcctggtggttctcgtccgcccacggcccccgattagcatgagcctccgcgccagtatcattggtcttcctaatgttggcaagtcaaacctcttcaacgccattgttgtgcgatgctttgaggatgacgatatagttcatgtcaatggaagggtcgagcccggatcagacattgatgtcattaacctagagctgatattttcagatctttaacaggtaatttggtcaacggatttcactttgtcttgctatcacgcatttcaaaagaaacttctttgctacctgtgtaataaccgtagatagagaagaggttagataagcttaacaagagcgatacacaagtaaaagtgaaggtaagacatacaaattctttcgttctgatgacctttttgttctatgtgctaattgattgcaccacttaggaacaagcagagaaatcaggattggaaaaaattcagtaggcacttatggaaggaaagcctgcaagatcggtcgatttggctgagcatgagaaagaagttataaaacatctttatctgctaactatgaaacctgtcatttctgttgctaatgtaatagaatctgatcttgctgaacctgatatcaatcctcgtgtcaaagaggtggctaaagcagcatcatatttgcagtatggtatggttacaatactagctcaggtttgttgtatacatcgaagtacaagaacctttgaagaaatttctgctaaataattttatattttttatgttgcctacccatatgtgtccacctatgctaacaaaatcatggaatgtataaaaagattgaaactgaactcgctgagctaccattggaagagagagtagagtatttaaaatctcttggtgttgctgaaagtggactaggaaatttggtaaaagcaacatataatctattggggttaagaacttatttcacaaccggagacaaggtgcatcatttgtgctgttaaagttttttccccgtcagttaaaagaaactgacagacctttaactgtgtccttttaggaaacaaaagctcagactattttttcaggcccttcttcctcacaattatttctactgtaatatttgaagaggtttttgtaatcattataactgcatgtgattctacatataggcgtgactgcgccacaagcagctggagttattcatagcgactttcagaaaggatttattagagttgaaactgtaagctgtacataacgatgagaattgaatgacgaagtttcagatttcggtttacatgttatgatatttctcagatacaatggcaatacttcacctctacggaatttggatataccgttacctgcttttttatgtttgatatttattaatcgtacactcattaataccatacctcaggtatcctacgatgattttgttgcagctggttttcttggagtagcaagggagaaaggactggaaaaatttcaaaaacatcgagtcaagaagttttggcagcactttcatttcatccttattgcagtgcctcgacagtagacataattaagttctgtccatgagtgggatttggggctttggttggcttgcgtgcccactcggtaatcaccatgaagcagaggatggaccgtgtcatctggagcagcaacagcaacagagtgtgggctatccatttgttgtagatgaattatgcgatttacatgcacaattctttgcataaataaaatatagtacacactaattcaactcaattttatctcaattctcatcggtttaatctctggtgacatgttgtactcgtacaatatttagagaagacgagattgtgtgtcattgcaacacacagacattatactatattttattaaaaaaaaaaaaaaaaaaaaaaaaaaaaaaaaaaagaaaaaaaaaaaaaaaaaaactcgagggggggcccggtac

SEQ ID NO: 23792 - DNA, 1719 bp, Zea mays
ggtcttgcgattcaatgatttccgtcggttttcatccctacctaattggctaccccgacttgcacgcgcgcggcgcgggtcacgtgccatttcatctatccatcccgcagctcttgtctctggcaaccgtacgcccaaccgtgttcccgcgccgcccacgaactactctccggcgctgcccatgacgacggtgtcgcgcgcgctcggctccgcgttcgcgggcttcacgcgggcgcccgcggtggcgcagaccgcgacgaccctgccctccccgtacggctcgtcggctctgcaccagcactggcgctggagccgggcctgccgcacccggcggttctcgtccggccgcgcggcacggattagcatgagcctccgcgccggtatcgtcgggcttcctaacgtcggcaagtcaaccctcttcaacgccattgttgaaaacgggaaggcacaagctgcaaactttcccttttgcaccatcagcccaaacgttggtgtggtggctatccctgatcctcgtttgcaggtgctctcaaaattaagcaaatcccagcagacggtcccaacatccattgagcttgtggacattgctggtctagtcaaaggagcaagcaaaggagagggactaggaaatcaattcctttcaaacattcgtgaagtggattccatacttcaggttgtgcgatgctttgaggatgacgatatagttcatgtcaatggcaaggtcgatcccagatcagacattgatgtcattaacctagagctgatattttcagatcttgaacagatagagaagaggctagataagcttaacaagagtaaaacgaaagatacccaagtaaaagtgaaggaacaagcagagaaatcaggattggaaaaaattcagcaggcacttatggaaggaaagcctgcaagatcggtcgatttagctgagcatgagaaagaagctataaaacacctttatctgctaactatgaaacctgtcatttatgttgctaatgtgacagaatctgatcttgctgaacctgatagcaattctcatgtcaaagaggtggctaaagcagcatcagacttgcagtctggtatggttacaatatcagctcaggttgaagctgaactcgccgagctacctctagaagagagagcagaatatttaaaatctcttgggggtgctgaaagtggactaggaaatttggtaaaagcaacacataatctattggggttaagaacttatttcacaaccggagacaaggaaacaaaagcttggactattctttcaggcatgactgcgccacaagcagctggagttattcatagtgacttccagaaaggattcatcagagctgaaactgtatcctatgatgattttgttgcagctggttctcttggagtagcaagggagaaagggctgctgaggttggaagggaaggattatgttgtgcaggaaggatatgtcatgcttttcagattcaacgtgtgacagcaatagtagcaaaaggcttcaaaaacaccggaatttgtactaggcagaatatagtttgcccatattgtgaatttttttttttgccacttgaccaccgagtattcatctaccacgctggtagggcagctttcttagatcaagcctaatactggacagttatcattgttagcttcacctaaaaagtagtaccccgcaccagggaataatttctcggacgaatttcaaaaaaaaaaaaaaaa

SEQ ID NO: 23793 - DNA, 1953 bp, Zea mays
  misc_feature (16)..(17): n is a, c, g, or t
tttttttttttttttnnttttttttttttttttttttttttttttttttttttttttttttttttttttttttttttttttttttttcatccaacggatctatcttcaaacggatttgtgactaggcttactattaaccgtgtgacatccctaaggaacgtcaaggcgactgttcgccatgtatatacataccgatcaatcaatggaattaagccaattcattcattctttgttcttgtctctctacatttaacactaacctaactctagcgatgggatggactttcttatggttttaacgacccggcaattgatcacatcaggggactccaggacatggtgtttggaatgaactgttagcattttgctcttccaaaagacgccaaggtttcaagggtgaactaaccacgtgactccaagacttctctccgtgcagtctgtatcaatgtatgcaagaaagtagaagcatcgcagcatgacggattggtaacagaggcatgtgtcaggaaagggagtttcctcaatgaccggccactaagtccctcacacagttttgcggcttcatacagtagattggatagatgaagcgcaccatggggttctgcagcctcaggacagtgcttcttctccttcagggtcgaatagttcagaatacatggcacactactaccctgaggatatgtaagaataccaactcttaagagttcctgtatgcatgacctcaagatctcgtatcgtgcttgaagcgtagggggtccgacatatgccttaatgtctgccctgtcaacaaatgcaatatctattgctgtagtaatattcgatgttgtcaaaatgataacatttggccaagacttcagtttgtccatttgtgttagcagtgcattcacaactctaatggagtctgaaggttcagagccagatatggcagcttgtctggcagcagcaaggctttcaacttcatctattaatacaaatactaggttgctttcttcctccaccatctcctggatcttctggaaaagtttggcaaccagttttccactttcagaaaaccacttgctgaacaatgaatgagcattgacttcaatcaattgacacatagaataccttgatttgaaccgaatagaaagtttctgtgctagtgctttacacaaggaagtctttcctgttccaggtggaccatgcaaaagtacaatccggttccatgaaaccagacatgtgtccacacctctttcagtaaaaagcaaagcactgacagcatatctcagcaacctctgcttgagaccaacttcatatagtaaactttcccacagaccatcaaattctttggccggtaaggcccactcattaaagctagagagtgtatcatcctcgcttggttcctcacctggaccatcttcactcagctggaacacatgcacaacaggcttgacttgccaaaataagagaactttgtgattctcaacccactcatcagtatcacttatttgtatccttttgacattttcaagaagaaaagaattatcggcaggaattggcacaggcccatcaacatagcttaagcttcgagcttcgagcatcctctcgaccgccacctggacgtcctcgtggcgagctacgctcgtggcgtgcaacagtacctcaactgacacgaggaccttatcgtcggccggggaaggagcaaccacggccgcagccgcagctgtctgctgcatcggctgcgaggaggagactgcggcgacagggggcagcatctgcgcggcggcaggttccagcagcggggaagcgtcggcggtagacgctgcgtccggagggggtgggggcgcagtgaaggagatctccataggggcgctcatggttttgcggagcgagatttttctagggtttgcggtattgaggaatggagaaggttgtggactggaaacggagaagatgattttgagagtttcccgc

SEQ ID NO: 23794 - DNA, 1594 bp, Zea mays
ggggggttccctaaatcatttttttggaaaaaacataaaaacatgtctccaactgttaccctaaagttcttccttatcataactagaactgtttctacctctaagttctagactgaactgttagtattgctgttttatatacagaatgtcttctagaatccaaagaggcatgacttcccccagcaacaccactacagcaggttgcaggagaccagcaatgtgttaatcacagagatgcagccgtgtctgtgtgtgtgtgtgccctcacctatcacctgcaagttgctgctacatgggggaaacctttcccgtatgtcagcctgcagcagatctcaaaactctgaaatgagttttgcggcgagcaacggacatgaccaggatgccttgggacaggaaccatagctgagaattctgacaataattatcgggcaggagaatagctcagactttcgtcagtatttctgcaccgtccctagtcaccagtatggtatgctcaaactgcgcagcccagctaccatcagcagtgacagtcgtccatccatcttcccatgtaacacactctgttttctccattgtgagtataggttcaattgtaaatgtttggccctcaaccatacgccctgagttttcgttggcatgatgtaggataagtggctcagaatgatacatagttccaatcccatggccaacaaagcgttccaccacataatagccataaaaataggcaagcttgcttattttcttgccaatctttctgtagttcacaccatccctgcagatagaaatgcctttctccaagcattcttcagctgcattgagaaaatgtttgatagaatcatcaacttgtccacatgcaaatgttctggaggtacccccatggtatccattcaggaacacatttacatcaatatttagacccacccgtccccggacccgtggtgaatcaggtaccccatgacagacacactcatttactgatgtacatatacttttaggaaatccatgatagccaagtggagaaggataagcaccagcctcaatgatcatattatggactgctgcgtcaatttcatttgtagtaatggatggcttaactaaagtcccagcgaagtcaagaacacgggcagcaagtttgcaagcagctctcattccagtaattccttgagcatcatgtaattggcccttgcatagttcaggcaatcctttcgcaccaacataagatggtcttggaatgtgccctggtacaggaagttgtggggagacctttccacgcctcaaaggtggccttttctttgattttactgaactttgctcttgtgacttttgtatctccataagctcatcttccacccatgcaagcctgcttgatacaatgaagcatcgctttggcacaacgaacttgccggagcggacggggcggagaggggcagcgagaggccggaaccttccggccacgaaggtggcggaggggcgcgctcccagtccagcagccatggggagagggatacaggccgccggcgtgagggaggaacggaggtgtgtgtgtgtattggaggttttgtcgaagcgaagggaaagggataagcgggcccac

SEQ ID NO: 23795 - DNA, 736 bp, Zea mays
  misc_feature (733)..(733): n is a, c, g, or t
ttcgtcctttttctttttttaggagatgtttttattagagcatttccaagagctccctataagtcttttctaaatcattttttttttgaaaaacataaaaatgtgtctccaactgttcccctaaagtgcttccgtatcataacaataacagtttctacttctaggttctagactgaactgttaggagtgctgttttatatacagaatgtcttctagaatccaaaggcacagcaacaccactacagcaggctgcaggagaccagtaatgtgttaatcacagagatgcagccgtgtctctgtgtgtgtgtgtgccctcacctatcacctgcaagttgctgctacatgggggaaacctttcccgtatgtcggcctgcagcagatctcaaaactctgaaatgagtattgcgacgagcaacggacatgaccaggatgacttgggacaggaaccatagctgagagttctgacaagaattatggggcaggagaatagctcagactttcgtcagtatttctgcaccatccctagtcaccagtatggtatgctcaaactgcgcagcccagctaccatcagcagtgacagtcgtccatccatcttcccatgtaacacactctgttttctccattgtgagtatagggttcaattgtaaatgtttggccctcaaccatacgcctgagttttcgttggcatgatgtaggataagtggctcagatcaggacgcgtgggcggacgcgnccg

SEQ ID NO: 23796 - DNA, 872 bp, Zea mays
taaaaataggcaagcttgcttattttcttgccaatctttctgtagttcacaccatccctgcagatagaaatgcctttctccaagcattcttcagctgcattgagaaaatgtttgatagaatcatcaacttgtccacatgcaaatgttctggaggtacccccatggtatccattcaggaacacatttacatcaatatttataatatccccattctgcagctgagttgaatcaggtaccccatgacagacacactcatttactgatgtacatatacttttaggaaatccatgatagccaagtggagaaggataagcaccagcttcaatgatcatattatggactgcttcgtcaatttcatttgtagtaatggatggcttaactaaagtcccagcaaaatcaagaacacgggcagcaagtttgcaagcagctctcattccagcaattccttgagcatcgtgtaattggcccttgcatagttctggcaatccttttgaaccaacataagatggtcttggaatgtgccctggtacaggaagttgtggggagacctttccacgcctcaaaggtggtcttttctttgattttactgaactttgctcttgtgacttttttatctccataagctcatcttccacccatgcaagcctacttgacacagtgaagcatcgcttaggcactacgaattttccggagcggacggggcggagaggggcagcgagaggccggaaccttccggcctcgaaggtggcggaggggcgcgctcccagtccagcagccatggggagagggatacaggccgccggcgtgagggaggaacggaggtgtgttctgggaggctgtcctcccggccccgccgggccccacgcgtccca

SEQ ID NO: 23797 - DNA, 1213 bp, Zea mays
gaatttttttttttttttttgtgaggaaacaatataaggccatccttggacgacattcccaagctaatcccagcactgcacaaatcacgttttcatgtacatgctaacaatgccactaattcagttcctatttgcacaactggagcggtcagtctaaaaataacaatctttgtgtcttaaaacactaacgcttactctctccaacacaaaagaacaatatgtccatacatagttatctagatagaacaacaacaactaattccagagcaagatagccacatgctgctgtttccaatactaatgtctgatgcataattcgttagcgacgttcatcccgtgcctcatcaacgaaacaagcaaaggctagattgttggcactggcatagtacccagcacgtgcaccctaagtgacagttcgccctcttcctcttcctcttcctggaacatgaaagcacacacgtgtcctgcttcgatacggtggctcttcacaaagaggggccatccaccaagaagccttagttctccatggatcattgagaagttgagcttactgccgaccaggtccctgcctgcaaaaactctggtttcacacccataagtgcccagacgaccgaatatgtgtcgcttactgaactgtcttgaaaataccatctgtctcttgacaacattagacttcttcatggtgcaaatgtatgctggaatgccagagccacaggcacgtgacaaaccaagcgcagcttcttcttgcttgggcgtaagtcttgtgcgatcgccataccataagttaggtcccacgacttttgaaaagcaagtactactttgggcttccatcactctttcttgggtggtgaccgctgatctccctgacccgcaaattttatccagagcaaaggcttccataaatatgctagattgcaaatcttttttttgtgacaggaagtagagaagtactcgcgtcgtggaggttcccctcgcactggggatctccccgccaggcgtcgacgagctggatgactccgacgcggcggcgaagtgcgacggacgagggctctgtagcggcgggggtcctacgccgcttgcgaccggttccggaggccttgacggcgcgagggggcggcgggaggtgaacagttgggacttgggagggaccggaatccggatcacgagggttgggcggggaggtccgccccggccggcctcgaggtacccaatg

SEQ ID NO: 23798 - DNA, 1207 bp, Zea mays
ttcagttcctatttgcacaactcgagcggtcagtctaaaaataacaatcttcgtgtctcaaaacactaacgcttactccctccaacacaaaagaacaatatgtccatacatagttatctagatagaacaacaaaacaacctataaggctgtaatctagatagctacatgttgttgtttccaatactaatgtctgatgcataattcgttagcgacgttcatcccgtgcctcatcaacgaaacaagcaaaggctagattgttggcactggcatagtacccagaacgtgcaccctaaggactgatttggtgaccggggatcccgaggggaagaaatcctcttgctattcaaaattgaattgcaagatgattcctccccatggatcccctagggatccctaatcaccaaatcaccaaatcagccctaagtgacagttcgccctcttcctcttcctggaacatgaaagcacagacgtgttctgcttcgatacggtggctcttcacaaagaggggccatccaccaagaagccttagtcctccatggatcattgagaagttgagcttactgccgaacaggtccctgcctgcaaaaactctggtttcacacccataagtgcccagacgaccgaatatgtgtcgcttactgaactgtcttgaaaataccatctgtctcttgacaacattagacttcttcatggtgcaaatgtatgctggaatgccagagccacaggcacgtgacaaaccaagcgcagcttcttcttgcttgggtgtaagtcttgtgcgatcgccataccataggttaggtcccacaacttttgaaaagcaagtactactttgggcttccatcactctttcttgggtggtgaccgctgatctccctgacccgcaaattttatccggagcaaaggcttccataaatatgctagattgcaaatctttttttgtgacaggaagtagagaagtactcgcgtcgtggaggttcccctcgcactggggatctccccgccaggcgtcgacgagctggatgactccgacgcggcggcgaagtgcgacggacgagggctctgtagcggcgggggtcctacgccgcttgtgaccggttccggaggccttgacggcgcgagggggcggcgggaggtgaacagttgcccgccggggggggccaccggatcccgataacgacagtcgggcggggtgggtcccccggccgg

SEQ ID NO: 23799 - DNA, 1840 bp, Zea mays
aacaaacaatcttctaaaccaacataggcacggaaaatccaatcagggaaaaaatccatttccctttcttctgaagtcgtcctcttcttcccgtcgcttcgccgtgccgcacctgcgaggagaggagacttcgccgcgaagctcaccatgatctcgccggagaggagctcgtcacagagccagcggtcggcggcggcgggggcgccgttcctgtcgatctccgtcacggatcccgtaaagatgggtaccggcgtgcagtcctacatctcctaccgcgtcatcaccaagaccaacctccctgaatttgagggaccagagaaaattgttattcggcgctatagtgattttgaatggttgcatgatcggcttgctgagaggtacaaaggcatttttataccccctcttccggagaagaatgctgttgagaaattccggtttagcaaggagttcattgaattgcggcgtcaagctctggatttattcgttaacaggatagcttcacaccctgaactcaagcaaagtgatgtcttgaggacatttttgcaagcagatgaagagataatggatagggcaagatcttatgagactggtatttttaagaaaccggcagatttcatacagatgtttaaggatgtgcagtcaaaagtcagtgatgttgttctgggaaaagaaaagcctgtggaggaatctactcctgaatatgagaagcttaaaaattacatatttgagctagaaaatcatttagcagaggcccaaaaacaagcataccgtcttgtgaaaagacacagagaacttggtcaatctttggcggactttggaaaggcgattaagcatttaggtgcttgtgaaggagatttgatggaaaaggtgttttctgaagttggttcgaagtcagagatgttgtcaataaagctgcaaagagaggcagacaaccttctctttaactttgaagaacccttgaaagattatgtgcgtgctgtacaatctataaaagccactatgcttgatcgagccaatgctttcaggcagcacttcgatttggatcaggagaggaagtataaagagcttaatcttgaaaaattgaagttcatgaaccctgaaaagtatgccgaagcagaatctgagtttcgagagttgaaagcagacagtgaggaggctactaagaagtttgaacacatagttagactaatgaatgaagagcttgctcgtttccaggagcaaaagacagctgatattggactcgcattccatgaatttgccaagggtcaggctaagctagctaaagacattgcggatgcatggcgcagcgtcctcccaaagctcgaagcttgttccacatcataaatgtgatttgtgtttcctcatgatgtttgggaatgggatagggggttggcagctggtgagtttaggctgttttttcccagcctgttttgacactgattactgtatacttgaactgcggtttggaaatgctccagctgttaggttcagttgacgtcatttcttgctgtttgagcttttaaccgtcttcttttcttagatcaactgaaatagctactggaatctcgtgatattgataatcaatgatgtaccatgatgctacttcctggtaaaaaaaaaaaaaaaatttttttcctgaagtgttcaagcgagaaatagatagcaggatttagagggctcttaagtcttaaagcatctatataagagaggctctaaacgtgaccctattttaaatatagggtttagaaacataaaacactttttcaagagcggctctattttaaaatttcataaaaaattatagggctcggtctttcgagttctaaatatagtactccat

SEQ ID NO: 23800 - DNA, 1743 bp, Zea mays
aatccggagctccaatccctaacaaccgaacagggcctaaacaaaaataaaatccaatcgagggggaaaataatccttttcccgttcttctgaagccgtcctcttcttcccgtcgcttcgccgtcccgcaccagggaggagaggaggcttcgccgcgaagctcgccatgatctcgccggagaggagttcgtcacagagcccgcggtcgcaggcggtggcgggggcgccattcctgtggatatccgtcatggatcccgtcaagatgggcaccggcgtgcaggcctacatctcctaccgcgtcatcaccaagaccaacctccctgaatttgagggaccagagaaaattgttattcgacgctatagtgattttgaatggttgcatgatcggcttgctgagaggtacaaaggcgtttttatacctccccttccagagaagaatgctgttgagaaattccggtttagcaaggagttcattgaattgcgtcgtcaagctttggatttatttgttaacaggatagcttcacaccctgaactcaagcaaagtgatgtcttgaggacatttttgcaggcagatgaagagataatggatagggcaagatcttatgagaccggtatttttaagaaaccatcagattttttacagatgtttaaggacgtacagtcaaaagtcagtgatgttgttctgggaaaagaaaagcccgtggaggaatctactcctgaatatgagaagcttaaaagttacatatttgagctagaaattcatttagcagaggcccaaaaacaagcataccgtcttgtgaaaagacacagagaacttggacaatctttggcggacttcggaaaggcgattaagcttttgggctcttgtgaaggagatttgatggaaaaggtgttttctgaagttggttcaaagtcagagatgttgtcaataaagctgcaaagagaggcagacaaccttctctttaactttgaagaacccttgaaagattatgtgcgtgctctacaatctataaaagccactatgctggatcgagctaatgctttcaggcagcactttgatttggatcaggagaggaagtataaagagcttaatcttgaaaaattgaagttcatgaaccctgagaagtatgccgaagcagaatctgagtttagagggttgaaagcagacagtgaggaggccacgaagaagtttgaacacatagtaagactaatgaacgaagagctctctcgtttccaggagcagaaaacagctgacattggactcgcattccatgaatttgccaagggtcaggcaaagctagctaaggacattgcggatgcatggcgcagcgtcctcccaaagctcgaagcttgttccacatcataaagtgtgatccgtgtttcctcatgatgtttgggaaggggttggtagctggtgaggtttagggcttgttcggttagctctcaatccatgtggattgagtgggattggatgggtttaaaacccaaacaagtcaaaactcttctcatttttttccaatcctatccaatccatgtgttttgggaataaccgaacaagcccttaggctgtttttttttccagcctgttttgacacggattcctgtatacttgaactgcgggttggaaatgtaccagctgttagattcagttgacataatttcttgctgtttgagcctgtaaccatcatctcttcttagatcaattgacacaactgctggaatcgcgtaaaaaaaaaaaaaaaa

SEQ ID NO: 23801 - DNA, 2623 bp, Zea mays
  misc_feature (1605)..(1605): n is a, c, g, or t
  misc_feature (1898)..(1898): n is a, c, g, or t
gaaatagcttggagctaagtcagaggagtgctgctgctggactaaggtgtgagctctattgaggtttaacagaacagatccatgttgtttttgtgttgctttggtaatttattgaagaacatttcccttttcatcaaaggccgattggagcagtggtcttcatgcaacggggtgtcctgaaggtttgcttgaggactactgacagtatagttaatacatcagagattgcaaaggtgtgccaccatcgtaattatgttctttttaactatgcatggccttttagttggatatgatcgttcatctctgccacatcataaaaatgtaggcatatggcggaggtggaaaacgaagttcgagttcattcactctaagaatggatgagttcaacatctggacttcagtgaactcatgaattgaactggagaggtcacatagtgttcatactgtgggaactcgcaaccagctcatctgggcatggatcccctcagtggtgaacatgtgaagatggggtggtctttttgtgctccggtatgagaggaaggaaaaaaaatcttagtctaacctaccatgttgatatgagcttacaggagaataatctcttcgatatgaatgactagagagcaatttggaggcataatgcttaagccgttcaagagaagatttgcggccgcgtgggggaaggtttgctggtacatcaaaagacgtattttatgctctttctaatctttctccagtagacctatgtgcttaattttagagatgataagggtggtgcgggccgaagatctgtcatactcctaggggccaattatagcttacacttatgttgttattagttttgaatgctgaacatacatggagatgcgtagctcagctcagcttggatataacttggtttctatccaaactaatactttgctccgtagggaatgcatctggcaacggaaattgttgtcaagctccagtagcagaaaggatcatcttcaattattgtaatcctgctccttaataatacattcttggatcttgctctgggcttaaaaaatctgcatctccaaattgttcctcgttgcgaacaattatgtaatacagaaccttagaaactggaaatgtttattccattccggtaatttgggaatgatctgtgttaaaatcctttttaagtgccataccacgcactatttttctgttcctcaactctatcgatcccagaacctatttctgttaactggttactaaggacatgtacaatatcttaagagcttgtttggttattgtcgtttcatgtggatggattggataggattaatatagattttaacttattacagatttaaactgactcaataccattcaatctatatggaaaacgaacctatcgtggagagtatctaagagagcaagtgtaaaaaaacacaagagacatatcgtagcgaaggaacgtctttaatacggttctctaagtctaaatacggttaaaatcgtacaacctatgtaaataagtcatattttgagggtttttaatgattaagatacatggtttagatatattggtcgtatgaatgagtttttaggtgtattagtgcttggagaatcgcaacgtantatctaggttgtatatacctagcacacaacaaacagatcccagtcgttgtgtgcaagggacttgccccttgtacgatcatgcgcactcagacaactagcaaacggacgtgaccacatcgtggagaatagatgtgacctgacggctgcctcctcttcgttctcttcacttgtatttatatttatatgttctagcaataaagaaactctcggttctcatttccttacactattcaaacagttcaaatacgtcattagcacttgctttcaccatggaaaggccacaagactgaagnagactccgacgaacttcaaagaaagatatgaaagaaggaaccatcgggtacgtaatgatctacaaaggtctctctattgcccttctcaccttcatcattcagttgttgaacgatggccatcgtcatcggcgaggtggtgatgtcgtcacaggccgacttctgcgtgctatacatcgatgccgccataccaaaaggcaccaaaagaacaccgctcgggccacacttgaccctgagcgcgttcttcggaccagcggtgatcccggcgtgggccctagtaacgctgcaccgacatctccaactcaagcattcgtaccattgcaaacatcacgccaagactggtgggtgcacctgtcgtcgccttcgccggagcgggagcagttgcgggagtcgagacccaacaactactctgtccgatgcggtactgcccctccatggatggggtcgtgccctactcaccaaacgcggacttcatcagaagaagacacctccgctgtcgttgttcgattgagcggactgctcgtccaagtctcctctcctgtgcgccctcatgcctaaacacggctaactacgcggaagtcgaccgaccctcgcggtcgttccaccggccagatcgctccatctttggtgtccatcgacaacctcttcctcctccgacgatgagaggatcatcttagtactcgacaatggggtaccgcaggggctgcctacttcaacccctgacgccg

SEQ ID NO: 23802 - DNA, 1248 bp, Zea mays
atatacctgtcactcacgctaccgccgtgaccgatcatctctcactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccgtcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctaccagaggtgcgggacggagatggtggccagcatgctcgtgacggagatgtccagcccgctgctgcacctgcgggagatgctcaaggagctgggcgtgcgggacacggagctgaacctcctcgtcgacgtgctcttcgccgccaccttctccgccgcccggatgggcgtcgggccgtacctcacctacgtcaccgtgacggccgacaaccccatcctcatcaaggcgatggcgacggggctgcagctggtgagcgcctactggttcctgcggatcctccggatggtcaggtacaagctcgccggcaagaagaagccgacgccggccaagctcgccgccgccgccgccaactgacgtaataagcgccggcgacgaccttcacgagctacgcacatttatgataccgggagttggattcgacagaggccgtgctgtacatatagtacaaatacacacacacgcccgcctctgaagcaatgcaatgcaatgcaatttctccactgccaaggatgtgtctgtcatctctcatcaaccaagtgtcggtgcgtaccaactgtacgcgcgttgctagcgcaaaaagaaaagaaaaaaaagaaagaaaaaaatcgttcaatgagtcctgttgaatgtggcggcactttaactgcaaactgctgtgagtgcgccaaaacgattgatggtgatgaatgatgatgatgatgtgcagcactgtgaccacgtcaacctttcacc

SEQ ID NO: 23803 - DNA, 800 bp, Zea mays
gccggccggttcgcagtctgtatacctgtcactcacgctaccgccgtgaccgatcatctcccactctctcgtcagatcctctcggctagctagctagctaggacagaggagggaggggaaggcgctggctatggcgactgcggcggcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccctcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctatcagaggtgcgcgaacgtacatgctttccctcttttcccccattcacatgcccacccttttccttccctcgccccagttgcttttcgctttgtccttgccttttctttccctaactccccccctacatgttttttcgtttacccccctccctttcccctttttgccttttcccccccttttccccttcttttctccccctctttccccctttctattcccttccctcccccttttttccacctccccccccttcctcttcccc

SEQ ID NO: 23804 - DNA, 1198 bp, Zea mays
gggtacctcgagggcgtcggtatacctgtcactcacgctaccgccgtgaccgatcatctcccactctctcgtcagatcctctcggctagctagctagctagctaggacagaggagggaggggaaggcgctggctatggcgactgcggcggcggcggcggccatggaggagccggacgtcgtcaacggccgcgacgtggtgagctgggtggcgtccggggtggtgctgtggtcgaccgccttcttgctggtgcgggcgctgttccccaagcgctcctacgacttctgcaaccgcgccgtctccaccatgcacgccgtcgccgccgtgtgcctcgcctgcctctccgtcgacgactggtcgtgccccgtctgcccgctcgccgccgcatcctcccctcgccagatgaaggcgctggcggttacgctggcgtacatggtgtacgacgcggcgtgctgccacctcaacggcgacacgcggctggacaacgccgtgcaccacctggtcagcatcgtcggcatcggcgcggggctcgcctaccagaggtgcgggacggagatggtggccagcatgctcgtgacggagatgtccagcccgctgctgcacctgcgggagatgctcaaggagctgggcgtgcgggacacggagctgaacctcctcgtcgacgtgctcttcgccgccaccttctccgccgcccgggatgggcgtcgggccgtacctcacctacgtcaccgtgacggccgacaaccccatcctcatcaaggcgatggcgacggggctgcagctggtgagcgcctactggttcctgcggatcctcaagacggtcaggtactggtcaggtacaagctcgccggcaagaagaagccgacgccggccaagctcgccgccgccgccgccaactgacgtaataagcgccggcgacgaccttcacgagctacgcacatttatgataccgggagttggattcgacagaggccgtgctgtacatatagtacaaatacacacacacgcccgcctctgaagcaatgcaatgcaatgcaatgcaatttctccactgccaaggatgtgtctgtcatctctcatcaaccaagtgtcggtgcgtaccaactgtacgcgcagttgctagcgcaaaaagaaaagaaaaaaaagaaagaaaaaaatcgttcaatgagtcctgttgaatgtggcggcactttaactgc

SEQ ID NO: 23805 - DNA, 1250 bp, Zea mays
actttactgttgcatcctacacaggaaattaacagtctgaaataggtcgggaaaggaaagaaaggaacagcccaatctcactgtcacccaaaactggcgatatgatcgatccaagggtaattttgtcattccttcatccccgtatagccgtatatttttcttctccggcagccatagcctgggaagaccattgggtacctcgaggccggccgggacactacaaacgcattaagctcttagctagccctagccacgtacccacacatcgtagacaacgcaattagctaggaatagcatccatggcgtccggggctgctgcttcctcggccctcttgctcctcgtcgcggccttggtggccaccagtgcgagggcggccacattcaccatcaccaacaactgcggctcgacggtgtggccggcggccaccccggtgggcggcggcacgcagcttgaccccgggcagacgtggaccgtggacgtgccggcggggacccagtccggcagggtgtgggggcgcacggggtgctccttcaacggcggcagcgggagctgccagacgggcgactgcggcggcgcactctcctgcacgctctcggggcagcctcccatgacgctggccgagttcaccatcggcggcggcggcagccaggacttctacgacatctcggtgatcgacggctacaacctggccatgctcttctcgtgcagcaccggcgtgaccctcaactgcggcgggcccagctgcccagacgcctacctgtttcccagcgacaacaccaagacccatgcctgcagcggcaacagcaactaccaggtcaccttctgcccgtgagatcgcgcgtgcgaggcaggcggcagtgtggccggacgacgatgcaatatgcaatgcatgctccagccaacttctttctttgcgaataataagtatgttgtttgtcctagtttgttattagtggagaaattaaaaaagtagacaatcgaataagacgatgatgttcaccccatagattatgtaacttcgatgagtttgatctatatatatgtgcttgcaaaacaaaaaaaaaaaaaaaaaaccgcagccctttccgtttaatgcatgtaggtctgtaaaaaaagttcaagcttgacgagacggcttggtctggctgcaggtcagcatggctcaacgcttaggacgcgccaactgttcggtcgcgagctagatcgtggctcaatttaataataatttattattatataaatttctaat

SEQ ID NO: 23806 - DNA, 1002 bp, Zea mays
cgccaagcgcgcaattaaccctcactaaagggaacaaaagctggagctccaccgcggtggcggccgctctagaactagtggatcccccgggctgcaggaattcgcacgagaccattacctagaacatcctaatcgaaaaaaaaactaacaggtccaaacggcccattattaacctaggcaggcagagcagcagaggagattcctttccctttccgttagcaggatagagagggagaggagcagaagatagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtattggcttgatatcagtctatattatcatttattatggttaaaaaaaaaaaaataaaaaaaaaaaaagaccataagcccaagccgcctgttctctgttaacctagcggaaatctgcc

SEQ ID NO: 23807 - DNA, 873 bp, Zea mays
agattcctttccctttccgttagcaggatagagagggagaggagcagaagatagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaaggctcatcctgcacaagaaaatgctcaatgtttgcatgctttgcatcaagagtagatcatcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtattggcttgatatcagtctatattatcatttattatggttggtccttcgggtttggtaactgtatcttcaaaccgtgtgttctctgttaacccagcggaaatctgccaaagctagtgttgttttt

SEQ ID NO: 23808 - DNA, 4576 bp, Zea mays
tcgatagtcacagttgttgaatttttgcagtttgtcactatttctgagccggtgaatgctattgcgtttgggtctactatggtgtttggctgatccagtattgtgcaagtgaatcatcatcggacgttgcaaatttgcgacgacgtgatgtgatgatgacttttaaccacgggatctgggcaaagagaggaggatatgacataaaatgggctagggcccatagagaaaaaaactaacaggtccaaacggcccattattaacctaggcaggcagagcagcagaggagattcctttccctttccgttagcaggatagagagggagaggagcagaagatagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtatttgcaacggggatttttacctacaatccctaaccccttgttaatattcacatggcacagcctacagtccctagaatgggaccgcagtttcctgcatatagaggctgtttatttcagcgtttacagcccgccatccattcacagcgttgctgttgcccgtcctcgaccaaacagcaccatagtagccattgcttaaactgagttcatatcttcgtatataactaaactgtaattttttttcattttaatagtttcagcgttgaggaagacaattagataactcaaagtatgagactgcatccctattgtctatatagaactgatatactgaccattgcaaccatgcagtacaagaaatgccaaaccatttacctaccatctacactatcctgacaatttgctcagtcattgatgaaaatttatgttcacagtttttctggactagatttctatcagccagcaacccctagtgcataacattcttcagcgctaatatcaagtaggctgttaaatatgtagaccataggctgcatgtgcttttcctttatgttaccttagtactacatccatcaattttacatatagatcaaatttggctgctcatgttcgtcggtactttgtgttagtgttccgcaggcagctccttagctatgtagttcagtacccaaattctcatgccccgtacttgaggtcacatgttttcatcttctgttacctgtgtagcccatttagtgttagtcaggtagctgctttgctactaccaagtacaaaagaaattcgtggaatcatggtaccgatgaacactgtttgaattcctggttgttgacctgtggtgctaggccaaaattactgcacatgagcttttattgtttcccctgatcttgacctatttggggtaaagcagtttctctttgagtactatcctcttgaggaactaacttgaacggttatcctcccacagtacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaaggtaagcgcagccagtatctcttgttcgagtgatctcgctcattttgaaccttcccccaatgttctcatattaattttgctgtttgttaggctcatcctgcacaagaaaatgctcaatgtttgcatgctttgcatcaagagtagatcatgtaaataaccacctgttgtttcatcccatcttcttagtttttcatctttcttgcctacctagatggtgctagctaggtattctcagtgtcatgctattcgtcagcactcactgatacattaattctgtgattgatgatgcagcgctcggacttcggttggaacggctccaccttctagacttgaggtctgcagcgggatcctaagagtctcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtattggcttgatatcagtctatattatcatttattatggttggtccttcgggtttggtaactgtatcttcaaaccgtgtgttctctgttaacctagcggaaatctgccaaagctagtgttgtttttactataggcttacagttacaggggatattggctgctaactgaaattcctcttcatagccacactgtttgttgtttcaaacaaatttgctggcctagtagttgtggaatgcattctaggaatgtatgcaaggggaggaaccgaggtaggtttggccacattcaaggaatgatgcaagaactttgttggtgtgctggatgtggatgtttcttctcctagatccaaattgcaagaactttgcagacctgctagctgtaggtagtgacattagacctgcacctactcttgttggcttggttgctgcctaacctggaaaaggagtgctccccagcatcctggccttctgcttcttgttgattgaattgaatttcttcccgtgcatgacaccaaaaataacattgcatctctacctaaccattgctttttagtctaaaaaaacccacaacagtgctgaaattgttcacatatcccatatcaaactgtatgcattttttgtataaaaaaactatacgtactcaaatataaccgacgaattttgtacacaatttgctctcgttcttttctgctgtcacaattattataagccggttgtagttctgagtctaatgaggaactcttgcaggaaccaacaaaaaaaaactgattttagtgctggtttttttttttggcaagaagaaaacgtgcaccgtggtgaaccgttgaccgctgtgtcggtgcggtgcggacctccatttctctattgggtcccgccgcgccggccgcgcccactccgcgtcgtccaggtcctcctcagatccgccaaacccgccgagacagagagatcgccatggccgcggcatcgcctccgctcctccccaccacggtcgtcccggcggccgcagcacccccgacacccgcgcccacggccatatcctccgcggacgccaccgacaccaacccagcggcgatccgggccttcctctcccgcctcctcgacaccacccggcgcgcgctgtcgggcgcccgcccctggtccgagctcgcggaccgctcggctctctcccgcccggagtccctcgccgaggccacgtcccgcttgcgcaagaacctggcctacttccgcgtcaactacgccgccgtggccgcgctgtgcctcgccgcggcgctcctggcgcaccccttctccctggccgcgctgctggcgctgctcgccgcctggtgcctcctctacgtgctccgccccgccgacgcgccccccgtctccgcgttcggccgcaccttctccgaccgcgaggtgctcggaggcctcgccgccgcctccgcgttcgtcgtcttcctcacgtcggtgggctcgctcatcttctccgcgctcgcgctggggaccgccatcgtctgcgcgcacggcgcgtgccgcgtgcccgaggacctcttcctcgacgatgttgaccaggctgccggcggcaccggcaacccgctgctgtcgctcatcgcctccgccaccggaggccgcgtctgatcatgagtctgtaatagatgctatgcttgaggtcactgccattttcttgatcgattattttcgcggaactatttatgcagctcaaaaattatactactatatatagctacggaaagcaacaaatcaaaccatatactggagtttgtttatgtatcatcgagcagaaatatattcttgttattcgtagcattatatttgtatttaaattccccccgggccaataatcagtaaacatcccggaattcggcttcacaaaaaaaaaaaaaaaaaaggccccta

SEQ ID NO: 23809 - DNA, 1501 bp, Zea mays
cggactcgtgggcggacgcgtgggtgcgatatgtgggaaggatattatgctgacgctgattgctagacgctccaggcattatgctggcaccaggtatctaaagaggggtgtgaatgaggagggcagagtagcaaatgatgttgagactgagcaaattgtttatgaaaacatgcttggaccatggcaaataagctctgttgtgcagaacaggggttcaattccactattctcgtcccaggagacatcaaagctgaatcttaagcctgatatcatattgcatgaaaaggacaaaaattatgaggctaccaggcttcattttgaaaatcttaggaagagatatggaaatcctatcatcatcttaaacttgattaagacacttgagaagagaccacgtgaaatcatactccgttgggaatttgacagagcaataaagattattaatagtggtctaccaggtgaagatcatttaagatttttacattgggatcttcataagaactctcaaagcaaaagtacaaatgcccttcaagtgcttttgaaagtggcatttgaagctttgaacttgacagaattcttttattgtcaagtttccccagatcaaagggcaaagggctcccctaatttaagccctacattgaaaattggttttggtcatcatgcgtgtgatgacaaaaattgtggcaatgcagattatgttgatgatcttgatgacatttcccaagaagatacctgtggtagttctgatcctggcaatggaattgcggaagataaatctgaggtcaatggatctgctcaaataaagcctccaaaatttcaaaagggtgtcttacgtacaaactgtatagattgtttggatcgcacaaatgttgctcaatatgcctatggcctagctgctttaggacaccagttacatgcacttggttctgtagaatctccagaagttcatttagactctcctttgtctcgacatttgatgcatttttatgaacgcatgggtgacacacttgctttacagtatggtggttcggctgctcacaataagatattctctgcgaaaagagggcacttgaagtttgccattcaatctcaagagttctttaggacactgcaacggtactacagtaatgcatatatggatgcttacaaacaagctgcgataaacttatttttaggatacttccagccacaggtgggaaaacctgcactttgggagccagaatctggtgatgagcatgtacttgatgacgagacatgtaaattgatgaagagggcaagatcagatggcagcattcttaataaaagcaaaccatcaatatccagtaatggcccaaatggaattttaaacttagcatttactggttcaaaaaatgaagggcagcgtccaaaccggagttctgatacagcctctgacaatggcatgtcaaagtcaaggtatactccgacactgtctcacattaagcatattagctgtgaactagactattacaatggtttctggtga

SEQ ID NO: 23810 - DNA, 1481 bp, Zea mays
cgtaaaagttattttgtattatagattgtacagttcacaagtaatatttgaaataaaagatacaagacagccttactatcgttgtagtgctagtttgcttgttgctgtactctgcttatcgtaatgcctgaaaaggccagctatcttagctagtattatctcgttctcgaataggttctcgaatatttgtcaactatttgtcaactgctagtttatttttaaactaaaaagcgacgaataaaaaagacagagggaatatcacgcaacatgagtctccatcaacgtagctcaaacggaacagaatagaatgggaaactggggctccaaaatctggccaggcgcacttccgcctcgtgccatagggaaatgatcacgatgccaagagctttcgttcatcctctcacctacgggtattcctctcagctagaaccgattttgttttctccagaacagcaaagaagatcgacccgccaatgccaatccatagtacccttggctcgatacccttcaaaaatgcgccagcaccttcctctcgcatgatagtttgagcacagtcaatgaatcctctatattggtttgtttgtccctgaatcatcaatcttgtcttcatgacatcgaggggtgtggttaaagcgccagtaatggcaccagcaaaagcaccaataattgcagtctctgtgtcgtgcaactccctcttagccgttaatcgataaccaattcggagttgctcatatatgcaaaattgaatggcatcaaatggcagatctcgcaggagaaaggaaccatagccagcataaagacctttaattccttcttgagcaaggataaggcgaacggcatccccggcagtcgggcccggactcctggccaccctttgtttaaccacctccgtgggaacacgaatgagagaagaagcagcccctccaattgctcctgcagtcaaatgagcaatagcgctcaaatttttaggaaacaattccagtagttttcttttagctggttcatatactccaacaaaaattgcagaagcgggaagaacaccgacaatatttccagctaacccatcatacatgcctttccattgaattttacttccgccttgtgcagcctgaagcctggtctttattgtatcaataggatataaagctgtttcaacaacaacaccagcagctcctccagccaaggccccctcaaaaaggacttggaggagatcgcacgattccccatttccacctccgcccatgcgcttgtcaagacttctctgcacggttcagtcggcaattacaaaattcgatgcaagaaaagagaggagatgccagcagattttgctgagtcgcccaccccttgtagatgctccaagatgcacaagaaatcgatcctgacggcaccgaatctggcggtggaaatgggggtggcggggatttgcgagaaaatgggtattggggagggttttgccgccaggctgtcaaaggttttttagc

SEQ ID NO: 23811 - DNA, 3366 bp, Zea mays
ctcatattattagcggataaaaggccaaaaaataatctaaaataaacacttaatgacatgcttatatattatcataatctagatatctagattatataatccaccataataatctaccataataatctatgatgtttatttgtctattaactttggattatataatctagaggttaaacaaacaaggcaataatatcatgacttacactgctgagctagcaactatcatgacttacactgctgagctagcaaccactggcagaacagagtggaaaagaacaaacaccagactatatataaacatgctttttggtttgtacgatttttttttttttttcgataaatactgagatatattcctttgcagaactgttgggaattgcatactataatttactgcgactttgcagggaagtaattaaaacacttttgacggcaaacatgttgtacctttaagtcggaaccaaaaaaaagaaaagaaaatctaaagcaacctatgtgaaaatcctcatgaaactcagacatcttgcaggctgactagtctcagcattttagacccatcacgaaactcccatgtacccccacttttacagagcgatgacgaccggcaagccaaatggagttctcctggtcattcgagttactgagaaaccatcaccccagattctgcgagtagtacactggcgggttcatgtaaccggctcgagactgcacgaagaacgggtttggcatgtaaggactggcgacttccgtttggcttccttgactcgacgaattgacgccgaccattgagccaacgtttgcgtacacgagcatggacccaacagcccccctctcccttggcaaaactgggctctgcggtggaaagcagtagaacggacggggtggcatgttgtttggtactaccggaagtggtggaggcggagcaggggggaacagcatgctaccttgtggctcacttctgcgctcaggagagtcgttgatcacgatcacttctttcatcatgtaggttgggcgatgcatggcaggcatgatgtttctgtagggcttctgctgggagtgatggtcagattgcatcacagaaccaccacgcaatggaggagcaacgaagccgctagcttgaacacttggtagagggatctggtggctggctgtggtcggcggcatgttgataaatgcagaattactgagatgttggtagtttggaggcatgaaaccaacaggtgctggataattccctctcaagatgtagtctgaacttggtgcttgaggatgcacactctcttcactgttcatcaccatcaaatccttacccatcagcctcaagacaggatttgatggtgaaggaagctgagtttggaatgaggggcttatacagtctgtggagtaagggaagctgatagcagattccgctgggaccttagccgctaaaagatgatcacgtggatcaaagcaagggttgggctttgcgctggttctttggtacgtgctgaaagatgatgatgccctcgaaccaatgtgcaattgcggaacctgcttcccagtagaattcagcattggtctggcaacaggactttgacgagactctctggcaatgttttcctggcaagaacaacgaaaaggcttctcactgggcagttcaccttctctggccataggtattgaattggtttcttgattcaagcacccggtggtttgctcttcaacagtcctaccagtagatgggccaggttcttcctcattagtcctggctccctgcgatccccctggaagggccatagttgaggcagtcgaaatgggagaatctagtgagccccttccgagtggcagaccatgctcttcattaaagtcttcttctccatttgatgttattgatgagttatcttgatgacctccagggcccatgtccctgttactagttaagcagggactagattcctttgttgaagtaggatccatctgccattcatccatttcattattggcagcactgttggattcatggccatgtgctaattgctcactggagtttggatcctccacagctacactacagccttcaaccaaaacatcatcgtctgctgttctgtagttttcaggactcagagaaacatcacttatttggttgcaacactcagcaggatcacttctggatactgaatcatatggcacatcagtttcagcatcttcaccttcacaatccatttgtgtaccctctgtttcctgtgcaacatcatattgatcattctgttgtcccgatactggcatgtcacttgcaaaagagaagtcattatctgcagtatcctcttcagtatgcttcaaaaacttcttgggagcctcattactagtaatcctgaatttcttatttacatgtctggtctcaggttcatgctcttcaccaaagccatgaactaatctagtactagaaggtgaaaatgcacgcctgccagtcctcaacggagatcggtgcttccggatcttctttgatgtagatgctgacctgtttggtccattgcttggccctgcagtggagaaggaaagagtcctagcttcaaatcttttcactgaagtgggattcctcactatatcataattatctagtttggtagattctctcctcccaatctccttaatttttctctttgcaagagcagcagctgatctaggtacttttggtatgacactgctctgaagatgagtttttgaagaccatgtaggaatcgatctaagcacgtttcaaggaccattactctgctcaacaccagtggcttctgaagttgtggccatgtataataactcagaagaaaacaccccaacatgactttctggaacttgagaatcattaaagccaaacatgctgctcctatccgatttctgtgctccaggtgccactttgtcaaatgttttaccactatggtttttgcttaatttcttgttgatatctgatcgtttggagcatacccactgctgcatagtcctggaaccacaattgctggtgctttcagaaggattccatgcattcctctcctcctcggaggtttcctcattaatatcgtcatgcgggtctgcttgaacctgggagttcaaatggcttgttttgttgtacttctttccatgcatcttcagcttcttattcttcaaaagctttgacttcagcatctttttgctcatcagtataccttttccagttccatgcttcgcaactttgctagaaccaaggtcatctttcaacaccaaaggtacatcattacacttggacaaaattctaatttttatgccgttagaatcaacataaacatctccttctctttcatcatctcttctgtcaaatgataccacttgtgggcttccgttctcagggggggc

SEQ ID NO: 23812 - DNA, 4698 bp, Zea mays
  misc_feature (1430)..(1430): n is a, c, g, or t
  misc_feature (1668)..(1668): n is a, c, g, or t
tgtgtatcccatagaaataagtcaaaggtgcaaaattaacgggataaaacattttttaaggtcaaccacagaacaaactgttatcatatgagatgatcctgacatccaccaaaaaacatggcaactgtaaaacctagcgtaaactaacccatggaaaactaacacaggttcacaaaaattaaatttaaagattgttctctccagggcttaaaagtgtttttttactgtcattggggggagagaggccccccacctgaatggtaggaaatcctgggaacgataggaatcaaacctaagactgaccagctcgtacagagagcttttaccactgagctacggctcagttcctagggcttaaaagtgtttttcggtaaaatgccataatcactgttatcttctaggaaacgaatgactcagcaataattaagaaatgagctctatatttaatatacacaagttgcctttacccttgcatctccatagaagaacattgatatggtgatgaatatcaagcataaactaacccatgactgcgaaacctgacacaattcaagcctaacatctgattatggtccacattcatacttccccaaggaattaagttacaaagctaaacataatccaagcttaacatctgttcttacaaatcttttatgacacatggagttaaaatgatgtgtagtacatagcacattcattcatgaaacaaaagctgcatcagtgcagacattataaagtgtggtctaaggtctgataaataatgggtatgctctccatgtactaatggtccaagatcgcattacgccaatcgataaacacggtactggagtcacagtgacaaataacatgtagagtgagttaaagacactacctgggagttcaaagggcttgtcttgttgtacttctttccatgcatcttgagcttcttattcttcaaaagctttgacttcagcatctttttgctcatcagtataccttttccagttccatgcttcgcaactttcctcgaaccaaggtcatccctcaacaccaaaggtacatcattacacttggacaaaattctaatttttatgccgttagaatcaacatagacatctccttctctttcatcatctcttctgtcaaatgataccacttctgggcttccgttctcagtgcaaacctctctgctcactggagacatagccaactcaactgcccaattagtgccattcctccgatcaagatcctcaagggtgcatggaagagcagtcttgtatatgtccaccatcaatcgcttcttccttggcttcactttaggcttcacaaggaccgtttcaacaagctcagtattagactctgcagaaaggcactgatctatgtgggcattcaatgtggtgttcgaagtggaagcaaatactttgcacacaggacaagtctttgaagccatnggatctgaaactgagctagagttagatgctatatcctctggccgccgaatatctgccgaggcacctaacttgacaacaaatttgcacttcttttcagatggctcgcacgatgagtcaagatttctcaaccgccgcaagggcacagcaacctcagttcgccgacttgctcttgtacagctattatcttgcagatctattggtatagcctcgtcagtatgatctgattcatttgtacttnccacttggtcgataccggatttcccatcctccggtgatgtgtatggcgaaggtccaggtgactcatctactggctggcatgactggaagttgatatcgcctgtatactcgtttgacgaaccggcatctttggtcttcaccagaccaacactaatgatgggttctgagcacgcagcagattgcttaatgtctgtggaaatatttaatggctgagaccggatcaaatcgggaggctcaaatggaggcaatggatccttcacaccatgctccaggcaaagctgcaacgagtgtggatggaaaggccagcttctcttgatgcctttgctccttgaagcaaaaacataatctctggaaatagggacagaaacatgggcccattagcatatggtaatacgtgcctatatgacgaacactcatgtatagtgttgccaaactgtataagattcaaaccctccacaataggttgaaaagaagagagaaaaaacaacatcaacgtggaccaactgaacatgctgtcatatcaaaactgaaatctccaaaaatatgtcgcctgcctgtttatcgcagaaccaccacgtatatggaaaagaaaaccaatagtaggcagtggacaaagattaatgagaggagcatccttttattttcagattctggggtggaaaaaaaaggccacctttatattaatcagcagaaaattaaactaattaaacacccccggacaataacacggattaaccctgaaagcaaccattcatacccaatccgatccctcaaagcagcagccaataattaatcgacgcatcagaaagacagagatccagcatcaagaacttaaacaccgaaaaataatctctctccaaaggtattgaatcaaagaggtgtatatacacatatatctttcaccttatggagaacttgggatacgattggatcagatctctgggatcctggcacgctggctgctccgccgcggacgtcgccggatcagcgctcacacccgggccaccagacttggaggaacatgaggggcctgaagggtgctcactggataacatctgatgaacgccttcgctgctccctccagatctgcggctgctacagtcggcaccgagaacccaatagctgtgaagcgattgggcctgctcttattcttgcactccagcataccaagttggtaagttcaacaggtggatagaacaagaaacttcacttccttgtccgtccactatctcatcaggcacctgcagagagaaagcaaggcacatattatttcatgtccaaccaaaccagctgttctttgggaatccaatggcatgattttatgctgatagatgcagcaagtgaggtatggatgccagagaggagaggagacacgcggagggggctgctctcgaagtagcacagagcacatgaaatatcatcccggggcaaggtggacgagcgagcgagtctttgagcagattaaggggaagcctacacggatcatgcagctctcgcaaaggatttgcagtaagggaagagcagtgaaggagacatgaacagttgccaagcactggagggtagcttgtatggtagtgctttcttgatggggaaataaatagcaaaagaagaaaagaggaaagggagcttaataactaagatttggcgagaaatcaagaaaaaagaaacgattttcccgtcgcttcatcactggcctaatcggggatttctgtaaggacgaggagccatgggagcacgtagaggaaggagttcgagaacgggggggccgtaatccgtaccaaatctgcagaaagcagatgcaagggatcgagaatctttggccgtagccaagaacaaaacaagcaagcacgaaaagcagcggagatctagcggtcacaggcagcgagagaagcacgaggaatcccagctccgcccgaagagagagagatccagtctgcagacgccaatcttccagttccagcgacgaatctggtaagggggagcgacgcgcaagagcaaggaaaaaccgcgcggattcaagtcaagcaaaaaatcgagaaccgcccacggaaaccacaccgcacgcacgaactcggaggaagaacaccggcagttctctcaccttccgttccttcttcacaggcgctccccgggcggcgcgcgcgatggagagagcatcctgccggtagatccacgcagcgagcagacggggaggagggtgagggtctcggagctctgtggtggtggaggttttgatttctggggactggaagcagacgggggggagaggtgagggaggaggagcgaggcaaggcaaaaggggaagaaatggctgccgattttctttgttggcttcccaccaccactttctctctcctagtcccacgctgcctgcctagccgggaaaaaaaattaaaggagagagaaggaaacaccaaccactcacacatcaaaggcatctggttctccaccaagccagccaaaggcggggctggctggctgtaccattaacagcagcagctcgagagagagcgcgtgtagtatttgcttttggagcgagaaaagaaaaggagccccggacctgtgagagagagaggggagcgctgaggcaggaaaatgagtggtttttttctgcggccctgtcctatcctacaccaactatattattatttttttcgacgctgctcgagtgctttctctctctcttttgttgtcttgttgattgtatggggtgaagcgccaacctttggtcccctccttaacgaatactccaagaatgccaccgatggcttgtctatttcttccaagcaggtactcgctcacgtaggcatattttgcccattcggacgaatctatttttaatcgaccacaattattcagttttatttttttaccacaaacttatatttaagaatcaacattctttgacaacggaaccatcgatagtagtgcataaatttgccatctatctggtttcaacgtgattaatgtttatagaaataggggatctattttactctctaaaaaaccaggactaacttatttaaattag

SEQ ID NO: 23813 - DNA, 5512 bp, Zea mays
tcgagagaggcccgaccggagcactacttttgcatggagaaggcatgggggctatatatagagttacctgaccaggagcttggccctcacatggacattcccttgtgtggggctccagcgagaaatagagggaagcttatgcgcttctctgtatctcgattggtgcaccaacgagagattatacatctatcatatttacttatgttaccttggttatgtgctttacctttctaacttagttataatctagcgtatagatttaaaatttaggttgtataattttttttacggtagacatagcgatgcttagttaaaattgtagttgtatataggatcgtttattttttacataggttttaatgagaaaaaaatagaagtcatagtgtagatagaaattagattgaccggttcgcttctctcgtagatgttaagggttccttgagttggtacgatcaaagtctcggtcgatatgctcagtgtccactagcatggcagacataacatcaaggtaactacttttgttggcggacactatggttctatgaagaaaggaattgtttcctctacagttacgttcggccaatgatgtgtggagctaggctatggctagccccacacaccagtgacccatctgtagatattttcatagacataaatacagatgatctgatcggtgaaaaaaaggggttggccattggccaccgtcacgcggtggcagacctacagggtatgtcaggtgagctaaaacataccccgtagaatctagccctttatacatataggcttatttacatcccaatcaaccagtggaataataaattatatacatgggtgaatgaatggtgtaaaaatattatggcatactcttaaccaaaatactaggtccgctgccctcacggcctcaccctgtcggatgcagagcacgtcagcagcgtttgttgcagcagtgctagtgctacaactacaaggaggcaaaaaggagatcacagtgcacatctacgagctacaactacttcatacggcgtcggcacatcttttccccccgcttttaagaaagcaaagcaaagcgactgcgaggcgagctgcgtcccggaccaggggagcatttatttggacacgacgctagaggggcacggggacacggccctttttcctcagctcgcatcgctgccagtccgcccccacgggcactgctgggcggtccgcggccgtcgctctcgttcgtgccccttttcaccgccggctctctcccctacttgtcgtcggatgggctggtccgctgttcacggtggacaccacaccatgccaacgccagacatatcatgggagatgggacacgggcgccgtgctggtaccactactactctactagctagctaggcgatgcttttgccagtcccacctaggtgttagcagctgcctgccgggtcggtcgggtgccggctgctgcagccggtgagtcccggagtccggactccggagagaggggatccaggcaggcaggcaggcatccagccgatcagggacgggatggatgtgtgtccgtccacagaccgagattaaaaaaaaaaggctgcggcgatgtcgctccccacgctgcggcaaaaggcaaagcacccggccgtcgctggtggccaccactccagtttgctggtcctccgactgtacagtacagtgcatacatttcttaacctgtttcgggtagtccaaggtctggagggatgtcggtaaagcatctcatctcacataatggatccgagaggcatgctgatctgaaaggcttggggtacgtttgttcatagctaattgtatcacactttgcctaacattagagagtatttgtttgagattataatatgtctaaattatataatccaacaacttttgaactatttataatatcaaacaaatactcttttaatcgtccgaatcgaagaactaactttagatagaaaaagttagtcaatgtatgacaagttagacagcaaaccaaacaaaccattggtctttgataacgacacaatttcaacgtctgcaactaacaaaatgagagtattcttgtacgatgcaatgcaacgttactattctactttggattgtattaagggagtgtttggttctaacctcctaaacttaatcacttttagtctctaaaataccaaacgggtgattaaaataggtctttcaaatatgatttctaaggacgaaaatttagtcactaaagtttaggagggtgactaaggacctgtttaaaagcaaccagttttttaaaaatggtttatagaaattgagatagttccaaacataccagtttatgactcagtttatataaattggatgccagtttcttaaaaactgattaaaactgagaagctagtctcttctaattaaaagataaaaaccagcttcttaaaaactagatttgcttccaaacaggacctaaaggaaccaaacaccccttaactatcacgagttaacactgctgaggcagcaaacaccggcagaacagtgtgtattttgttctgtcttctgtcttttttcttgcttctgggaatatcaaatgccagctttttcgataaatactgagatatattcctttgcagagctattgggaattgcacactgtaatttactactgcagctttgcagagagtaattaagatacttttgacggcaaacatgctgtagctttaagggagaaagaaaggggaaaaaatctaaagcaacctatgtgaaaatcctcatgaaagtcagacacatctcatgcaggttcattgatctcagcatgttttgacccatcacgaaactctcatcccccacaaacttcgacagcgacgaccggcaagttaaatggagttctggtcatttgagctactgagaaatcatcaccccagattctgtgagtagtacactggcgggtggttcatgtaaccagttcgggactggacgaagaacggattcggcatgtaaggattggttactcccgtttggctttcttgacttgatggactgacaccagccaatgcgccaaagtttgcgtacacaggcatggatccagcagccctctcccttggcaagattgggatttgcggtggaaggcagtaaaatggacgtggtggcgtattgtttggtatcgagagtgcgggaggtggagcaggggggaaaagcatgctagcttgtggctcagttctactacgctcaggagagtccttgatcacaatcacttctttcatcatgtaggttggatgatgcatggcaggcataatatttctgtaggacttctgctgggaatgatggtcaggttgcatcatggaaacgctgtgcaacggaggagcaacaaggccgctagcttgaacacttggtagaggaatctggtgactggctgcggttggtggcatgctgataaatccagaattaccgagatgttggtagcttggaggcataaaaccaacaggtgcctcgtaattccctctcaagatgtagtctgaacttggtgcttgaggatgcacactctcttcgttgttcatcaccatcaaatccttacccatcagcctcaagataggatttgatggcgaaggaagctgagtttgtaatgaggggcttatgcaatctgttgagtaagaagggaggctgacagcagattccgctgcaaccttagccgctgaaagatggtcatgtgaatctaagcaggggttgggctttgcgctggttctttggtacatgctgaaagatgatgatgccctcgaaccaatgtgcaattgcggaacctgctttccagtaaaattcagcgttggtctggcaacaacactttgatgagactctctggaaatgttctcctggcaagaacatcgaaaaggcttctctttgggaagttcaccttctctggccataggtattgacttggcttcttgattcaagcacccagtgatttgctcttcaacagttctaccagtagatgggccaggttcttcatcgttaatccttgaatccttcaaagcagctggaggggacatagttgaggcagttgatacaggagaatctagtgagtcctgtccgagtggcagaccatgctcttgattaaagttttctccatttgatgttattgatgagttatcctgaggacctccaggacccatgtccctgttactaactaagcagggactagattcctctgttgaagtcggatccatctgccattcatccatttcattattggcagcactgttggattcatgcccatgtgctaattgctcactggagtttggatcctccacagctacactacagccttcaaccaaaacatcatcgtctgctgttctgttgttttcaggactcagagaaacatcacttatttggttgcaacactcagcaggatcacttctggatactgaatcatatggcacatcagtttcagcatcttcaccttcacaatccatttgtgtaccctctgtttcctgtgcaacatcatattgatcattctgttgtcctgatactgtcatgtcacttgcaagagagaagtcattatctgcagtatcctcttcagtatgcttcaaaaacttcttgggaacctcattactagtaatccggaatttcttatttacatgtctggtatcaagttcacgctcttcaccaaaaccatgaactactctagtactaaaaggtgaaaatgcacgcttgccggtcctcaacagagatcgatgcttccggatcttctttgaggtagatgctaacctgtttgatccattgcttggccctgcagtgaaggaaagagtcctagtttcagatcttttcactgaagtgggattcctcactatattgtaattatctaatttggtagcttctctcctcccaatctccttaatttttctctttgcaagagcagcagctgatctaggtgtttttggcatgacactgctctgaagacggtgagtttttgaagaccatgtaggaatcgatctaagcacttttgaaggaccattgctctgctcaacaccaatggcttctgaagttgtggccatgtattctggtgactccgaagaaaacgccccagcaggactttctggaacttgagaatcattaaagccaagcatgttgttcctatccgatttctgtgctccaggtatcactttatcaaatgctttaccactatggtttctgcttaaactcttggcgatatctgagcgtttggagcacacccactgctgcatagtcctggaacaacaattgctggtgctttcaaaaggattccgcgcatgccactcctcctcggaggtttcctcgttaatatcatcatgtggatatgcttgaacctgtgtgtatcccatagaaataagtcaaaggtgcaaaattaagggataaaacattttttaaggtcaaccacagaacaaactgttatcatatgagatgatcctgacatccaccaaaaaacatggcaactgtaaaacctagcgtaaactaacccatggaaaactaacacaggttcacaaaaattaaatttaaagattgttctctc

SEQ ID NO: 23814 - DNA, 1370 bp, Zea mays
cattgggtacctccgaggccggccgggccgggagcaacagccatgacgacgacgaagcggcactgcttgcgcttcaccaccgtcctggcgacgacgcttctctccgccaccgccgcctgcctcgacgtcggcttctacgacaggacatgccccactgccgagaccatcgtgcagcagaccgtggcggccgcgttcaggaacaactccggcgtcgctccggcgctgatccgcatgcacttccatgactgctttgtcaggggctgcgatggctcggtgctgatcgacacggtaggcaacctgacggcggagaaggacgcgccacccaacaaccccagcctccggttcttcgacgtggtcgaccgtgccaaggcgtcactggaggctcagtgccccggcgtggtctcctgcgccgacgtgctcgccttcgcggccagggacagcgtcgtgctctccggtggcctcggctaccaggtgccggccggacgccgtgacgggcggatatccaatgacaccgaagccctcaacaacctgcctccgccgttcttcaacgccaccgagctggcagacaggttcgcctccaagaacctcactatcgaggacctggtcgtgctctccggcgcgcacaccatcggcgtctcgcactgcagcggcttcgccggcccgacagacctgaacggccccgttgaccggctctacaacttcagctcgcctgacgggattgacccgacgctgagcaaagcctacgcatttcttctcaagagcatctgcccggccaacaccagccagttcttcccgaacacgacggtgttcatggacctcatcacgccggaaaggtttgacaacaagtactacgtcggcctgaccaacaacctgggcctcttcaagtcagacgtggcgctgctgaccaacgcgacgatgaaggccctggtcgactccttcgtgcgcagcgaggcgactttcaggaccaagtttgccaggtccatgatcaagatggggcagatcgaggtgctgacggggacgcagggcgagatcaggcgcaactgcagggtcatcaaccccgttagtgccaccgatgatgtcgtcctcgcccgcccatcaggattcactggagtggctgcgagctagctaaccaactgtcggttcatgcacatgcgttgtgcacagtgtgtgatgtctagtgtgagttgatgtgtgaaattgtaataagtaatgagcagattatcttggtaagctcgcttgttactgtggcaaaagttgttttgttgcatgacaaaaatgtatactcatcggattattgaaaacaaaactgatatttgttcacaggcaaaaaaaaaaaaaaaaaaaaacttataaacacccacgcggccgat

SEQ ID NO: 23815 - DNA, 891 bp, Zea mays
  misc_feature (802)..(802): n is a, c, g, or t
  misc_feature (811)..(811): n is a, c, g, or t
  misc_feature (815)..(815): n is a, c, g, or t
  misc_feature (869)..(869): n is a, c, g, or t
  misc_feature (872)..(872): n is a, c, g, or t
actccttagggcgattgggttcctcgaggccggccgggatcatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctgggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgagggacatggttgtcctctccggcgcacacaccatcggcgtctcgcactgcagcagcttcgccggaattaacaacacaggcgaccggctctacaacttcagtggctcatccgacgggattgatcctgcgctgagcaaagcctacgcgttccctccctcaagagcatttgcccgtcanacagcgggncggntcttccccaacacgacgaccttcatggacctcatcacgccggccaagttcgacnacnagtactacgtcggcctcac

SEQ ID NO: 23816 - DNA, 1476 bp, Zea mays
ccggccggggagctagctataaacccccccccctcgaggccggccgggatcatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgcccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgagggacatggttgtcctctccggcgcacacaccatcggcgtctcgcactgcagcagcttcgccggaattaacaacacaggcgaccggctctacaacttcagtggctcatccgacggggtaaatttcccctccgaccatcttccgttccctagatagttctcatgtgattattatccactgctactgctatatatatggcctactatacagattgatcctgcgctgagcaaagcctacgcgttcctcctcaagagcatttgcccgtcaaacagcggccggttcttccccaacacgacgacgttcatggacctcatcacgccggccaagttcgacaacaagtactacgtcggcctcaccaacaacctgggcctcttcgagtcggacgcggcgctgctgaccaacgcaaccatgaaggcgctggtcgactccttcgtgcgcagcgaggccacgtggaagaccaagttcgccaagtccatgctcaagatggggcagatcgaggtgctcacggggacgcagggcgagatcaggcgcaactgcagggtcatcaaccctgctaatgccgccgccgacgtcgtccttgcccgtcagccaggttcatcaggatccactggagtggctacaagctaaccatatctcggtgtgtctgcagtgtgtttggtgtgggatgtgatatagtatattgcaataatctagaaaactgaagaagaagcaggtgatgaccccactctgtagtgcatcacgcggtgcgtgttcatttaaccgtggcgtttgattgtgaggatgaaataaaacacatgtatgaccacatctgattattagtgatacaaaaaaaacttgattg

SEQ ID NO: 23817 - DNA, 1392 bp, Zea mays
cccattgggtacctcgaggccggccgggatcggatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgaggacatggttgtcctctccggcgcacacaccatcggcgtctcgcactgcagcagcttcgccggaattaacaacacaggcgaccggctctacaacttcagtggctcatccgacgggattgatcctgcgctgagcaaagcctacgcgttcctcctcaagagcatttgcccgtcaaacagcggccggttcttccccaacacgacgacgttcatggacctcatcacgccggccaagttcgacaacaagtactacgtcggcctcaccaacaacctgggcctcttcgagtcggacgcggcgctgctgaccaacgcaaccatgaaggcgctggtcgactccttcgtgcgcagcgaggccacgtggaagaccaagttcgccaagtccatgctcaagatggggcagatcgaggtgctcacggggacgcagggcgagatcaggcgcaactgcagggtcatcaaccctgctaatgccgccgccgacgtcgtccttgcccgtcagccaggttcatcaggatccactggagtggctacaagctaaccatatctcggtgtgtctgcagtgtgtttggtgtgggatgtgatatagtatattgcaataatctagaaaactgaagaagaagcaggtgatgaccacactctgtagtgcatcacgcggtgcgtgttcatttaaccgtggcgtttgattgtgaggatgaaataaaacacatgtatgaccacatctgattattagtgatacaaaaaaaacttgattgaacaaaaaaaaaaaaaaaaacggcccggc

SEQ ID NO: 23818 - DNA, 1979 bp, Zea mays
ttgggtacctcgaggccgggcgggggagagctcctaagaccctccctcagacgcgtggcgtcccatcctacgatccaaagctctctctgtgtcgcaggtcgcagccatggcgaagattacccgaccgtgagcgccgagtacagcgaggctgtggagattgactcctatagggccattgggtacctcgaggccggccgggccgggatcatgcatcagcattcagcagcagcagcacgaaaccctgtagtagcctgccatggctacgcgctgctgcctggtcgtcgccactctcctcgcggcgctgctctcggtcagtgccagcctcgagttcggtttctacaacaagacgtgccccagcgccgaggccatcgtgcagcagaccgtggccgccgcgttcaccaacaactccggcgtcgctccggcgctcctccgcatgcacttccatgactgcttcgtcaggggctgcgacggctcggtgctgatcgactccacggccaacaacacggcggagaaggactcgatccccaacagcccgagcctgaggttcttcgacgtggtggaccgtgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaagccctgaacgagctgcccccgcccttcttcaacgccacccaactcgtcgacaacttcgcctccaagaacctcagcctcgagggacatggttgtcctctccggcgcacacaccatcggcgtctcgcactgcagcagcttcgccggaattaacaacacaggcgaccggctctacaacttcagtggctcatccgacgggattgatccggcgctgagcaaagcctacgcgttcctcctcaagagcatttgcccgtcaaacagcggccggttcttccccaacacgacgacgttcatggacctcatcacgccggccaagttcgacaacaagtactacgtcggcctcaccaacaacctgggcctcttcgagtcggacgcggcgctgctgaccaacgcaaccatgaaggcgctggtcgactccttcgtgcgcagcgaggccacgtggaagaccaagttcgccaagtccatgctcaagatggggcagatcgaggtgctcacggggacgcagggcgagatcaggcgcaactgcagggtcatcaaccctgctaatgccgccgccgacgtcgtccttgccagtcagccagattcatcaggatccactggagtggctgcaagctgatgtgtttggtgtgggatgtgatatatattgcaataatctagaaaactgaagaagaagcaggtgatgaccacactctgtagtgcatcacgcggtgcgtgttcatttaaccttggcgtttgattgtgacgatgaaataaaacacatgtatgaccatatctgattattagtgatacaaaaaagcttgattaaaaaaaaacaaaaaacaaaaaaaaaaagcggccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggcccccaaggcccccgcccgccaaaaaacaagaaccccccggggtgcagaaattcaaaaaaaagttaatcaaaacccccccccccaaggggggccagaaaccaaatccccccaaaagggaatcaaataacccgggccggggcctaaaaacgacggaataggaaaaacccgggggtcccaattaactttgagcccccttttccaaaaaggccccaccaactttccaaaaatttgccaccctaaaggcaaaaaaaattttgaaaaaatgtaaactcatcggaattttgaaaacaaaaccgattttttcagac

SEQ ID NO: 23819 - DNA, 869 bp, Zea mays
  misc_feature (857)..(857): n is a, c, g, or t
gggtacctcgaggccggccgggccgggatcatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgagggacatggttgtcctctccggcgcacacaccatcggcgtctcgcactgcagcagcttcgccggaattaacaacacaggcgaccggctctacaacttcagtggctcatcccgacgggattgatcctgcgctgagcaaagcctacgcgttcctcctcaagagcatttgcccgtcaaacagcggccggttcttccccacacgacgacgttcatggacctcatcacgccggccaagttcgaaaccnagtactacgtcg

SEQ ID NO: 23820 - DNA, 1373 bp, Zea mays
  misc_feature (871)..(871): n is a, c, g, or t
  misc_feature (874)..(875): n is a, c, g, or t
  misc_feature (889)..(889): n is a, c, g, or t
  misc_feature (893)..(893): n is a, c, g, or t
  misc_feature (896)..(896): n is a, c, g, or t
  misc_feature (905)..(905): n is a, c, g, or t
  misc_feature (913)..(913): n is a, c, g, or t
  misc_feature (929)..(929): n is a, c, g, or t
  misc_feature (937)..(937): n is a, c, g, or t
  misc_feature (947)..(947): n is a, c, g, or t
  misc_feature (1000)..(1000): n is a, c, g, or t
  misc_feature (1184)..(1186): n is a, c, g, or t
  misc_feature (1188)..(1189): n is a, c, g, or t
  misc_feature (1248)..(1248): n is a, c, g, or t
cctcgaggccggccgggatcatgctatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgagggacatggttgtcctctccggcgcacacaccatcggcgtctcgcactgcagcagcttcgccggaattaacaacacaggcgaccggctctacaacttcagtggctcatcccgacgggattgatcctgcgctgagcaaagcctacgcgttcctccctcagagcatttgcccgtcaaacagcggccggttcttcccaacacgacgacgttcatggacctcatcacgccggccaagttcgacaacaagtactacgtcggcctcaccaanaanntgggcctcttcgantcgnacncggcgctgntgaccaangcaaccatgaaggcgntggtcgantccttcgtgngcagcgaggccacgtggaagaccaagttcgccaagtccatgctcaagatgggncagatcgaggtgctcacggggacgcagggcgagatcaggcgcaactgcagggtcatcaaccctgctaatgccgccgccgacgtcgtccttgcccgtcagccaggttcatcaggatccactggagtggctacaagctaaccatatctcggtgtgtctgcagtgtgtttggtgtgggatgtgatannntnnattgcaataatctagaaaactgaagaagaagcaggtgatgaccacactctgtagtgcantcacgcggtgcgtgttcatttaaccgtggcgtttgattgtgaggatgaaataaaacacatgtatgaccacatctgattattagtgatacaaaaaaaacttgattgaacgaaaaaaaaaaaaaaaa

SEQ ID NO: 23821 - DNA, 1284 bp, Zea mays
ggtaccctacgcggtctcgtgcccgtaccctgtgctcatttgcggagccttccaagctagccacttcactggtcactccattagcagatgcgctctgcatcttctcccctctggaacacactcccacacagaactagagctccaaggccatggagaaatggagaagacgcaggcacttgctgcttgctgttgcagccgtggccctggtggcagcaataacgctgccgtccgcggaggcgaagctgtccccggactactaccggtcgacgtgcccggacgtggaggcaatcgtgcaggcagtggtggccaagaaggtgaatgagaccttcgtcacagtcccggccacgctcaggctcttcttccacgactgcttcgtcgagggctgtgatgcgtcggtcatcatcgcgtcccgcgacaacgacgccgagaaggacgcgcccgacaacgtgtccctcgctggcgacggcttcgacaccgtggtgcgcgccaaggccgaggtcgagaagaagtgccccggcgtggtctcctgcgccgatatcctcgccatcgccgccagggacgtcgtcaccatgtcgtccggcccccactggaccgtccagcttggccggcttgacgggctcgtctccaaggccggcaacgtcgcgggcaagttgccgggacccaacatgcgcgtcaaggacctcgccgccctgttcgccaagcacaacctcaccacgctcgacatggtcgcgctctcgggagcgcacaccgtcgggttcgcgcactgcacccgcttcgcggaccgcctctaccaccacggcgtcggcgacagcgatggcgcgtcggtggacccgtcgtacaaccctgcgtacgcgcggcagctaatggacgcctgcccgcctggcgtcggcgcagacatcgccgtcaatatggacccaatcacaccgaccgccttcgataacgcctactacgccaacctcgccggcggcctgggattgttcacctcggaccaggcgctgtacagcgacggcgcgtcgcaaccggcggtgagggacttcgctaagaaccagacccgcttcttcgaggcgttcaaggacgccatggtcaagctgggcagtgttggggtgaagaccggccggcacggggagatcaggagtgactgcactgcattcaactagtagatcgaccacccattcttttgaagaaaaaaaaaacagccgcgtacctgagcgaactcaaccacgtccacgtgacagcacagaactcaatccttagagctaggatgaaaacggacgaaatcggtct

SEQ ID NO: 23822 - DNA, 1499 bp, Zea mays
ttttttttttttttttaagttttagattcgaaactttgcagatgaagctgctgcagaggttgaacaaattccgacactgccgtgaaaaacagtagttaatgggtcagtgaccagatgctaaaacgctggcacgttactatcttcttggtgccgctgacaggatgccggggaggcgttcgatctccttctgttggttagcttgcgaccctgtttgctggcaccagtcggcctgggattgccgcctcaccaagacgtgcctcgcccagtcctatcttctaccgggcattcggctgcatcgtctcctgcaccttctgtggctccactgacagcgcctgcgcctccgctctgtgctggtgcgctgtgttgttgcggcacagacacaacaacaccaccagtcgtgctccgtggcgaatcatactcagcagcgtcacccgttgggagctggaaccggcagacaggacaggtgttcctgatggcaagccacgggcggatgcactccccatggaagtagtggttgcaggggagcctaaggacactctgccccgccacaacggcatccttgcacacagcgcagccgtgcgaggcctcctggtcgctgagcgcaacctccggtaagccgtccaccaccgcacgggatgccggcagccgccgtgtagcctccctgacgcggcgcgcgagagcgtcgacgaggttgaggtcggcgtcgtcggagtcggtgtcctcgccgcccaccaccattcggaagggccgcgtggcgtgtggcgctggcgctcggaggtcgaacccgctgagcatgagcccacccacctcgcccacatcgtcgtcgctggtggcctcctcaacggcgtccaccgggccctggaagccaccaacaggcggccccgaatcgagggtaaacccgttcagcatgagcacgatcccgtcctcgtcgtcgtcggcagtctcctcatcgaccgctccccgctcgaattcggaccctacgccgcccagagcatttcgggaaatcatctcctcctcctcctcctcctccccggaggtgtcctcgacgagttgcgatgcaggaaagaggtgggggtagaattggctgagacctccgtcggagtcgaatgagcggcctagggtttcgagaatgggttcgtcgtgggaggacaggggtccctggcgctggcccacgaggacgtcgcctccgtctccttcgccgccgcggaaagcgaaatctgagatgcgatactgcccgccgcccccgtagctgagcgcaaagtggccgccgacaagtcccgcgtcctcgtcctcgtccccgtcgccatcacagtcttcgaatgggtcgtagcagaccgggccgtcgtccccggagtcggagtcggagtcgaaaccgaagggatcgtcgccggcgatacccgccattgggaagaagcacgaagcaggcaatggcggaagtggttcttgagaagggtccgtgggggtgacgactgggtagctccgacgatgaattatgagtg

SEQ ID NO: 23823 - DNA, 1215 bp, Zea mays
gggaccaaccaatgaaccaagcaaacactgcaagccaacagaggccgcgaaacaaattcaaaagtatgttattgctacctaaggctatggccagcaggtacatgtgccctgcaaatcactattttgcactgcactctttatgtagtggggtttaaaatatgagatgtggatgctgctgagctaacttaacaacttcattacacatacacgtccaagacccgatagacagcacacaagcaggcaaatatactaatatggcgcgatcatccagagccatgagctgccgatcctatcttgattgctcatccactgtcatctaatagtagagtatgtgatgaactccctggaagtaaaatgaaacggctggtggggaacaggattccataaatgtgtgaatgaatgtttctcgtggatcaatcccggataatgatatgtggacccatccaactggctttgcaagctccaccgttctaatctcctttaggttgtggaagccatccccggcccggatggagatcttgctcggcgtgtaactctcgtcgagcttgaaatccacgtagagcacaacgagctgcagctgcaccttcttctggaactggatgttcaccaggtgcggctgcgccccatcagactgccagtaggtgtcgaggttgtcgtcgcgcagggccgcgacgccgttgccggccttgcaggaactgacgctccacgcggccgtcttcgccatctctcgcatgtctgcgtccacagtcagttccgggttccccttcagacgcccagcgcctggggtcgccgccgctgctggggtcgccgccgcttcctcctcggcgtcggattccatcggaccagtgcgaggtgaagaatcggaggagtgaagaacgctcaccagggcggagtcagagtctcggacagtcagacagaacagggcgagaggcagtgcagagcggaatcgggactgggcagcgcttgacgccttggcgcggcgccggcggcgcacgcgaccacaccggggtgccgctgtcgcacggcgataggccgcccgcactcgcctatcgtctctcccctcggccggttgccggtcgtgtcgccctcgcggctgtcgctgttcttggcggcggcgcggcgtatggtatggcggccccccggccggcctcgagtcgccgtttcgtcgagtgcccaagtgggggtctcagtatttttttcccggccggcctcgag

SEQ ID NO: 23824 - DNA, 2587 bp, Zea mays
  misc_feature (717)..(717): n is a, c, g, or t
ggtcatgtggcatgtgatgagtacaagcatcaaatcctatgtagaccatgtggcattgtatgggtacaagcgtctattaactctattgtagctccatagatcttggtttagtcaaacatactcatgtattacaaaataatactccctccgatttttttatatgacaccgcttagttcaatatatgacaccgcttagttcaaaattgaactgaccaacgacatataaacaaacagaggtagtaatagatatgcaaggtatatccatcttacggtcttggcccgtagatcttgatctgtcggacatgagtatccttcccattcagatgattggataaaacagcaatttggagcataaatgtgtgaatgaatgtttctctgcatacatacccaaaaaaagacagtaatatatctgcctacattacagaagtaaaatcaagtagtacaagctttaaatagagtgtcccttccactaacttctaaaatagtttcacttcctaaattattatgatgataaaattcttcaagcattcactacataaaatattttaactctttcctggtgatatttgttactaaccttgggattgacgattgataatcagtccctaaggactataggttatatatataggcagcaggcctgggcctaatgggccttaacaatattatggatgtagtattatctggctcaaatgttcggtatggaacgacaaaccngacaggatatccaagtcttttcaaattcaacacatagattcaaaccaaaacaacaaaccaaggctgttagctaagctctgcacatttgttttgtcctcctacatgtataaagggagtatacacataattttaggaacggttattcatcttcatattacaatgcataccgtggatcaatcccggataatgatatgtggacccatccaactggctttgcaagctccaccgttctaatctcctggaatcatgagatacgttactgtaaatagtcaagtgatgccaatactggcagttagtaagctcaacatttcaattttcaaacgactagttcatacagcagtacttgcaatgcagaagcaaacctccaggtaatgtcaggtcatattaactgtatctaacttctaggaaggcacaaaataccagaaaaacgatctagttacagtgtataaaatcagttcaagtttaccctcagaatgattatttcgcaggtttcggaactcggactctgtgtcatactcaactcggacgaatcaacatgtataatcttgtttaaatctattacagccgactaggttctgaacatccttcaaatgatatctcatggagaaaaagcgtacctttaggttgtggaagccatccccggcccggatggagatcttgctcggcgtgtaactctcgtcgagcttgaaatccacgtagagcacaacgagctgccgcacaacatagaaccaattagtctcaaagccatcgaatcacaaggcaaaggagtagcatctctactgaagcaggcacctgcagctgcaccttcttctggaactggatgttcaccaggtgcggctgcgccccatcagacctgaaaccaaatcgcaggacccgaatcaccaactctgaccttctagcttcaactaattcgacaaagaaaaaaaaaggtgatccactgactgccagtaggtgtcgaggttgtcgtcgcgcagggccgcgacgccgttgccggccttgcaggaactgacgctccacgcggccgtcttcgccatctctcgcatgtctgcgtccacagtcagttccgggttccccttcagacgcccagcgcctggggtcgccgccgctgctggggtcgccgccgcttcctcctcggcgtcggattccatcggaccagtgcgaggtgaagaatcggaggagtgaagaacgctcaccagggcggagtcagagtctcggacagtcagacagaacagggcgagaggcagtgcagagcggaatcgggactgggcagcgcttgacgccttggcgcggcgccggcggcgcacgcgaccacaccggggtgccgctgtcgcacggcgataggccgcccgcactcgcctatcgtctctcccctcggccggttgccggtcgtgtcgccctcgcggctgtcgctgttcttggcggcggcgcggcgtatggtatggggatcccccggcgcaggagtcgccgtttcgtcgagtgcccaagtgggggtctcagatttttttgattttttaataattagatgcgtaccgttaaaagattataactttaaatatataccattgattatacatgtcattgactcatgtaaacctcacatgtaagtgagataaaaatgatatatatctacggttgtaatcttttaatggtacaaatccatatttcccatttttgatattttagctctttttcgagagaaaataattatgtttaggcccttagacgacttaattccgttttttgaccttatgctcgacaccacaccccgtggcaccaagttaacacggctgtggtgtacgtgccaagctggcaagcaagggtcgacatggcgccaacgtgcgccacagaccttggtgtcgagctacgcccg

SEQ ID NO: 23825 - DNA, 1207 bp, Zea mays
  misc_feature (2)..(3): n is a, c, g, or t
  misc_feature (16)..(16): n is a, c, g, or t
  misc_feature (20)..(20): n is a, c, g, or t
  misc_feature (23)..(23): n is a, c, g, or t
  misc_feature (28)..(28): n is a, c, g, or t
  misc_feature (35)..(35): n is a, c, g, or t
  misc_feature (66)..(66): n is a, c, g, or t
  misc_feature (68)..(68): n is a, c, g, or t
  misc_feature (71)..(71): n is a, c, g, or t
  misc_feature (73)..(73): n is a, c, g, or t
  misc_feature (79)..(79): n is a, c, g, or t
  misc_feature (84)..(85): n is a, c, g, or t
  misc_feature (88)..(88): n is a, c, g, or t
  misc_feature (96)..(96): n is a, c, g, or t
  misc_feature (98)..(98): n is a, c, g, or t
  misc_feature (104)..(104): n is a, c, g, or t
  misc_feature (114)..(114): n is a, c, g, or t
  misc_feature (124)..(124): n is a, c, g, or t
  misc_feature (138)..(140): n is a, c, g, or t
  misc_feature (161)..(161): n is a, c, g, or t
  misc_feature (163)..(163): n is a, c, g, or t
  misc_feature (178)..(179): n is a, c, g, or t
  misc_feature (183)..(183): n is a, c, g, or t
  misc_feature (186)..(186): n is a, c, g, or t
  misc_feature (191)..(192): n is a, c, g, or t
  misc_feature (198)..(198): n is a, c, g, or t
  misc_feature (221)..(221): n is a, c, g, or t
  misc_feature (230)..(230): n is a, c, g, or t
  misc_feature (233)..(234): n is a, c, g, or t
  misc_feature (238)..(238): n is a, c, g, or t
  misc_feature (241)..(241): n is a, c, g, or t
  misc_feature (243)..(243): n is a, c, g, or t
  misc_feature (247)..(248): n is a, c, g, or t
  misc_feature (250)..(253): n is a, c, g, or t
  misc_feature (277)..(279): n is a, c, g, or t
  misc_feature (300)..(300): n is a, c, g, or t
  misc_feature (302)..(302): n is a, c, g, or t
  misc_feature (310)..(311): n is a, c, g, or t
  misc_feature (313)..(314): n is a, c, g, or t
  misc_feature (316)..(316): n is a, c, g, or t
  misc_feature (319)..(320): n is a, c, g, or t
  misc_feature (324)..(325): n is a, c, g, or t
  misc_feature (331)..(332): n is a, c, g, or t
  misc_feature (339)..(339): n is a, c, g, or t
  misc_feature (342)..(343): n is a, c, g, or t
  misc_feature (354)..(354): n is a, c, g, or t
  misc_feature (359)..(360): n is a, c, g, or t
  misc_feature (362)..(362): n is a, c, g, or t
  misc_feature (371)..(371): n is a, c, g, or t
  misc_feature (377)..(377): n is a, c, g, or t
  misc_feature (380)..(380): n is a, c, g, or t
  misc_feature (389)..(390): n is a, c, g, or t
  misc_feature (393)..(393): n is a, c, g, or t
  misc_feature (411)..(411): n is a, c, g, or t
  misc_feature (413)..(416): n is a, c, g, or t
  misc_feature (421)..(421): n is a, c, g, or t
  misc_feature (429)..(429): n is a, c, g, or t
  misc_feature (431)..(431): n is a, c, g, or t
  misc_feature (436)..(436): n is a, c, g, or t
cnnaaaaagggttttncccnttnggggngccccgntttttaaaagggattttgttccaaaagggananccnanacccanttggnnttnttttttgnantaaaanggttttcccnattttggccntttgggtaaaaaannngttttttaccaaaaattaacngnattttaacaaaaaannaagngtncaaanntgccanttcccctttagggggccaaattntggaaaggnganngggnggncntttnngnnnnacccccactgggaaaagggaattnnnccaaaggaataatttgggaancnagggtttnncnntnccnncgtnnaaaagnngcccagnganntttaaaccgcnccccnnangggggaatngggccnggnccccccccnnggntttttttttttttttttncnnnnttttntttttttntnttttnttttttttttttttttttttttttttttttttttcgcttttgtttttgttgttttttttttttttttttggaaagaaaataagcctctccagctgtcccatgagccatctatgtttctgggctctttttttttttttttttgatgaactagagttcatatatcatatatgaggataagaacagtacagttgttgtactccaacaccatgaaaccaacagttgaccaactttatttattcctataagtatttgtagctgccgtgcgtatgttagccaacttgctccattcagattcagccgctcttcagtcctgctttgatccgcagcccttggggacggtgacgccgcactgtttggtaacgaagaacaccttgtccaggtctagcttattcctggcgtccggggagccgacgtagtcgcagatgcaggacgcgtgcgcgtctaaggccttgatggttttgcagcagtcctcggacggaggcatcttgggcccctccttctggacgaactgcttgcagctgcgccacagtgcgtctatgtcattctggcaggcagagacctgttggtcagctgacaccgctgctgctgctgcggaggccaggaggatgaggaggagcgtcgcagccatgtggccagcagggctcagctgggacatctccgtgtgcgcttctgctggactgggcgggacctcgatctactgattcgtgggcttatcttttgttgtaagtaatataagcgttgtgttgtgcttcgattttcgatttgccaatg

SEQ ID NO: 23826 - DNA, 4140 bp, Zea mays
gtgtgtgcaagagcatacagagttcacgcgcgctgctttgctttgctgtgctccttgagaagggtgatggcgatatgggcactgatgtgcagtattctcagcaatggccatcatggagattgcccgtgttgctgaacacagcctcgtgctgcggcaatcagcattcaaacccagctccccagctgccaaggctgttgttgatcagctgcttggtgttgtctgcaggggtgaatacgatacattgcttctcccatgcatcactggccttggatgccttgcccgtaccttcacagcaagtgagaccaggatagtggcccctcttgtgcagcttctcgatgagcgcgagcctccagtcataaaggaggctgttgttgcgctcaccaagtttgcgtgcactgagaaccatctacatgtgaaccactgcaaagccattgttgatgatggtggtgcgcgccaccttgtccagcttgtctaccttggtgatgaggtgcagattgaggcgctcatactactctgttacattgcattgtatgtgcctgagagcgaggaactcgcgcaagctggtgtgctggccgtgctgctttgggcatcaaagcaggctcaaatggtgcaggacacacgtgttgaggcattgcttccagatgcgaaagggaggcttgagctgttccagtccagggcctccaggtgatgttggagaggggatcgttgggcatgggttagtagttctttattgcaatgtgtaattagagtagaattatctccgtcatccgtaattgctcttgtgaggtacgttacatttttggctgtacatgtgaagtcatatatttgtctattaaattggttggtgttattgaattataaattataaattcatgagacattgaaatagaacatgttgcccaaaaaaattttggccatcgcggcctatcttagaattaatacaaaactacaactgttctgactatagcgtcaaataactatagttcctggtgtctgttcacaaaaccacagctacttgtgttctcagtgcaaaggaacttcagcttttatataaatcgtagtgaaacagtgtgtcaactctaatgtggttgctactgcagtattaagttgtctctaacagaagactctatatgctcctctaccctaaatatagagaagatttctttctctatagcctccaatggtgtcatctaaaacctactctgaatatagagcactccatcccctctatatagagactcttcttctctatccatttttatattttagacaacagattaagcaaaactaaaatatgtttatgacatttgagggtatgacaaatacatacgtaaaaaaactagagcaaaaatgtctctaatatgggtctttgatgactgatgtatagaggacaagatataaaggatgttggagaggaataaaatatagagcagataatcttttcgagaagtctataaaatatagatatagaggacaccactagagacaaccttaggctaaggctgacaggagggtgcatgctcctgttctgttacggttttctagcagttgtagtttcttgttaccaagggtactagtagttgtggtttcatgatcggcaccatagttatggttccttgttacaatgatctggatagttgtagttttgtaaattagttctatatcatatttatccaaatttacagtattatgacatgaattcaactttgctcagaaatttcacttttgttatgtttttgattggggtgagcgacgtcaatgagaaattatagacttacagctgcataactcctagaaatttgtttgtaagcaaaaccagcctggaagtccctgtttgccaaatataggcacggttggtggttgtcctgtatctgtgaatgtatttaatttgctgaatctgaaagtgtgattgttttaaatattagcagtatattttactagtcaagattggacaaatatcgttaaataaaaagttctggaagtatttcagtgttctacttgttcatccgaattggattggtccaatttttttttaaaaaaaatctgtttgttcccatcatggttgcgcttgttcctttgtaatgctgtctgaagttattatagaaacaggttttgcttatagcagttgtatttggaacagcattctaatgcagtaaggaaaatcagcaattataagtggtatcctggtaggcatattatgttctccggccgcatttgcagcatttgttcaatacaattatgcatactggagcccacatgttggtgtcaaaatttcagtctttaagtagtttgagaaattattatggaagaagaccaaacagttgactgatttaaacttgagcaatcagtctctctgtggaataaaatccaaattgtaagtatgctggttttgaatatgcatatttttacatgtttttttttcgcttttgtttatgttgaatcagaaactggatggtagaaagaaaataagcctctccagctgtcccatgagccatctatgtttctcggctctcttacagatttatattatgtgatgaactagagttcatatatgaggataagaacagtacagttgttgtactccaacaccatgaaaccaacagttgaccaactttatttattcctataagtatttgtagctgccgtgcgtatgttagccaacttgctccattcagattcagccgctcttcagtcctgctttgatcctgcagtggaagggacacgaaatgaggagggcagtaaaagcgatggtaacagacgagatctataatgcttaatctatgtatatagcccataactacctgagatctaaaaatctaacggtttattttttgtgcaggtgcagtggtaaaaagtcatcaggtcacaggtaagcaagtcttgatcttcacatgagttgcttgctgagtaggctgttttcatatgcttgtaaatatccctgtctgtttacttgtctgattgatgacagaatattattccaccatgagcacgccacgtggagcatgagctgactgacatcgacatgcaggaccctctctggctgctactgtgagccgggccagcatgtcattgtcgttctcaaatgatcattggccatgcccagctaaagctattatactcaccgcagcccttggggacggtgacgccgcactgtttggtaacgaagaacaccttgtccaggtctagcttattcctggcgtccggggagccgacgtagtcgcagatgcaggacgcgtgcgcgtctaaggccttgatggttttgcagcagtcctcggacggaggcatcttgggcccctccttctggacgaactgcttgcagctgcgccacagtgcgtctatgtcattctggcaggcagagacctgttggtcagctgacaccgctgctgctgctgcggaggccaggaggatgaggaggagcgtcgcagccatgtggccagcagggctcagctgggacatctccgtgtgcgcttctgctggactgggcgggacctcgatctgcacaacacaacgcttatattacttacaacaaaagataagcgttgtgttgtgcatctaagacccggatggcacttggtatttatagtctcctcttgaggttggtttggtaaccatggcaatgcgaattttgtgaactgttttcagggtgctttttttttgggttaagcactcttcatgcaaacaccatcagtgtgaccctctcaaaaaaaaaaaaaaaaaagcaccagactgtagcctagccagtgggagcaggcaccggatggcgtgacagcgtcgttcccacatgatgttgtgagcgggacagccgggcatcgggcctagcggttgaaagtaaactatatgaggtgaatacatgaaatctaaattttataaacttagatagacataactttaatactggcttagtgttacaacaagaatagaaacaatcggagtgcggaggaaagagttctctttgcacaagtcgctcaaatgattgcggattacttcagagagtaacttaattgatatggaatcaagtgcaagagaggagggagaggaacaaccaaattgcaaatgaggatcaacacaaagatgtgggtgatttgtttcccgtggttcgatttcaaagaacctactctccgttgaggggtccacgtagta

SEQ ID NO: 23827 - DNA, 701 bp, Zea mays
gtccaagcagatatcctctcctctattctcgttactacttcgtccttaagcctctccagctgtcccatgagccatctatgtttctcggctctcttacagatttatattatgtgatgaactagagttcatatatgaggataataacagtacagtcgttgtactccaacaccatgaaaccaacagttgaccaactttatttattcctataagtatttgtagctgccgtgcgtatgttagccaagttgctccattcagattcagccgctcttcagtcctgctttgatccgcagcccttggggacggtgacgccgcactgtttggtaacgaagaacaccttgtccaggtctagcttattcctggcgtccggggagccgacgtagtcgcagatgcaggacgcgtgcgcgtctaaggccttgatggttttgcagcagtcctcggacggaggcatcttgggcccctccttctggacgaactgcttgcagctgcgccacagtgcgtctatgtcattctggcaggcagagacctgttggtcagctgacaccgctgctgctgctgcggaggccaggaggatgaggaggagcgtcgcagccatgtggccagcagggctcagctgggacatcgtgtgcgcttctgctggactggacgggacctcgatctactgattcgtggccttatcttttgttgcaagtaatctcgtgccg

SEQ ID NO: 23828 - DNA, 817 bp, Zea mays
ctcgagcccgcccgggcacgttgcggcggcgcagagcacatccccaattccccaggaacaggctcgtaatttttccactgccatcgcaccctttcataaaaccctaaacccaggacccaggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcgcgggcaagcgggtggtgagatgcgtaggatttgaagctgggaacaaactccagaaagaactgtgccctgtcgtgatgtcataaatttgtggtgaaacatcatatcatgaggataaaacttgttgcttttttgtgatgcaattgagaaaactttcgaatttgaactggttcccaatattttgttctcctccctgtcccctgttgaagtgctctctgttttaagttagcaattaacgggatcggatttaaaaaaaaaaaaaaaaaaaaaagaaaaaaaaaaaaaaaaaaaa

SEQ ID NO: 23829 - DNA, 743 bp, Zea mays
cgatctcaaaggggcggcccccgaggccggccggggcgccggcgtctgtccataaaaccctaaaacctccggctgatcggttggtgttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcatcagcaagcctgtcactagtcgttggttctagacttctagtgtgagatgcgtagtatcagattctgggatcaaaatccctaagaactctgaactgtcgtgatgtcatagattttgtgatgaaacatcataattgcctgcttcttgttgcaagcgaacttttgcgtttaaaatggttccctaatattgtgttcgccactcaaaacctggttgcaacgctctctagtttacgttggctggtgattggatttacaggatgtacttcttat

SEQ ID NO: 23830 - DNA, 1274 bp, Zea mays
tacctcgaggccggccgggctcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggtgacaaaaaaaaaaaaaaaggggcccccgacccctccggggcgccggcgtctgtccataaaaccctaaaacctccggctgatcggttggtgttgaggcgagtggaagcttcgagttcttttttccttttggcttattgcgcaagaagggtaacgagaggacggcggcgatggcgaagaggctgctcccgtctctgaaccgggtgctggtcgagaagctggtgcagcccaagaagaccgccggcggcatcctccttccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcatcagcaagcctgtcactagtcgttggttctagacttctagtgtgagatgcgtagtatcagatcctgggatcaaaatccctgagaaagaactctgaactgtcgtgatgtcatagattttgtgatgaaacatcataattgcctgcttcttgttgcaagcgaacttttgcgtttaaaatggttccctaaaaaaaaaaaaaaaaacggccccctggttgtaaaaaaaaaaaaaaaaaagcggcc

SEQ ID NO: 23831 - DNA, 643 bp, Zea mays
atttttccactgccatcgcacccattcataaaaccctaaacccaggacccaggtttatcggtgaggcgagccgcgagtggaactgtggaagcgtcgagcttttttttcttcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcgcgggcaagcgggtggtgagatgcgtaggatttgaagctgggaacaaactccagaaagaactgtgccctgtcgtgatgtcataaatttgtggtgaaacatcatatcatgaggataaaacttgttgcttttttgtgatgcaattgagaaaactttcgaatttgaactggttcccaatattttggtctcccggccccta

SEQ ID NO: 23832 - DNA, 1983 bp, Zea mays
ctccctcctcttgtctattcttcttctccagtgcaaaccggcgcttctcgcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggagcaaatttcgatggcaaccggcgagaccgccgtggatcgtcgcaaggaccctctcggcccccgcgacatggatttgtcaggggaggagcacgtccccaaggcgcggaagccgtacacgatcacgaagcagcgggagaagtggacggaggacgagcaccggcggttcctggaggccctgcagctgcacggtcgcgcctggcgccacatacaagagcacatcggcaccaagactgccgtgcaaatccggagccacgcgcagaagttcttcaccaaggttgtccgagagtcatcgtcaggatgtaacgcctctgcgggcgccgcgccggcgatccaggtcccgccgccgcgccccaagaggaagccggcgcacccttacccgcgcaaggtggacggcgcggccaagaatcccgcgccggagctcaagctgctggagaagctgcccccgcgcgaccgggatgaagggtcgccgacatcggtgcttgcctcggcgcgcacggcgtcgcgagcggaggtgttaggcagcgcgttcgcgaacagctcgagcgccagcaggtcgctggacctttcagcttccggtttggatgagcgtggtgacggcggcggctcgctggtctcgtcggtggccggggagcacggctgcgcatcgccaagaacgagagcgccatataccaaggtgctcgttgaagcaaacgaagtgtcgcatctaggaccggaagctccagtcttgaagctgttcggaaagaaagttgtggtgaaagacctgaaaacggactattcacctgcggctgcgagcgttgccaaggcaagcagagaccataatcctaccggtgccgcaggagcgagctcatggagtccgtgggccgggcagcgtgcaggtgcagcagctcatgtacttcgttccccagcacgacggcctagcggcgcagcccgtcgctccgtggttcggctacagcgggagcgtgccgtgcgcggtgttctacccgcaggcggtgggttcagctcaggagcaccagcaagcttcagagcctctggatcacaaacgcgcgcagagggaaaggtccctgacaggttcgaacatggcctccagcgccgcgtcggcggcgcagaactcggacaccgcgcagtcccgccacggccccgggcaagaaaacaccggcgacggctgcgcggcgctacgggctgccatcccgcggctggccaagtgcgcgagttcggcttccttcagcgggagagggttcgtgccgtacaagcggtgcgcggccgagagcgaggcgccgcgctcggtggcgcccggagaggaggatgacggcgagctgacgaggctgtgcttgtgacaactgacaagagctgaaacctcggtgtaaagaactcacgacgcactttttggatgttgagctgctgctgacatgcatggctgcctgtacatgctctgcagaagcagctagcctgggaacaggttttccaggagagacggatgagcaactctggttctttacccctcggtatatacgcgtatatataggcaaaatctgtactcatattccgcttttgttcactacttgtgtaattttttccccaacatgagatagagagggttgtgtgtgtgtgtcaatagtctgaccacatgtaaattttaggtttgtactatctggacgaaatgtaatagggagcaggcggaatgagccactttacaaaaaaaaaaaaaaaaaaaaaaaaaaaaaaaaaaaaaataaaaaaaaaaaaaaaaaaaaaaaaataaataataaaaaaaaaaaaaaaaaaaaaaaaaaaa

SEQ ID NO: 23833 - DNA, 1433 bp, Zea mays
  misc_feature (12)..(12): n is a, c, g, or t
gagaccattacntagaacatcctaatcgaaaatccacctttcccgcaccttgttgcacataaaaattcccacgccccgcacccaacgacctccgcgtccgcccccaaaacccccgcaaaccctagccgccgccagctaggcaaggaatggccgccctcctgcggctcgccgcagcccgatccgccctccccaggcgcgccctcgccccacaccggaggctcgcggcggcggcggcggccgcgatggaggagtggtggtccgactgggagcaggacggcgaggaggaggcgcgcgcctcggcgccggccgccggccttgaccccgccggcgggggccccgggggcgtgcagtgggtcgtcatgggccgccctggcccgcagaagcacgcccacgccgcgcgcctctccgaggtgctcgccgtgccctacatctccatgggcgcgctcctcaggcaggagctcaacccctcctcgcaactctacaggaagattgcaaactctgtgaatgaagggaggcttgtgccggaggacatcatatttgggttgctgacgaagcggcttgaggacggatacaacaagggtgaaaatgggttcattcttgatgggattccacgcacccgtatgcaagctgagattcttgacgagattgtggatgttgatttggttcttaatttcaagtgtgctgatggctgtttcatgaagaagcaatcgagaggcaacatctgcgcccactgtggacagctctttgacgtcagcaattcagcatctacgaactgtagccccagcctcgggagctatacatggcattctcaggcagaacctgctggtgttttaggcctcgaagcctcaaggatggagaggatgcgcacatatgctgagcagaccaagcagctggaagattactacaagaagcagaggaaaattgtggaactgaagacatctgctcgcccggtggagacatggcaggggctcgtagccgccctgcacctccagcatctggactcgcccccgacaccgcacaaactcaccgcgtaaatatcattattaattttgctacctccgagtagagagtctaaaggatcagaattccgatcctgcctgcagcatatctaatatccctatgtttgtgggttctggctcgagagagtcagtcggctgtcttttgttttgttttgttattgttatagataaaggtaagcgattttgcagacacgcttattgtatggttgtaaccgagagttgtggacttgccttggcttgcgagtgtactcgcttatatgctccattgtgaaaaaaaaatgcacctgtggtagaggcggggcccccaacgcgcggggggccgcccggtgctctgttctgtgcatgatgttgatagtcatgcccttttggaattctgagaagacagcatgtgtgatgaaggaatgtgatagtcat

SEQ ID NO: 23834 - DNA, 2343 bp, Zea mays
gcacgagaccattacctagaacatcctaatcgaaaaacgccgaatgcaccctaagaaaacaccggagggcatgtgccttgtgtgcgcaccagatcagccgaatcgtttctgttgaagaagccatggaatcgcgccgcctcttcctcactcgccgcctctccatctcctccggcgcccagtccagcgccgctttcatcgccgacgaaatctatgccctcctcaccacacgatctttccgggcttccgttaaccgcacggaactgttcatacgctccaaatccgtcacagcctccggcgtcgccgagatgtaccgctcggtggccgttgcaggcccacctgggcagcccctttacctcggccgcgcggcctccgtgctggtcgaggcatccgcgcgcgcggccctccccgacggcgcgctgcggctgctggacctcctcatactcacgcccaaggcgccgctgccgtcgggcgcctcctgcggccacctcatggcgaagctcttctcactcgggcgccacgcggatgcgcgccgcgtgttcgagaccctcggcgatcgccagcgccgcgatgcggtcaccacggtttggagagtcgggagagcggctgacgccgtcaaggtgttcggcgaaacggcggccacgaccacggcgccaaaatattccagtgaccggtatgttaccatgaatatgatgactgactgcctgatgaagggagatctggaggctgcttggaagttgcggacccagatggtggaggcgggcatgaaactacagaagcaccaccagaaaatgctgcaaatgctggaaaaagtcctggtgtgcccagacaacaacaagcggaacgtgcttatcgaagtctgcgtcaaggcaggcggcatggacgaggccgtccattggctccggcagatgggctacgatggcatggaacctcccagtgctcactcctacaacttggtgatcgccgggctctggaaggccggcaggggtgacgacgctgtcaaggtgttcggcgagatgacagacatgctcgtggcgccgaatcatttcacatatactgtcatgatcaatggccacttgaagagactgagcagtgttttgtcctcgaggaagaacgagaatggagatctggaggctgcgctcgccctgctggatcagatggtgcgggatggcttcaagccacacgaatacacctgccatttgctgatggcagaacactgcttagctgaatggctgggagacgttacagctttacataagatcgctcatggcagcctgcttgagttcctatctagaaccaacgaagataagttactggccatcattgaggaatctgcgaagaacggtgctgctgcagcgggtaatgtttgtactacctttctcgaggagctttgcaggattcagaaagtttcactcgcagagaaggtgctgcggacatttgcggaggcagggttggtcccgacgacagagatgtacaacattgtcattgacgggtattgcaagaccagggacctccaaggggcgttcttgttgtgtcgccagatggaatcacatgatcagcttgtacctgatgaagccacctacaagtctctgctgctggccgtgcgcaacgacacaacaagcatcatctactgggaggacgtggttgagttgtttgagaagaatggaattagtactgatgcgctgaactccggcagtcctgctgcatacggattcaagtataggtacagtctagtaactagaaagtttaaggaattggcgagcaagctattttagaatctgcagaatggatattttcattgctgatctacactcttagcttaaactattaaacatatgctcgatgatgcagcatgtattctttcttaagaacttgtggaaccttgtttgctcgatggctacattcagattgaggggcttgttctaacttctaaagcgcacattgattgacctatatatggttcccagctgcctcagtgccttgtcagtttggcacgtcatgtggttactagatttgttggatgcattattgggcttaacgaatttggggcatacaaggccttatcaaatccgaggaaaacgaataaccacgaaggtggttggtgctttaaccaagatgaaaactccaatgtaaacataagcatttgatcatgcaattaggaagtgtttggttgctttagtcaccctcttaaactttagtgtttagaatttttatatactgtttgacagtttagagactcaaagtgactacctttagtcattaaagtttataaggtgggagccaaacaccccgttaatcaagtggactgtgattaattggtcgaattttccttgactagatccacgc

SEQ ID NO: 23835 - DNA, 2573 bp, Zea mays
gccaggaagtacttaatgtttttacatattacaacaaaacacaccctcaagataggcaaatataccaatcatgcatgccttgttacatattgattcaccaccatttttcggcaattgttactagactataccttctagtcttgatgccacactattcaccttacggtgaacagatcaatttcaatgtgtttggtgagattatgtgacacaagattgcttgtgatggtgattatcgatttcttttgggtttttttacattggtgcccttagttgtgccttgttactcaactctacccttagtttttcttcttgcttagttttgcccacggaccccgttcctttgctcagagaaacactcgcacaccgtctccatcacagttaacgtgcctgacagcatgggcccacgtttgttgctacaggtggagcccacaacgaacatccccatcttctatgttcctagaaatcgatccccatccccatttcatcgtcgtcggccgccccactgccaggctccaccactagctcctcgccgccagtccacaccgccgctaggccgctccttcaccagctcctcgtcgcgattccacccagccgccagctcctcgtcgccctgccgccagctcccagagacctccacggcttcatggccaccgagacgccaacgcctcgtcgaggtcctctcctcgcccagagatctccctgcggcgcgccccgtcgagctcctctccgcttgtggttgcggccaccgcctctcacgtcatcttgattggatcgctgcagcacattcccggtcatcgcgtgttatatggagaccgtgttggccgagaagcttgggccagagcatagcgatattagtgaccctaattagggtttgccatgtgtcgtcatttatatgcttaacagatgtggatggagtggtaccatactaaattgtttttagttatttgccgagtattgataagatcatttctctgtcccgcggccatgcatatatcctccatagccactacaggaaaataggcgatttcggttgctagaggcagctaaaaataaatcgtttctaccgaaaatagcttattttcagcgatattagggttattttcggcggcagtaactcgtcgaaagtttctagtcgaaaataaagattattttcgatggctataaagtggccgccaaaagtaatcttgcaaatggttatttcggcggcggctcgttgcctaaaaaataattaagttattttcgacggctcgacctgaccaccgaaaataaaggctgattattttcggcaactagagggccaggtgttagccgtcgaaaattcacttattttcggcggtcattggataagccgcctacaataattgcggcccccgaaaatgtacggttttcctgtagcgagccacaaccatcagaacctccacgagctccactccagtcaccacaattctatgtgaaggacagctgtagctcaagtgtcatgcccacaattgtagcatttcctgccatcaactatgctctgtgtcagctctggcctttgagtcgctcctctattgtttatttttctagaagattattggcgactcacatattttatgtagctccagcatatttcaaaacagtagtttttgcattaattttactcagtcctaatagaagcaggaaagcaactgaaatgaaacaggagactcgacaatactttggttcatacatatacctggggaagaataccacctatcaaggatgccacaagagcaagaacagctccactggaaacaacatacctacaattcagtggggtaaaaatgttcaataacatacaatacacaagatgttcaaatgacctcaatcacagctggatcattcagcattccagctggaaggaacctagaacttactcggcccactgcatcccatatcgcgcaaacacagaagaaataggggtgtccggatccatcgcgtggtacggcaccaaaccgaccacaacagcagaaaccatcatatataggaagcaacacagggataaggtcaggcccatacccaatggaagatcgcgtcgaggattcttcacctgaaaatcactttgacaggcctaattaatggtgatcatgtaactgcacacaagctggagcagaatttacaggaacacaaatggcattttgtacatgaatgtaggctgacctcctcggccgtactagcaactgtgtcgaagccaatgaatgcgaagaagagggttgctgatccagagagaactccgctgataccattagggaaataactgcgtaccagccagacaagtgtcaaagtccaattgggggtcaatttattgatttggttatatgaatcaagaaattttactatacccttctggcactttataaccaacccagccattcctgaatcctagccatccaccagcgcagatgacaaagagcatcactatgatatttgcagtggtgatgatgccttccacagatgagctctgatgaggacataactcatacttgagtgtataattttaagttgaaagtagccaactgttgaactccagaacaaatggagtcataatttcatag

SEQ ID NO: 23836 - DNA, 5911 bp, Zea mays
  misc_feature (2473)..(2473): n is a, c, g, or t
gcttgcatgcctgcaggtacttcattgttatcgatgatgtatgggacgaggaaatatggaaattgttcgaatatgctctcgttgacaatagctgtggaagcagggtgattgtgacgacccgcaattttcgtgtggcaaaactgtgcgcaactcctgttgctggtgcattgtttgaactcgaacctctgtctaacgcagactccaagaggttgttctacaaaagggtatttggtaaagatggcggaaatcataatcagttggatgaaatagctgggagaattttgaagaaatgtggtggggtaccattagctatcattactacagcgagtttgttggcttctaaacccaaatcaataaatgaatggtatcgtgtgtacagatcccttggttcaggacttgagaaagataacactgatataaagcgtatgcatgatattttatctctcagttactatgagcttccttcctatctgaggccttgtttactgtatctaagccttttcccagaggattgcagaattgacaaagacagccttgtgaggagatgggtagccgaaggccttgttgtggatgaacaaggtggggggaatctgtatgagttgtatgaccgtggagagaaatacttcattgagcttgttaatagaagcttcatccagccactagacatcgatggtgtagatggcattccgaatgcttgctccgtacatgatctgatacttgaccttctgatttctctgtcagtcgaggataattttgggttaaggttggattctcagaacttcaccacctcaacagatagtgaggttaacattcgtcgattgtcgctgcaagacaatgaggtggaagtgagtgtgccggaaacagtggacttatcccatgtgaggtcagtaatcgcatttggcgatgcttttaactgggcgccacctctgtcaaggttcaagttcctccgtgccttggatttggagggtttcccacggaagaacaaccatccaaaggaactacgacgcctgcaccatttgaggtatctgcagctccgcgcctttcttccgtcgcgggtgctagaagaaattggaaacctacaacatctgaagatgttggacttgagccatgcatatgtgtcccccctgccagtaagcatcactcggctcagaaaccttcagagtctactcgtcggatcggatgtgaagatgccacaggggatcgggagtctaagcaagctggaagaaatgtcatggatcgaggtggaaccaaacactgcagcggagctgggaaagctgacagaaatgagggtgttgtgcgtacatggactgggttacgatgaggctggcgaccaggcttttctccagagcctgtccaacctacgcaacctcttgggtctattcatcactgagtctgagatgtgttccttagatgacctgcccgatcctggacaggccccagtaggcctccgtttctttcgtggaaccgagacgaccttccagcagatgccacgttggttctcttggctctccgagctgtctggcttaaccatcactgtgaataatctcacacaggatgacatcgatatgcttggagccttgcctgagctacgtcttcttcagctagaagtagccgagaatggcaccattgcccaagaacagctgtccattggtagcgataagctctttcagtcattggaagcattcaaatttaagcactgcgcaagatgttggctggtgctttctcaaggagtgatgacaagacttcaaaagcttgagctgtacttcgaagtgaggaagagagatgacggtgcgattgatgtcggcttggagaacctgacttccctgaagcatgtcactgttgaagttgattgctatggagccaacatcaggcaggtagaggatgtggagaccaagctcagggatgcactggatgcccatccgaagaatccaactcttgagttgtcacgagtagctacccactgcatggaacgggatgagcattcttctgggcgtcatcaaaggtaacgcatgcagttggtctcctactatcctcccacatgaagtcgctactactccttcatttcttcccctaatgcgtccatgttttttcgaccctcttggtgttatacctattcttcagcttcggacggccggcagacgacgatgattacagcgacaatgacagtgatgcttccaaataaagaggtaacatctttgcttccattccatcaatccctccatctaaattttcttatttctatattcctctgagctgttctcatctaaattgtccttttgcagttgagattctgacggtggaggcgctccatgcttgctagttcccaattcccatcgtttgtcactttgttcttcagtttagcagtggcttggtgcctgtctgtgtgcaggacatttgttagcctctatggctgtcaccctccatgtaatcttcacttttgctgccctttctagggcttgtcggttgtatcttnctttcccatgaataagagcgcctcaatttaaacatcatctcctgggtcttggagaccctgaaaaatgtgatgctgtcagaaacactctctcatccattcatccctgcaacgcgtgtttgcaggaacctaaacttgcttccttggatatagttaagagcaaatgtgttccgccctgctgatatatcttctttatgtgatagccaggcagatccgcagatggtaccagcctaccagggggggtcactgtgtatgtatacaagatgtctgctgttttttttttttggccactgctctaatctgaattgatatttagtcagatttgaaactaattttctgaagacatgtatccttttttttcctgtatatctagtcatatttgatattgaataatgtgtagatatgtattttctcgataatccgcagctttagacttgaggggcagaggagacagtagaaacaataccggacatggcagggcgggacggaaaagctttagatttgggagggtaaaagaagcatgcgtcagttgtttgttgtccacttcagtagagggagtgatggagattgcaaggggcagacggcagagggaatatcgcctttgcttcaggatcaagatttggacttgtgccaccactcacctcacctgcctcggtcttctttctctttcttgctcgcgcgctcggacataaacatgatgaatgacctgatggacgaagcattcgatggatcttcgtcagaaatccaggtgctcctcctacatgttgcttaactgcagctgagagggaactaggttgcattagactgagcacagcggttgcgctaccgcgccctctccccttgcgtagggagcttctacgcgcccagcggctgacgctagagagccccctacgcgctgcagccgtaggggtgggagcgggagtcccccagatcaaggggttcactattcaccccctacaacattgtgttgtggggccacgagtaattgttagtagataaaaattggtagtaaatatataaaatgatattttatagttgtagtggggtataggggaagtatttagggggaaccgctgcgggagatgaaaacatagaggatgaaatgttgatgatgtgataaaaaagtgatataggggaaaaaatttaaaggtaacgcttgcggataggttacatgcaagcaccggtgctgtcggcctcctacccgttcgtgctgctggtgccggcctctactctgctggggctacctacccgtttgacctgggagccctgcattgatcgcccgggcttcgtggccaaaccacctgtcggccggcctgcagagggtacagaactgcaggcatgcccccgtctgctgactcgttactgctccctcctagtcccaggagaagcagagcagggtacatgctagaactggtttgacagcaggaggattagttgttaggctctctccaacatagtcggtaaaggcttctctaccctaaatatagaggatcaaacggtcctctaactttagacgacgctgctgattctctatatccatatgattggttggatgcgcaatccgtacaaggctcgcgcaagcctatctctccacaaacatagcttttctccgtttatgtgcatgcaacaaaaaaagcgttaatctagcctatacacggtcatccatatgtagccttccaatcaaacgttggggagcagtcaacacacgaatagagactggttgctgaggagcattcaaccaatcatgtggtatatgtatagttttctctaaacagtcttctatccatttaaatactttaaacaaccggtttagcaaaactaaaatatgtacaatacatttgagagtataaaaaaatacatatgtataaaaatttaaaaataaaaaatgtctctgatataaatatttgcgtatagaggatatgatttagatgacgttgttgaagagaaataagatataaatttatagaggatgaaatcttttagaagagattgtaaaaaatagatataggggtcgttgctggaaacaatcttagtctttgtgagatcatctaaccaagtggagtattattttttatatatataccgtagctaacaaccaatccactagggttttcttttttttaaaaaaaaaacaagtaattcactaatcggcgattgcgtctatccaaactaaactacaggcaatgcatatgcacatcacagcacaacttcgaccaccaatcacctctgccattgccatctgtcaacagaactgaagaacaacacaaaacaaacctgctgcaacatacctgtgcagtgccgctgtgccggccgggacaaaagtgcacaaagtacctggcctgctcacgtttcccatccatccccaccttccttgcatgctccatggatccatccatgacaagctctcttgtgcttggttttggcaaactgtgagctttagttttataatgacgaatatactgaaacggatccatcctcgggaattttcttccattaattcttcccattcatgatccgtatgtaaataaacaatagccttgtccagttctacagtttttactcctccacgcaaataatgaacctaacccacgatttgtacgagaactctggatctcgagtctgtagtttgtaccatgctggaaggacaaaccaaggtgtgcaagaaactcccaagactgcgttttgacgccatggtccttgaaggacgagtgcaccacacgcgcgcggctggcctttggcggagtacaggagtggatgcctgccgtcgtcgtcgtcctgcacgtacgccaggtagctagaacccaattggaagcggccgcttgagccgcggcggcgcggaccggcccggccgtcagcccgcccggatccgcttcttgggcggcagggcgcggaacacggcgttgaggtcgcgcggcacggggaagaaggcgcggcgcggcgccgggaacctgcgcttggcgggcgtcgacggcggccgcgcaggcttcctcggcgccggcgggcactcggacggaggccgcagcctgctcgcctccgacgtcggcgtcgtgggctccggctcctgggcctccgagccgtcctcctcctgctgcttcttctccgcacccggctccggcgccgcggtcctgatcggcggcagcgccgagaggacgtcgatggccgtggagctcatctggccggccgtagagaggaggaggtaagacgagggaggggcgggcggacaagctaaggacaacgcatagatagaatgcaacaaggcggttgcggctagcgccaagccgccgaggcttttaaatacttgtcggagagagaggcagccgatcgacttttctgtgggcccggctttattgcaaccatccactttgctccgtgttaaagatagtggatggttttggtaaacacgcaaagaagaaggggaaaaaacctctttggcatcattca

SEQ ID NO: 23837 - DNA, 2327 bp, Zea mays
  misc_feature (2)..(6): n is a, c, g, or t
  misc_feature (2319)..(2319): n is a, c, g, or t
  misc_feature (2322)..(2322): n is a, c, g, or t
cnnnnntctcgttccaaccagacagaatttatgtactttcgtacatgggcccatcttagtggtttttttttttttttttggggttaacgcttgcggatagcctaagaaacccccgcccccgacacctttgagaaacagcttctgtagccgccacgtgttctcattttctgctatcaaaatgcaaaagacctctagccaaacgttgaactacaaaggtgatatgcgatggtaggccatgcttgccagtgaactatgcttcatgccatagaagatgtatatgagggccccagccaccagccatatggaaacacgaatccacgtgtgactcccgacgttcataagcaggtataagttgaccatgatgcaacagactggaagaaatgggaccaacgggcacatgaaacctccagtttgtcccaagaacttcttgtcttgtccaatgcacaaaagcacaatagaagaacccaacactgccagcccgcctacagtgcatgcgatcctttgcacataaaatggcaaaaaggagacagaaaccgcagaaatcaagatgatggctccaacgcatatcaacactatgcttccaatggctttctgtcgccttacttctctggctacctcactgacatcaagcgcttcttgaacattgctaaaaggatcttctgaattttgctcatcatgctctaagtgcccagagaatgaagctactgcaagggccacttccattggcatctcatacggaggagcatatcttactactaaaacagaaatggcaaccgcagtaaatgccaataaggttcccacgcttaccatccctgccaattgggagacatccatgaaaaaggccaggacagaagcacatgtgccaattaagactgtgctcaagattggcacttgagtttttcgattaacatctgagaacagtggcgggagcaatccatctctagccatggccattataattcttggctggggaagaataccacctatcaaggatgccacaagagcaagaacagctccactggaaacaacatactcggcccactgcatcccatatcgcgcaaacacagaagaaataggggtgtccggatccatcgcgtggtacggcaccaaaccgaccacaacagcagaaaccatcatatataggaagcaacacagggataaggtcaggcccatacccaatggaagatcgcgtcgaggattcttcacctcctcggccgtactagcaactgtgtcgaagccaatgaatgcgaagaagaggggttgctgatccagagagaactccgctgataccattagggaaataaccttctggcactttataaccaacccagccattcctgaatcctagccatccaccagcgcagatgacaaagagcatcactatgatatttgcagtggtgatgatgccttccacagatgagctctctttaattcccagacagagtaatgcagtaactatcaggacaagaatagcagcacatggatcaactggggtgtcgaggcctttgacatgcacctgtgctagaaagaatggcaacttatcttggccaccgaaaaatagagccaagtttggtgacatgccacgtgccactgatgaccccccaatggtgtactcaaggatcaaggcccacccaatcagccaagcaacactctccccaatgcagatgtaggagtagtgataggcactccctgccgaagggaaacggcaggagagctcggcatagcacaatgctgaaagagccgcggcgacgccggctatcagaaaggagagcgtcagtcccggcccggtgtgctcacgagccacggttccaaccaggacatagatgccggcgccaatcgtcgagccgacaccgatggcgacgaggtggggaatagatagcgtcttggcgaggcgctggacacctcccctgtcagcgtcttcggcccagccagcggtcgccggcttccgccgcaccaggcactgcaaattgggccaggaggggcctcccacggccatgcctggtcatccaagggctgaatggatgccgttgggagagaggaggtgaagaactcgagagattgtcaggttgatgcaatcctccacagatcgagatcgctgctgcaaagcgtcaagcgtaataaggtgtttgacctgctccatgtgaaagctggactgctagaacggcattgacttctccttggctactccgcctcagctcgagtagttttctttcggagaagggcaacagccaacagcagctagctgccgctacttgtgaactggactactacagactccctcctgtttcgatttagcataccaggtatgattatttttcnttnattag

SEQ ID NO: 23838 - DNA, 699 bp, Zea mays
aatgaagatgagcaaatgatatgatttattaaaggttgatattatatatggtttattgaaaataagagtaactgctactgaaagtaggatttattcattcattgcctattcatctaagtattcacatatggacgttaaatgacgacgggtgatgttccttctttattcattcgcaagacgggcgagctgtacatcgccctcgagttacaacctagacctccgcagttccagcttggcgattgtcccgagatggacctcgtcggggccgtctgcaatccgcagtgtcctagccgttgcccataggtgcgacaagaccgtgtcagacgagacaccagctgcgccgtgaacttgcatcgccatgtcaagcaccttcagggccatatttggagctgcaaccttggccatcgcgaggataccacgtgctttcttgttcccatgtcgatcgagttgatcggcagcttcaaggactaaaagccttgcctgctccagttcaatccgacactttgcaagatctgataaaaaggaaccatgctgtgcaatcctctttccaaatgcggtcctgtttaaggccctctctaccatcagattcatgccacgttctgctgctcctactagcctcatgcaatgatgtaaccttccaggaccaagtcttccttgagcaatctcaaaaccacgcccttctccaagcggacgcgtggg

SEQ ID NO: 23839 - DNA, 1475 bp, Zea mays
tccaccgcggtggcggccgcttttttttttttttttgaaggtagagccgtagaggcaggccctttatgcatatatatatatggcggttaaaaacatgtacgtgcagggtggttggttaagctctagtacgtcagatgcttagatctagcaagacagcccgaatgggcgtgtcctagcgccaagcaaagtatttgacgtacgcacgacaaccacaatggccgcaacaagctggtacagggcaaaagtaaataaagcaggataagacacgacacaaaagaagcgttaagcactcacatccatatcggccatgtatgaataataactttagtcgccacaaaatcttgaccgagtaggatggccttgaggcatgtgcttctgctccactccatacagcaacggtggttgtcaaactcaaacagagaaatcacatgtcgtcttgggatttttctagagctgccaatcgatggcagacagccccagcttctctaagatctggtttgttttggagaagtgcctgcatccaaagaaacccctgtttgcagacagacctgatggatgagcagatttcaatatgtgatgttttgtttcgtcaatcaatcttgtcttagattgagcagaatttccccaaagaaggaatactaatcctgatttcttttgtgatacagtcttaatgacctcatccgtaaactgctcccatcctttcttggcatgtgagttggcttgatgctccctcacagttaggacggtattgagcataagaacaccctgcacagcccatctttccaaatttccatgtgatggcacagtgcagcctaggtcttttttgagctctttaaaaatgttacctaagctagaaggtatttttatcccctccggtactgagaaagacaaccccatggcctgaccagggccatggtatggatcctgaccgatgatgactgccttgacacggtcgaacggggtggcgttgagcgcgtggaacacgaggtgcggcggcgggtacacgggcagcgggccgtggagcctctcgtgggccacgaagcggcagagctcgagcgcgtatgacttgcgcagctcaccacgaagcgcctccgcccacgtgtcctccaccaggagctcctccagcttcggtgcgccccccgatgcttgcgctttggactcggcgaggcggaggttgcgccgcgcgcgggcgagcgccaggttggtgtcggcgcgacggcgctgctccggcgacagcgaggagggagaggagttggaggagagggaggcggccggggcagcgcacaggcgcttggcggggcgcgcgaagaagtcggcgatagttttgggtgccgccggggtgggaggggacggcggcattggctccggatttgggggatttcgggaagcggcggcgagggacttcgttttggtcagcagccaccagcccacggctctcgcttttgggtgggcccggccgggggcccgggtaccca

SEQ ID NO: 23840 - DNA, 2264 bp, Zea mays
catcattgggcccccccccccccgccgttgttggcttcgtggtccgtgtttaacgggcgtagagagagaaagagaacagagcgagagagggggaggacgaagccctccgcgtcgtctcctgctgttccatcccacatctattctgcctcggcttgcaccttcgacctcgctgaaagttctgacctcaaactgaaaggggcctgtgaagcgtttccttgcggcagtgcaatggaggtatttggcaaatctgtgattgctgagcccagcaatgtgattttcttgtccgcaatccttaacacagaaggatcaaaccctagtcacaagtgtgacaagaggtgccagaacgagaacatttttgggaacatgtaccgttgcaaactgactggaaccactcacatctgtgacaaaaactgtaaccagagaatcctctatgacaaccataactcgctctgccgagtgagtgggcagttttttccgctctctccattggagcagcaagcagtgaggggtatccgcaggaagcacgaagtggacagcaatgaaggctgctcctttaagcgcaggcgtggtgcacagctgcatccttcccccttcgagaggtcctactcagctgtgtctccaatcccgagccaggttggagatggcatggacctgagctagagctaacgagacttccttttcttcagccaaccacctaattccgttgtctaccctttttccctttggttacaggatggaactataagagattccttctttgtagacttttatgaagggatataagactccttagatgcaccgaataaatgtctatgtagtttctattctgtttcatgggaccttgttgtaactcgtgaactttgattgagcacctattcggatttagtagcacgttcagaaaatcattcgctgcttatcttttttcacacttccgagttagttattttgtgtgtttttttactttgtgttcaactaagtttccttctaattttgattctttaatgcaatttattataattgaggtgtacatttgtccatcaatgtaaatatgtgaaagattctttggcactgtaatccaggcacagggaactgactgcctttgctgactgaagtttttgtacagttgttactagtgttttgcttgtcaagttcctaatcaagcttgaatcatttacggtctgttctcatatagctcaactctatctgtttcttaactcttttttttacaggttatgtttctaacgcttaatgttttcctcatgttcttttttggcttaacatttgttgtctgcaggaccatccaggttctaatcgttttttgggaaatgtttcgttcttttttatataactatattgctaacttaatttaatttgttgattaattggcctttctttgtttttgcaggtgaacatctctgattccattttcatctgttgggtggcaagaaactaatcaaggagtctctctcttctcattctctgcgtggaggactgtttagctgtagctgagtggcatgctttccaggtaactgattagccacatccacatgtagcagtgtcggaacatgattacctattacatctttgcactaggctcacctgagtgttatttatacaacctcttcctcttgtatgcattgagcattttgcatattaactgaaaataaaaagagcatgttgcattcgagacgattgacaatcatcgatgacattttcagttccatgtcagtatgtcgggaagttagagtgtgtttggtttgaggaatgaagtgattcatcttcttctcactcctcacttttttatttggtttgtggaatagaatgagttgatccatcaccaccacattcttcataagctaataattagtatatacatgagggttgagttgattccaccaaaattgatggaatgaacttataatgcatcccctcatgaagcataaagtgactccacaaaccaaacacaccattagtttcttttgctgtcatgccacaacctctgttactgaaaataaataagccataaatcaaagcagtccctttgctcatgtaaaacagatgttcttgctctatagactgagtgagtagtagtagtagttctttttctcattctgttctagtatgccaacattaagatttttgcaccttgagattttccgcaacagtctagtttagggttcttacatacaacatgatatgtacatttcttatccacttaagggcgtcgtgccggtgatccaatagctagctcaggaagatctcta

SEQ ID NO: 23841 - DNA, 747 bp, Zea mays
cattgggtacctcgaggccggccggggttgttggcttcgtggtccgtgtttaacgggcgtagagagagaaagagaacagagcgagagagggggaggacgaagccctccgcgtcgtctcctgctgttccatcccacatctattctgcctcggcttgcaccttcgacctcgctgaaagttctgacctcaaactgaaaggggcctgtgaagcgtttccttgcggcagtgcaatggaggtgaacatctctggttctattttcatcgtcgggtaacaagaaactaatcagggagtctcttcccatttcttgcagtggaggaatgtttagctacagccgcgcagcatgctttccagagcataaattggtggaagagaagtttgatgctaccactttgccagaagaaccgagccagacacaataacatcaaactgagtctgagatactgcactttacaaattctttcgatattggcagattgaagaccaacaagatttgaagagcagcaagatcagcttgcacctgcagtttgaagaaatcctttcaaagaagactgcttgcggcaatcttgccttcactccacaagcatgtgctgtgttatgcgtaccatgtaatgattgtagtacttgacaactgataccaaagtagtggatgcttttctttcgcatgaagtcatgttgatttttgtacgttctaacagcgtctccatcaatatcctattgaatctcccatataaaaaaaaaaaaaaaaaaa

SEQ ID NO: 23842 - DNA, 895 bp, Zea mays
ccggccccccggggccccgcgggccacgggcgtagagagagagagagagagagagagagagcgaagagggcgtgagagaggagggaggccaagccgtacgcgtcatctcctgctgtttcttcggttcttcccatccctttcctgcctcggcttgcaccttcaaccttgcttaaagctctgagctcaaactgaaaggggcgtgcgaagagttttcttgcggcagtgcaatggaggtatttggcaaatctgtgattgctgagcccagcaatgtgattttcttgtccgcgatccttaacacagaagggtcaaaccctagtcacaagtgtgacaagaggtgccagagcgagcgcattttggggaacatgtaccgttgcaaactgactgaaaccactcacatctgtgacaaaaactgtaaccagaggattctatatgacaaccataactcgctctgccgagtgagtgggcagctttttccgctctctccactggagcagcaagcagtgaggggcatccgcaggaagcatgaagtggacagcagcgaaggttgctcctttaagcgcaggcggggcgcacagctgcatccttcccccttcgagaggtcctactctgctgtgtctccaatcccgagccaggttggagatggcatggacatgagctagagttaatgagacttccttttcttcggccagccacctaatttcgttctgtctaccctttttcccttcgattacaagatggaactataagagcttccttctttttagacttatatgagactccttagatgcaccgaataaatgttcatgtagtatctattctgtttcatgggaccttgttgtaactcgtgaactttgattgaacgcctattttgatttagtggtactttcagataatc

SEQ ID NO: 23843 - DNA, 1202 bp, Zea mays
cgggacgggcgtagagagagagagagagagagagagagcgaagagggcgtgagagaggagggaggccaagccgtacgcgtcatctcctgctgtttcttcggttcttcccatccctttcctgcctcggcttgcaccttcaaccttgcttaaagctctgagctcaaactgaaaggggcgtgcgaagagttttcttgcggcagtgcaatggaggtcaacatctctgattccattttcatctgttgggtggcaagaaactaatcaaggagtcccttctcattccttgcagtggaggactgtttagctgtagctgagcagcatgctttccagaacataaattggtggaagagaagtttgatgctaccactttgcgagaaggaccgaaccagacacaattcgcatgattggttgcccgctcgcgtccatccatgctctccacatgcattgaccgagtgatgaacagtgtttggtttcttgtatacacgagaccagggactgcacccgcagctgcaggataaactagaaatagcacatctagttgcatatctgattgcatgcatagatacgcacaaaaatcccgtttccggcgggccaagcacacatgagccatgctacgctcatccagctatccaatcaggtgcaataacatcaactgagatactgcagtttaccaactttttcaatatggcagattgaagagcagcaagatcagcctcttccatatgcagtttgaagaaatcctttttaaggtctattagactagaatccttccggcaatcttgccttcaccccaagcatgctgcataccttgtaatgagtgtggtacttgacgactgttaccaaagtttttttgagggtaagactgttaccaaagtagtggatgcttttctttggcacgaagtttctttcatatccacctagtttgtctgtaagaaaaagcgaaagaccgagaaagacggtcagactaaggtgaatgagacaatttaaattttcttccgaaaaaaaaaaaagttcaaatctaactccaaagcaccaaaagcacaaaaaagaagttcacactagctaaatgaatatcgagagaaatgcacgaaacagggcgggtccaagcgaagaagggtgggagcccagacccaaaaatcaacacagcctggctcgcgttcaatcaaagtccacgagttacaacatggtcccataaaacatagata

SEQ ID NO: 23844 - DNA, 1880 bp, Zea mays
tattaatcagcccccttcctccacggtcgcgtttcacgggcgtagagagagagagagagagagagagcgcgagcgagcgaagagggcgtgagagaggagggaggccaagccgtacgcgtcgtctcctgctgtttctccccatccctttcctgcctcggcttgcaccttcaaccttacttaaagctctgacctcaaactgaaagggacctgcgaagagttttttttgcggcagtacaatggaggtatttggcaaatctgtgattgctgagcccagcaatgtgattttcttgtccgcgatccttaacacagaagggtcaaaccctagtcacaagtgtgacaagaggtgccagagcgagcgcattttggggaacatgtaccgttgcaaactgactgaaaccactcacatctgtgacaaaaactgtaaccagaggattctatatgacaaccataactcgctctgccgagtgagtgggcagctttttccgctctctccactggagcagcaagcagtgaggggcatccgcaggaagcatgaagtggacagcagtgaaggttgctcctttaagcgcaggcgcggcgcacagctgcatccttcccccttcgagaggtcctactctgctgtgtctccaatcccgagccaggttggagatggcatggacatgagctagagctaatgagacttccttttcttcggccagccacctaatttcgttctgtctaccctttttcccttcgattacaagatggaactataagagcttccttctttttagacttatatgagactccttagatgcaccgaataaatgttcatgtagtatctattctgtttcatgggaccttgttgtaactcgtgaactttgattgaacgcctattttgatttagtggtactttcagataatcattaaaaaaaaaaaaaaaaaaaaaaaaaaaaaaaatttagttattttatgtgctttactttttgttcaactaatttgccttctaattttaatcctttgatgcaatttaatataattgagaggtttacatttgtccgccaatgtaagtaagtgaaggattctttggtcctgtaatccaggcacagggaactgacatgccttgcctggccgcggccgtggtacagctgttactagtgttttgcttgacaagttcctaatcaagcttgaatcatttacggtttgttcccatatagctcaattctatctgttgcttaactcttttttttacaggttatgtttctaacgcttaatgttttcctatgttcttttttgtcttaacatttgttgtatgcaggaccatccaggttctaatcgttttttgggaaatgttttgttcttttttatataactatattgctaacttaatttaatttgttgattaatttgcctttctttgtttttgcaggtgaacatctctgattccattttcatctgttgggtggcaagaaactaatcaaggagtctctctcttctcattctctgcgtggaggactgtttagctgtagctgagtggcatgctttccagaacataaattggtggaagagaagtttgatgctaccactttgcgagaaggaccgaaccaacacaataacatcaaacttagatactgcagtttaccaactttttcaatattgaagattgaagagcagcaagatcagcctcttccatatgcagtttgaagaaatcctttttaaggtctattagactagaatccttccggcaatcttgccttcaccccaagcatgctgcataccttgtaatgagtgtggtacttgacgactgttaccaaagtttttttgagggtaagactgttaccaaagtagtggatgcttttctttggcacgaaatttctttcatatccacctagtttgtctgt

SEQ ID NO: 23845 - DNA, 1392 bp, Zea mays
aaacatagaggcattccgcagtccgcagtccatccgcagtccgcagtccgcacgcacggacgcgccctcccagatctcccgcctccggcaaacaaaatgcccccactctcaccgcccgcatcgctgacccccgctgctggcggtcggcgacggtggaagtgccgcctcagtcccactatcgcacgtgaccgctgctacactcgctccttccgctccgcggggctccgcccggcggccattccgctccccgatggcgccgtctgtacacctgtggctcccgcctcctgccgccgaccccgccaagcccctataccctgttctgcttctccacggcttcggcgcacaagccacctggcagtgggcgcccttcctcggcccgctcctcgctgccggtctggccccctatgtcccggacctcgtcttctttggcgcctcatcctcccccgcagcagaccgctccccggtctatcaggctgcctgtgttgccgccgctatggccgcgcttcctggcgccccgcagcggtacgccgtcgtcggggtcagttacggcggcttcgtagcataccacctcgcccacgcgtttccggcagcggtggagcggcttgtactagtcgcggccggtgtttgcctcgaggaggccgatctggccgcggggctctttgccgttgaggatatcgccgaggctgcaagtcttttgctgccccagcggccggaggatctccggaggttggtggggctcaccttctgccgccctcagcggttcatgccgtcctgtttcatcagagattacatcagggttatgtgcacggaaaatgtaaaagagaagagggagttgctgtatgcattgatcaatggcaggaagctttcagaccttcctaaaattaaccagcaaaccttgataatttggggagagcaggaccgggtctttccattggaacttggattacggctgaaaaggcatctgggtgatacttccgaactaatcattgtcaagaatgccggtcatgccataaatcgcgaaaagccagcagaactttgcagactgataaagcactacatcgttgatccctcagtcaaatgtcgagatgaccgtaagggatcttggaagaatgcgataaagaggtttgttgggtcgagcctgaggaaggtggactcttctcgaccgctgctatagcaattgacgtatatatattgacttttacgtgcagcagatttgttatctgattgtgacacgcaattaagtaattaacgatgtgtaatgtccagtagccactattattgtgtaactagcattggcagacatctgttcaaaaaatacttgtgcaatatgtataatgcaaatgattaacaatttcttagttacagccaaaaaaaaaaaaaaaaaaaaaaaag

SEQ ID NO: 23846 - DNA, 1812 bp, Zea mays
  misc_feature (17)..(18): n is a, c, g, or t
ccaaacgttatggatgnntataattttttcatggagaaagtaatatttgaattcagtcctcccaactgtgtctgcactgaacatcttgagggaaaattggctagatctgtacgttttcttatgtgctattgacatagtaagtggttggtcaatcttgttaaatgcacataagatttactcaacattttctttgtgttgtgttgcaggttatgtgcacggaaaatgtaaaagagaagagggagttgctgtatgcattgatcaatggcaggaagctttcagaccttcctaaaattaaccaggtaatgattagcatttgcataagcacttgaacttgatgagaccatactagttccccagccaaagcttctgcttttttgactgttaaagaatataattgtagtatatttcattgatttgtcagcaaacggctcgataatttggggagagcaggaccgggtctttccattggaacttggattacggctgaaaaggtttgtttatttatatgtgtcatcaaattcaagtctttaatttgattcattaatctttgctctgttaagagggacaaaacagacattttaaccttctgtataaaaaatctcaggcatctgggtgatacttccgaactaatcattgccaagaatgccggtcatgccataaatcgcgaaaagccagcagaactttgcagactgataaagcactacatcgttgatccctcagtcaaatgtcgagatgaccgtacggtacacaattgaatggtatatcatgggattcttgaaaccctttaggtcttgttcaattagaggttgatcgaagaggattaaatctcttgctagtcaaaattgaatagaaagatttagggcatgtttgattcgtgactaaatgtttcacgctttgcttaaggttaatcgttcgaatcgaagaactaaccttacagaaaagttaggcaaaacgtgacaacttagttagcgaaccaaacatacccttaatctctctgtctcctgtggtcccatgcaacccaacaaggccttagacccttagcaggaagagttgcagttgcctgagttttttttaaagaatcccatgtatcacattattttttacttcactttgacaaactttgcttccctttgcagggatcttggaagaatgcgataaagaggtttgttgggtcgagcctgaggaaggtggactcttctcgaccgctgctatagcaattgacgtatatatattgacttttacgtgcagcagatttgttatctgattgtgacacgcaattaagtaattaacgatgtgtaatgtccagtagccactattattgtgtaactagcattggcagacatctgttcaaaaaatacttgtgcaatatgtataatgcaaatgattaataatttcttagttacagtacataaacatattatacaaccacaagggtgaatatacttacacactgggtacctttattagtaatagtgtttagctaatacaatatattacattatgatgttttggacataatcggataggcataggctgcattggctggtaacttaagaaggcttccctcctttgcactgctttggatgacctgcaaccgttgatatgtggattaggaatcaaataaacaaatcatgcctggtaaaatattaagaaaaaaaggagtgttggtaacaatgccttttttaccttagcgcatgtagcgatggcctatctgctttgtcgcatgtacatgagactacgagatgactggtgtattagcgcctttgttttcggaccatgtgcaaaataaatcgggtaaatggagcccatggg

SEQ ID NO: 23847 - DNA, 1107 bp, Zea mays
ggccgcttggccgctttttttttttttgggcggcggcggccctttttttttttttttttttgaattaaagcgcatagcactcattgtatatattgggtataacaaattatattacatgcattaagaaaaataaaaaacaaccgagagggacatataataaataaagaaataaacaataataggcaagcacatcccatgtgtttgccactcgcattccatacgctgatgcacgtacatgtttctatatcaccagggtgcaacgtatacactgttagttattccagagaatgaagaggtttttgcgtctagtcggaggaactgctgctggagggcgcctccgatgacgagtctggggatgaggcggagtcggggctaggagcgggagcatcggccgccgcctccggtgcatcggcggatgccatggacctaccctccacgacgtccacgcgtgcggcgcccgcgaacggtgccaccgcgatggcggccaggaggagcacgacgaggaacacgcatgcacgagccattattccgatgattcttgctcgctttcctgtatgtgttgtggctttgtttcgactgtgatccccgcccccggccgggggcccaaccccccataggagtagtatattacatgcattaagaaaaataaaaaacaaccgagagggacatataataaataaagaaataaacaataataggcaagcacatcccatgtgtttgccactcgcattccatacgctgatgcacgtacatgtttctatatcaccagggtgcaacgtatacactgttagttattccagagaatgaagaggtttttgcgtctagtcggaggaactgctgctggagggcgcctccgatgacgagtctggggatgaggcggagtcggggctaggagcgggagcatcggccgccgcctccggtgcatcggcggatgccatggacctaccctccacgacgtccacgcgtgcggcgcccgcgaacggtgccaccgcgatggcggccaggaggagcacgacgaggaacacgcatgcacgagccattattccgatgattcttgctcgctttcctgtatgtgttgtggctttgtttcgactgtgatccggccgg

SEQ ID NO: 23848 - DNA, 679 bp, Zea mays
ggcggccgctttttttttttttttttttgaattaaagcgcatagcacacattgtatatattgggtataacaaattacattacatgcatcaagaaaaataaaacaaccgtcgtcaccatagaattaaagcgcatagcactcattgtatatattgggtataacaaattatattacatgcattaagaaaaataaaaaacaaccgagagggacatataataaataaagaaataaacaataataggcaagcacatcccatgtgtttgccactcgcattccatacgctgatgcacgtacatgtttctatatcaccagggtgcaacgtatacactgttagttattccagagaatgaagaggtttttgcgtctagtcggaggaactgctgctggagggcgcctccgatgacgagtctggggatgaggcggagtcggggctaggagcgggagcatcggccgccgcctccggtgcatcggcggatgccatggacctaccctccacgacgtccacgcgtgcggcgcccgcgaacggtgccaccgcgatggcggccaggaggagcacgacgaggaacacgcatgcacgagccattattccgatgattcttgctcgctttcctgtatgtgttgtggctttgtttcgactgtgatccccgccggcctcgggggggccaatcgcccataggagt

SEQ ID NO: 23849 - DNA, 598 bp, Zea mays
ggccgggccgcaaattttttttttttttttttgtactgagaaaacggtgccatcgtcaccatagaattaaagcgcatatcacacattgtctatattgggtataacaaattatattacatgcattaagaaaaataaaaaacaaccgagagagacatataataaataaagaaataaacaataattaggcaagcacattccatgtgtttgccactcgcattccatacactgatgcacgtacatgtttctatatcatcagggtgcaacgtatatactgttagttattccagagaatgaagaggtttttgcgtctagtcggaggaactgctgctagagggcgcctccgatgacgagtctggggatgaggcggagtcggggctaggagcgggagcatcggccgccgcctccggtgcatcggcggatgccatggacctaccctccacaacgtccacgcgtgcggcgcccgcgaacggtgccaccgcgatggcggccaggaggagcacgacgaggaacacgcatgcacgggccattattccgatgattcttgcttgctttcctgtatgtgttgtggctttgtttcgactgtgatcatcccggccgg

SEQ ID NO: 23850 - DNA, 828 bp, Zea mays
atatgcaaacgaagcacaaattaccactagctcgatacaaggagacttatgacatcacacaataatacaagagcaccaagtaacttttcctatatctatcatgggtacaaatgctatatggtcactgccctagcacccaatggatcaaacgacacaatactgctaggaacaccgactgtacaaataaaatgaactgagaaaacggtgccatcgtcaccatagaattaaagcgcatagcacacattgtctatatatattgggtataacaaattatattacttgcattaagaaaaataaaaaacaaccgagagagacatataataaataaagaaataaacaataattaggcaagcacattccatgtgtttgccactcgcattccatacactgatgcacgtacatgtttctatatcatcagggtgcaacgtatatactgttagttattccagagaatgaagaggttttggcgtctagtcggaggagctgctgctggagggcgcctctcacgatgagtctggggatgaggcggagtcggggctaggagcgggagcatcggccgccgcctccggtgcatcggcggatgccatggacctaccctccacgacgtccacgcgtgcggcgcccgcgaacggtgccaccgcgatggcggccaggaggagcacgacgaggaacacacatgcacgagccattattccgatgattcttgcttgcttttcctgtatgtgttcttgcttctcgaagttcacggtcgagaacttcctgcacgctcagccctggatcgatcccacaggcacgccgtcgaagtacgatctgttcacatgagcgccc

SEQ ID NO: 23851 - DNA, 1659 bp, Zea mays
  misc_feature (1623)..(1625): n is a, c, g, or t
  misc_feature (1628)..(1628): n is a, c, g, or t
  misc_feature (1636)..(1636): n is a, c, g, or t
gatcaagggctgacttctctcttctataaaaatattaaaaatatatgtttatatctaattgttaaactgcatgtcaagagaaaatagaacactacggtccttcctgttccttaattttttttttttttttgatttaatttttctgcctcggatgacttgggatatatgaaaacaagagcgtacaattgtttagccgatttggagtacaattacatgtcacgctattattgatgaagcatcagcgtcgcagtactatatttatctcgtcatcgtctgagctgaccgcatcaagctcaacaatattctctgtaggattgttcatcttttgccttttaacatcctgttgtggttttcgcaatccctccttgggcaaggctttggcgccagatgatgacaaacttttgtttaagccggccttcgatctctgttgattcctagagccggtggttggggcttttggtaccatattgtccatattagctgtaacatgggaaagaaatcttataccctgggactggttcttattagtcactctatctgcattgcttaaagccctttttagcccatcaattgacattactttcaccggttgcaaagaatttcttggattgggtcgttctgaggaaggattgaccatgtaaatcccttcagatcgaagtttggaagcaaatttgaaatttccgcccttaagctctactctgccagtagtatacttttgtgatgttttcgacgaatgaaatttgcagtatgatcctttactcttatttatagccatggtgcaagccaccccgtctttcctcttgcctttgcagagaccaaaatctgatgcgacccccatcttcaacatctgtccaacagaagcaacactcatagagaaccctttgcccccattgtccatgcggacattgccattgaacacagcgaacactgaacccacagcagctccggagtagtgaacgtgcgcgtccccaaacaggaacagagatacgtcggtctcgtccagagcgcccatcttccagatgctgtagctgctccccttcgcactcacccgctgcacgcccttgtccagtaacacgcccgcggttgcccaacagccggagaacctgtcgctccccacagagttctttaacgcggtgatgcgcacaaatcggatgtcagcgaagcggttgctaatctcaagaggcgagagcgtaaggtgcttgatgcggaggccggagtatttgtcgacgaggatttcggtggccttgggtcgcttggggcgattagcaagcggggaggtggtttcgggggccgcctcgaggtaatccttgacggcgtcgcggaaaacggacatgtcggtgccgccggggggcgccgtccttggtggtgtgaaagcgccgtcgcacacggggacatcggcggtgcggggggaggcgggaggtgtctccgggacggcctcgcctagtgatagcaggaggtccaggtcgtcggcggcgttcgccatgtttgcggtgaggtgcgtggaggacaggcagcggggtactgaggattgaggaatcaggaatctgtgattgtgcgaggtgggagatagatgtaggaggaggatgcgagggaaactgtgttcggcctcggcccgcccaatgnnnaanttttttcnccggccggctcgaggtaccaatg

SEQ ID NO: 23852 - DNA, 1990 bp, Zea mays
ctcttaaactaataattagtatatacataaagcatgggttgattacacaaaaattaattaaataaacttataatgcatcacctcattaagcatagagtgactctacaaaccaaacacaccatatatgtctcaatcacctccaaactacatacaacaaacaccagactgcgtgccacgatctcggtaaaagttggcactaagtctatcttcagcagcttccatcccatctcctattttaaatttcaactctactatgttttcaaaacattgtttttaatttataagactatatgtcaacagattcgtcctaataatgcgagcggcatcatataacaacgcaattatcttattggggtttcttctgaacctacacacacgcgtcaacgcctccgtttcttccccggatgcccagaacccagctgttctggacgagaacgaacgacgcactccgaacagtctttaccaatactcgagacagccagccacctatagtactacaatgaacggctacgggctacggctaaaatatctctcagtgtatctgcctatctatacataagttttgcataaaagcgcactttctaacagctggagggagggcgcaaggccagcgtcattgttcctcatgtacgtctgtctcgtcgtatatctcctcctgcaggagctcctctatgacatcctccatggttatgataccaacagcctcttcatcttcgctcagtgtgggcaagggctctttatggacctgcagaacgtctgcttgatctttggaccattttttaggcctatttcctctatttgatgtgttctgagtgttagggtagctcttccatctttgcagtggtggcggaaggtttttcacgaccttttcgttgttcttatcatcaatagcaatggacacctcaaaagttccaccatcattagcagcttgttcagctggttggtaacttggattgtttttccttatgactacagccatgtggctgtgacctttctgaaattcgtttaggatgtcatagaggggcatttcttctagaacacgaggaattttgcggatagttacactttttataggaacctcatcatcagcactaactgataataaattcttcaccaatatcaatccaataatattcgttttcttttcataatacacaggaactctgctatgccctttctcaagtacctcttgcattagattcctgtcaagttttgcatttatatcaattgcaaatgtttgacacaagggtgtcatagcatctttagctttcttttcagtcagttcaagagctcctgatattatggtagtttcatcatgggttaattctccacctttgccagcctcattcccgtgcagagtgacaagtgtttttagttcagctctacggaagagagctgtctgaccatgacccagcacatagtccaatagcttgcttataggataggcaataggaaagcagacccaaacaagcacacggactaatggagcaactgaggcaccaatagccagcccataatgtgagcagatggactgtggtaagatctcaccaaaaagcagaatcagtgtcactgatattaaaatagcaccccaagctgtcaccaagctatcaaggaatatgggcaaagcctccattgcagccgcattgcagattagaagagtgcatagcagaaggtgctggttcttcacaacaggtaaaatcttagctgcgtgcttgcgatcctgctcggtgccggacttggcgaggacctcgagatcgacgaggctgagggacatgaggcccagggtgaggcccgacatgaggcccgcgaagagcacgagcacgatgatgatgacgatgtgctcgaaaaaggccgccgagcagcagtggtactccaccgccattcacctccgccgccggctcctctctcccctcctgcttgacgacgagagccaccaccaccagaagcttctcctccgctcgacccgcgaactcaccccacctcctgcgtc

SEQ ID NO: 23853 - DNA, 1526 bp, Zea mays
  misc_feature (39)..(39): n is a, c, g, or t
ctgagctcgaggccgctttttttttttttttcttagtcntaaatcagataattgtccgggttgcgacaggagcaaccaaccataaattttcccagaaagatgcggcgtagaccggggccagttgccgtttttttttttttttgtagcggaagatagagatttaaataagataatacgatgcgtgcatgcatatgcataggctgaaaccatgagttgcaaagacatatatagagcgtcccgatcatatcgacgataacgactcaaagcaaagaactaacacactcagaggaggaagaaacagggtaatgaacgggcaaagacaatcaggtggctggctacggactgaagcggatttattctgtttggtccaagctgcccgttcgctgtccgggtcacgcactccatgtctccatctactggcacttggcgtttgggaggttgcacgcggaagggatggccttggcgcagctggcgtagggcgtgttcttgagcttgttccagtagttgctgcagaggcagccgaagtcggcgttcctcagcgcgtcgcagcacccctggctcggcgcgccgctcgagcaggacgcgcactgcctcagcaccgtgccccggtcgacgttgcacgtcccgtcggcctcgctcgccgcgaagagcagcgccagcagcgcgacgcccaccatggccacggccacggccacggcactgttgccgcgcacccttctcccggccatctgagatcggcggatgtcttggcttcgctaggctgctgacctgctgtcagtttagacggagcgtggtgtgtgtaggctagtgtgatctgcacttcccggccggccgggggccccaatgtccatggagcttgatgggccggaccgacggcacacgagcagaggtgctccgtgagtccgtgacggcgtgcttgcatgtgcaaatgtgctcgcgagctggcctccggccgtcggcaccccaaaaaagtggtcggccggccggtcacgggcaagacggaatcatcgccgtacgtatgtactgcagagtaaaaccatctttctagaggtatgtctttgcatatggaacttccactaggagctcacattctagcttactacttatgaaaatatttgctgatactgagacaacgtttgctcctatgcaacatacaccacatggaaatataaatgttatggagccatacttttgctcattggagtataaatgtcttgacatgctgaactttgtgccatttgttcataataatgaaattatcactggctataaattttggtgattgaaatttgtgaacaagtttttttagactccagaccgataggccctgctttatagaaagcaacgttttgctggggagaccagcttacaaagggtagcattgagttatgccattacatgtttaaagtgggattctctctaaactccctcttccttaagcaaaaccagaaaggtaagatacccaacattgcattcaaagctgacacactgccaccatagctctgttattcagctaactgtctgca

SEQ ID NO: 23854 - DNA, 810 bp, Zea mays
ccaattagtcctaaatcataattgtccaggttgctacaggagcaacaaacataaatttctcttgtttgttgcggcgtagaccgttgacatttgacgcgacttcattcagcagtagcggaagatagagatttaaatacggtagtacgatgcgtgcatgcatatgcataggctgaaatcatgagttgcaaagacatatatagaacgtcccgccggctagcagggcagccgatcatatcgacgataacgactcaaagcaaagaactaacacactcagaggaggaagaaacagggtaatgaagcggatttattctgtttggtccaagctgcccgttcgctgtccgggtcatgcactccatgactccatctactggcacttggcgtttgggaggttgcacgcggaagggatggccttggcgcagctggcgtagggcgtgttcttgagcttgttccagtagttgctgcagaggcagccgaagtcggcgttcctcagcgcgtcgcagcacccctggctcggcgcgccgctcgagcaggacgcgcactgcctcagcaccgtgccccggtcgacgttgcacgtcccgtcggcctcgctcgccgcgaagagcagcgccagcagcgcgacgcccgccatggtcacggccacggccacggcactgttgccgcgcacccttctcccggccatctgagatcggcggatgttttggcttcgctaggctgctgacctgctgtcagttagacggctctcggtgtgtgtatgtaggctagtgtgatctgcacttgccggccttgaggtaccactttcttctttttccc

SEQ ID NO: 23855 - DNA, 2206 bp, Zea mays
ggcccctttttttgttttttgtattccagttagttggtagtagtttccggctttgttttcggcgttcggcgctgcccaaagaacttacaccctcagggggggaagaaacagggtaatgaagcggatttattctgtttggtccaagctgcccgttcgctgtccgggtcacgcactccatgtctccatctactggcacttggcgtttgggaggttgcacgcggaagggatggccttggcgcagctggcgtatggcgtgttcttgagcttgttccagtagttgctgcagaggcagccgaagtcggcgttcctcagcgcgtcgcagcacccctggctcggcgcgccgctcgagcaggacgcgcactgcctcagcaccgtgccccggtcgacgttgcacgtcccgtcggcctcgctcgccgcgaagagcagcgccagcagcgcgacggccgccacggccacggcactcttgccgcgcacccttctcccggccatctgagatcggcggatgtcttggcttcgctaggctgctgacctgctgtcagtttagacggcgctcggtgtgtgtaggctagtgtgatctgcacttcccgcccgcgcgtccgagggacgcccgatatagagcttgatgggccggaccgacggcacacgagcagaggtgctccgtgagtccgtgacggcgtgcttgcatgtgcaaatgtgctcgtgagctagcctccggccgtcggcaccccaaaaaagtggtcggccggccggtcacgggcaagacggaatcatcgccgtacgtatgtactgcagggtgcagagagttcatgcaggcgccgtgccaatgggcaagacggcggcagcggtttattgctggaatttggccgcatctcgcgtgccgtcaagctaattttggtcaatgtgactagtggtcgtaggcgggggacacggggtggcgtaccgtagcgccgtagcggggtaaaataaccaacctatcgccatgcttgtgactctttcgtcagttagttctacttagctcatcccctagttctcgctaggatttctttcgtattggcagcagatcggtgatgggctgacgaagaacgtgcccgccagcgtgcacgatgcagatgcctatgcctcccttcagttttctgcattatcgatcgatacacgatcttaaacagcgatgaactcacgaaattaattcaaagaccgattatcgagatatcaaccctattattcaatatttttacgcttgagttttgatgtaggagttgaaacgcgcggtctgaactgacgactaacgacaccctgaacctaattcggaaacagtctacaaccaaaaagaaaaaagaaaaaaaactgactctcaaaccacgtcctcaacttgcacatattcagtttggcgtcagaatcctggagccaagccttcgtcgagtcgatttttttcgtccagatatgcggctgataaacctactactcgcgtgccattattaggacaaacctaaagctgataaaacaaacaaacaaacaaacatgaacccagtcgtacacgcagtgcgccatgctcttagtgcgtttatgttttatggtagaaatccaaacaacgtgtttacagaatacaataatattttaatgcatgcttttcaaaagtaaagcatagtgtacaaattaaaggagataaaacccaatacaagagaataataatgatatgtctgtatcgttaaaaaagtataagagttagccattcgttctagagcatgggctgtgtttagtggtggtaatggaccacgatccattttttcatgattagtttaagcatttaattaatttttgtttaaaatgaatagaaatagagtcagattctagtccgattcgattcttaaatttcatagtgcaaaattcagagctcattatcacccctacttgtgttagatggtaaacgacatcaaattgcatctcctagcatatgacaagatgatcgcaatcaaacaaaaacatctacagttacctgtattacaattgacatcaatgtcggccactcagtctagaacataggttatgttaggatgtctgggtctgtgctttgtggcccttgtgtggccaagagcatgagcctcaccgtaggcatatagattttttttgtactagtggacatcgatcctttctggccattaagacgttgagggccctacaaggttcttacgtgttttcgatggtcgga

SEQ ID NO: 23856 - DNA, 645 bp, Zea mays
  misc_feature (14)..(28): n is a, c, g, or t
tttttttttttttnnnnnnnnnnnnnnnacgatagtaagatgcgtgcaggcgttttttttttttttttttttgagttgcaaagacatatatagaacgtcccgccggctagcagggcagccgatcatatcggataacgactcaaagcaaagaactaacacactcagaggaggaagaaacagggtaatgaagcggatttattctgtttggtccaagctgcccgttcgctgtccgggtcacgcactccatgtctccatctactggcacttggcgtttgggaggttgcacgcggaagggatggccttggcgcagctggcgtatggcgtgttcttgagcttgttccagtagttgctgcagaggcagccgaagtcggcgttcctcagcgcgtcgcagcacccctggctcggcgcgccgctcgagcaggacgcgcactgcctcagcaccgtgccccggtcgacgttgcacgtcccgtcggcctcgctcgccgcgaagagcagcgccagcagcgcgacggccgccacggccacggcactcttgccgcgcacccttctcccggccatctgagatcggcggatgtcttggcttcgctaggctgctgacctgctgtcagtttagacggcgctcggtgtgtgtaggctagtgtgatc

SEQ ID NO: 23857 - DNA, 1653 bp, Zea mays
ggagtctgttggagttggtctcattcgggcccctcaggccggccggcaagcatttaggtcttacgacgcgcccaaagctcacgccggacctgctcctctccgacggcggcatcggcttcgtgctccgctactttcccaaggcgttcaagccccgcccccgcccaggccacgaggtggacgacctcgccaacctcatcaagctctacgcggactggcactcccgcctgatcccctactactccttcgaacagttcgtgcgcaaactcgagaaattgggtgccggcaaccgcgtcagggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgatataatcgctagtgtcaaggctgaactaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaatttggttccatttttatgttattattagtagtagtaaacaccgaggatttggatcctgggaacgaacgacgtcgtgttggctttggctgggctcagaggaacgaatactgaatcttgggtctgatgatctgatcctcttgtgcccccaatccgatgataaatttggcccctctcacaccaaaccaaacactatggatttcctccgtccgttttcaaacaaaaaaaaaaaaaaaaaaaaaaaaaatttccacatactagtgcattgtgtgtggcatgaataggtgaatagcaataatcttccatcggcatgtgaaatgcttatgacttcatcgatgggtcgagctgagtacaacatagcatgaatgaagaaacccactctttgaattatgatttacaaagccattttgc

SEQ ID NO: 23858 - DNA, 1575 bp, Zea mays
cattgggtacctcgaggccggccgggttctgcaccgcggacgcgtggggtccaacagcggcacagcccacgggccacgcccagttgatatccctgatggcctgatgtcgcaactcgcaaccctagctcccagcctcccactcccacgcgcttcaagtcttcccaggcggccggcggcgtactcccagagtcccagacggccaatcttcccagcatcgggtggcgtcctcactccaggcggcaggcggctgcaccgccgcagtcacgaactcacgcgcaccgcgggcccgcggcagcgcgcacacgcgcacacgcgcacggcgcaccagcagccgtgagccggccagtccggcagtcccagcctcccaggcggccagtcctcccagtcccagtcccagctgcctaggtctgccgcctgtcttgaccccacccactggccacttcccctcctgtccgttcccaaatcccgtcccctccacccgcactccattggcgccgctcccctcccctcgccgccgccggagatctgatccgatccgtttgtgcttgtgctggacgatggtgggcctctctgaaggggagaaacacttcatccgcggcggcattgcacaagacgttcgcactgatggacgtaggcggctgcagttccggtccctctccgtccaaaccggagtcattccacaggcgaatggctcagcgcgtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagttcgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaacactctatatttacaaagtcattttgctctctatatttacaaagtcattttgctctcaaaaaaaaaaaaaaaa

SEQ ID NO: 23859 - DNA, 1344 bp, Zea mays
tcgaggccggccgggctccaactcccgccagaaccctcgatttccctttttttcccccttgcccaggaccaggagcaagatccatccatccatccccgattccccaaccctaagcagccatggccgcgccgccgcccacgggctgcttcaagtgtggccgccccggccactggtcccgcgactgcccctcctccgcctccaccaaccctcctgccgccgccgacgcgcccaccaaccctagccacctctccggcgccgcctcccgcttcaacgccaagcccaggccccccgcggcggcggtggatggcgaggacggcaaggggaagaagaagaaggagagggccacgcgccccaagctcacgccggacctgctcctctccgacggcggcatcggcttcgtgctccgctacttccccaaggcgttcaagccccgcgcccgcccaggccacgaggtggacgacctcgctaacctcatcaagctctacgcggactggcactcccgcctgatcccctactactccttcgaacagttcgtgcgcaaactcgagaaattgggtgccggcaaccgcgtcaggagatgtgtttccgaactcagggatagggtcgccagaggcggtgatcctacgcttctgcacgaaccgccagtccacgaagacatgccattgccaggcggaggtgaacatggtactgaagacccagttctcggcaccgatgctccgctgtcggacaaccatggcactggccccgtggtgcaggaagacgcagatccaccgatggagagcaacgacgtggtggatcccatggaagaggatctgcttaacgaaatctacgaaaacacagctgatatcccggctggtgagggagccagcaaggagtctccggagcagtcggctccaaaagaagccaactcgctggcgcaggaaccccaggacggcgacgtccccaagccggcgaaggttgagctcactgaggcgcagaaggcacgcatggaggccaacaggctcaaggccttggagagagcggcggcacgggctcgtgcctcgcagcagcccacctagatacgcaagatgctgctgtcttcacttcacttcaatagttggttggttggttgagatgatgcatcattctgtggtgtgtcattgacaaggacacgtagttcgctggtgtctgattgaatctgggtctgctctagtcgatttggtccctagtagtatgtaacaggagaagataagagtttgttggatgtgcttgaaagcttcgtcctgttctcgcttccccaaccaattctagagtcagaattccatgtcattcaagctgatcttctcattaaaaaaaaaaaaaaaa

SEQ ID NO: 23860 - DNA, 1334 bp, Zea mays
aatcaaccaccttataattcaattcgccgtttggcagatgcataagtctgtttcgacaaaaacaaaccatgcgacatgcccctgtttataagatgcacatatatacgcgctaatgaaatatctcattacggtcagacatgatcaaacacgtttcaaccccacggctgctatttttcagccctgttcctttgctttaattatcaacaccaaaactatgatcagtacagattaccctctttacacaaaattatttctatgtgtgctggtcatggatcatcctccatgcttatgtacatatatggtcacagccagcacaatgaatactgcagatgccgactgcattgctaacctctgcaggataaccctcgcctctaaaaggcaacccctgtcagcttattgtcactgcccaccgcactgacggcttaatcacccgatttcgctgctttccgtatgattcccatgccttcagtcagtagaagtctcctcccaagttcagcataataaattacttgtcttgtcatttagcatcttggtgttctcatcttctgtcagtggattaggctggagtgttctcatcaccttgaacctcttctctatcataatcatgggctcagtgattttccgcttcatttaccggtttctcatgatccgcagcagcagctagttccttgtcatcagtaatgctcttcatcagcctttttgatcttttaggtcttgattcgggcatctgttcgttttctgtgttactactccccggatgatctcccacatcggcctctccattcttgtctatattgtcattatcatgagtattcgtatgtttcttgtgggagctctttttctttttgctggtcgttttgtcttgatctacagcttctgcagtagcatcatccaagtcttcgagcgtcaaatctccttctttgtcaaccttgatgcccttcgctcgtctcctcttttgtcgatccttcgcctgcatggatatttctttcaacttgtgtgcaatctgtgtgtcatcaataagtaatgaaacaacatcctcttgtctcatcaaatgatcgtcctggacatgtttccccttcataactaactcttgcactgcatttttctgctttgctctttgcaatattttctcctcaatggtatctttgcatataagcctgtacacagttacctcctataaagaccaagtctgtgtgttctatccattgcctgctggtcttgtgttggattccagtcaatttcataaaaaataacagtatcagcagcagtcaaattaataccaagccccccagctcttgtgcttaacaagaaaacaaatatgtcattcctgttct

SEQ ID NO: 23861 - DNA, 3011 bp, Zea mays
ttttttttttttttttttttacacgaaccccagaagctttacttgtatccaagtgcttgtatgtgctttatgtacaaggacaacacaattacatggagtggttagcacatccgttatgttatcttacaacagcacgagcacctcacgtatgcatcaaatccgcatctgttggatattcttcagcgaaatgcagaattggaggttccttcctaaccaacacagcaagtcgtagaaaccgtaacatccccagttctacatgatcgacggaatcgagtcattcttatccgagaagaatgacaggtttcgaaatgcatcgaggctatttgccatcaggcggttccaattccaactactttgactgtcccctatcagtatgtcatcggtttgatatctcacagccggtatgtccaagtccagtggtccgagtgaatcaggccaatatatgtcagctaaaggttgatccttcaactcattagttttgtcatttcgaggtggtgatttagcataaaactcctcttcgtctttggcgtcatcattacaaggattatcagcatcagtctctcgtccagtcaagtcctgaagaaaacctcgaaatccttctgaatttgaaggatgaacttcattgtcagtatcaggagagctgctgtcgacgcggcccccttcctgcttcctggaggctgacaaattaaaactgaactcatcacatgtttcttctgctccccatatgtttgaatggggagcatgggctggctgttctgatgcttgataacgagaagcatgaagggcaacaacagcatcaaacgagtcatagctgcatggattctcaagaaacaaaggatcttttacactagtccccacgcaatctaaatctttggatgcttctgtcagtaagtgctcaaccctgatatctgtaagggtatctgcccactctacttcagatattgccacacaattcattccctgatcatcctgaagtacacgtggatactaagttataataagagaaaggaaggccatagaaacgtttatttgtcagaaggatgcaagagacagaaaatataacctcaaaagcttgggttacaggaacctgcacttgcttttggctgccaaaccgagagtggggcacattagccggctgatccggaagctcagagttcttgcctgtactggatggtgtcatatgcaataacattgaactgcaaggatatgactcatgagtgcaattactgagcaaagtaccatccttttgcacacaagccttatctcctgatggtgatttgacttggatgacttccggtctcatgcaatcttcaaaatgtgttaaagatatgtcacttactcctgctccaagctcaacaagggaaaaccaaccataccttaacaacaaaatgttgacacaaaattagcatcattatgcatctacaactgacccattaggttgcgactttctatcgatcagagaaattatataccttaaacggaaaacagaagggctattcacagaaagaaacacatcagcgactgcaacagtatctcttgttgtccatctctgatatgtagccaaatcctcttgattagcacaatacggaaaaagaataagctctccagatgcgatgtttgagttaccccattttcggtttagatgttctagcacagatgatattttcttcctagagcttaatgtgagctctaaatgaggattatggtcatcctgataagaggagaaaaggcaacatgtaatgttcaaattgctcacagattggagaactgaacagaactgaccccaaatcaattacaaagaaaagtttgcgcaaaatgcaaagggagctatttgtcgtctttcgtctataacatgcatgaattcaacaacaagaacctgagtgctcggtcaataattcacgagtaacaactgtcatgttaaaaatacagcgactgagggaaattgtgattcatatgcagtttgctagtagcgagaaacaatgtttaccttctccaatgcctttcgagtagcttcgtttattggaaataactgtagcttcagcttcacaggtgcttgtgaatctgtttccttcatatgatttgtgctaatgcctgcaaatgcagaacaaaaacatcatgacagtagacctgtatctgctactgttaatttcaatgtgtgttgaacaaagttcaacaactacaagaactaaaatccagttgctacaagccataccatcaccagtagaaagtctgtctgatgatgaagtcagtgttcttgcatcaacattacataacatgcctgggttaatcgtgttgcgctcgagctcctcagccgcatcagcaactaaagaaacaccagccatggccgctctctcccattttttatatgcggcagatgcaacagcaccacctaaaacacaggtcaccatctatccacattaatgcaatgtaacaaaggttcaccactagagagctcttctacatgatagtttgatagtttcaatcatcaacgatttcaccgagactcaaatcacacagattgtgtggcaaaagataagcaaggctaggtcataacaaaagaacagactaacagagaacatgcgcccacctgccttccttttctgtttcacggttcttgtggcagagaggtcccctttagttgttcctgacttgttagaaattggttctgcaatccgcttgaaaattgtccctttaggagatgctactctgctaccattttgagaatctattgacaagaactttacaggaggagtctcatccccaggagccttgctgataactggagatggagaagatatgcacatatccactcgtgaatgctttttcctggacttatttctgtccttcagcagttgttttccctagcaaacaaaaggagatacacatagcatgagaaagaagaaacaaactgaaacattttataatgagaaaaaaaacatggggagttggggacaaagcaactcaccaatgcttctacaaatgttttgaacctccgaggcttcaggggtacc

SEQ ID NO: 23862 - DNA, 3469 bp, Zea mays
  misc_feature (350)..(350): n is a, c, g, or t
cgagcccaccatgacacgaagccacatacaacacaacactcctggataataccacctcgttagatgaagagaacgagacatcgagcgagctataaaaaagaacatgtctcattttgaactcatacctccttgaccttctagctaagataaagtgtaaattctgtagtttaataactggtacgtgggtcatatgtccactttaattttaaatttatttttatgaggagggttcactttaattttaaatttattttatggggagggtctattacattgtcttgccactagatccgactcttgggtgtcgcacaattgttgcactatactatcgaatatgattgatgtactgncacagcgcacaagcattttatagtataaaggcatgtacaacccatataaatgattcatattttaagcggtatttaagaaataagtgcaataaaaacaccatacatgtatttggtggagaaacgtctctagtatggttctctaagcgtaagatacgattccatctataaaacccatataaagccttgccttaagtgattctagtaaataatatatttgattgtataaacgaatttgttagatgtatttagtgcttctagaaccgctaggttgtacgtgtcctaaggagctgagagcctcgtagcctcaaagctgacagaccttaccgtaattccagcaatttccgttacgcctcagcgcctcagaggagagaagcttccctgcatggctgcattacgggcgaggcgagtggtatagctggtaggtagtccgttacacgaaaagcctaatcttgcaactcctctgacctctctaaccgccattcaggactcggggtaaacgcaaaccagcagctacactctcgtctccctctcctccgatccattgtgacttgcggctccccaccaaggcacaacaacttacaatgtcattggcaacggcgaagctacgggagcgcacgcagttcaggctgtccgtgctgccgccggcgtcgccaccaccgttcatgttccaggagcacccgttcggcggcctgccgtcgtgtccgcccggatcgcccgaccccgtcatcaacaacctcacggagctcgagagggtgggcgtcctcggccatggcgcggacggtacggtctacaaggcgcggcaccgccgcacgggcgcggagcttgtggtcaagtcgctgcgcgtgcgcggcgacggcggcgccgcgctccgggaagccgacgtgcacctccgcgtggccgccgcggcgcccgaccacccgcacgtcgtccgcctccacggggtcttctccgcgaacccggccgcctgcagcgaccagcagctcctgcgccttgtcctcgagtacgttcctggcggctcgctcagcgacgtgctccggcggcgcggccgcccccggaggacgccatcgcgggcgtggcgcgcaacgtgctctgcggcctgcgccacctgcaccgcctcggcatcgttcacggcgacgtcaagccgtcgaacctcctcgtcggcctccacggcgaggtcaagatcgccgacttcggcgccagcctccacgtccccagcggcggcggcggcgcgcaccgagcggccggcgccgaggggacgtgcgcgtacatgagcctggagcggctggaccccgaaggtttcggcgcggcctcgccgtcgggcgctgccgacctctccagcgacgtgtggtcccttggagtggtcctcctagaatgccacatgggtaggttcccgctggtggcggctggggagaggccggagtgggcggctctggtggtggccgtgtgcttcgggagcgcgcccgaggtgcctgtgacggcgtcgtcggagttcagggacttcgtgcggcggtgcctggagaaagactggaggaggagagccacggtggacgaacttctaggccaccccttcgtcgcgggagggccgccatgttgcgccaccaccaccaccaccaacgagtggctaaccaacttccatgacgaactgatgacagtcgaacgcaaagaacactcctgatacagaactcaacgaacgtggcaacgacgagaataaagacctaatggtgatcaacggtcgatgcaaatccaactgaacatgaggccagccaagcgaacttgatcaggtttgggagcataattcagaggtgtctgaatcccgcggcagagctggtgatcagctgcagttgctttgtgaggccgcaaaacgactggcttcatgagccgcccgtggtcgcactcgcaggtaaacaaaacatgcagtggtttgcaaacagatttgggtgaatcatcagtcctaggctgcgactgcgacctgctcaaagttgagctccaagcgtccaatggtacaacttaccgtgttcatgtattttttttcttcaattcgaacgcgtacaaaaagtagaattgaacgcatataaaattttcagttcgcacgctcaccagccgccgccgatcggctatgggcgagttctctaaaacttatcggattttgccctgttatttcagctggggaatcggaattcctccattccttgtgtgtgtgtttttgttgaatcacggtttaggctttgctttgctacagaatccataaataactatagaccgtccatctagatgtcaattaccatgtattaccttgtacgaggtaatattgtgattatgtttatcttttttatgtttgatttgctttatatgaaaaacaacacaatgatatatatatatatatatatttatgcttgatcatagctatatatggaagcattaaacaagcggcgggagaagatcaaccagcacttcatcgagctctccactgtcatccccgacctcaagaaggtgctgatccaaccaactttatcactatcccctgcgacctacatcatctgttattttgttctctgttcctgacgaaaataaaattaattcgtgaaggagctccaagaaaagctcaaggtgcttgaagacggtggcaatggtaatgaccagggcatcaaatctatactacttattaagaatgcaagggtagcctgcctccttgcgttctgccgttggacgatctcagccgcccgttctatccttctctgatctaagccgtccgatcccacacaaaattcccactctccgatcctgcccaccagccccgaagccattgcgccccgaaaccatccatgcatcgccgtccctcgacgcagacctgcacccgttcgccaccagccgcacgctcgcaatccacttggaacccgtccccagcctgcggcgccgccctccgccagaaagtctcctccttctgtcgtagggccttgaactcgtccgtgaaggcgccgaaccgctcgagcaggtcgtcgttgagggcgacgagccagtcgtgcgcgtcgtcgaggtcgcggcccatggggaacagcggctgccgcgtcgggagaatcgaagccccgccgatcacgccgagggacgcgtcggccttggcg

SEQ ID NO: 23863 - DNA, 2574 bp, Zea mays
gggccccccctcgagtttttttttttttttttttttttttttttttttttttcggtcattaggcaaacttatcttatactcggccccaggaagctttacctgtacccaagtgcttgtatgtgctttatgtacaagggcaacacatttacatggagtacaggttagcacatccgttatgttatcttacaacagcacgagcccctctcatatgcatcaaatccgcatctgttggatacccgtatcagcagcaaacagctcacttgggcaatataaagctccctcttccgggaatggcagattggaggttccttccttaccaaaacaaatcgtggaagccctaacatccccagttctacatgatcgatggaatagagtcatttttatctgagaagaatgacaggtttcgaaatgcgtcgaggctatttgccattagacggttccaactattttgactgtcccctataagtatgtcatcggcttcgtatctcacagacggtatgtccaagtccagtggtccgagtgaatcaggccaatatatgtcagctaaagattgatccttcaactcattagtttcatcatttcgaggtggtgatttggcataaaactcctcgtctttggcatcatcattattataatgattatcagcatcagcctctccagccaagtcctcaagaaaacctttaaatccttcagaatttgagggatgaactccattgttagtatcaggagagctgctaagagtgtttgaaccttcttgcttcctggaggctgacaaattaaagatgaactcatcacatgtctcttctgctccccatatggttgaatggggagcatgggctgactgctctgatgcttgataacgagaagcatgaagggcaacagcagcatcaaacgagtcatagctgcatggattctcaaaaaacaaaggattttttacactagttcctccgcagtccaaatgagtgcctttagatgcttctgtcagtaagtgcccaaaactgatatttgtaagggtatctgcccactctactgcagatattgccacacaattcattccctgatcatcctcaaaagcttgagttataggaacatgagcttgcttttggctgccaaactgagaggggggcacattagctggctcatctggaagctccgagttcttgccatcactttgaacacaagccttatctcctgatggcgatttgacttggatgacttctggtatcatgcaatcctcaaaatgggttaaagatatttcacttactcctgctccaagctcaacaagggaaacccaaccataccttaaacggaaaacagacgggctattcacagaaagaaacacatcagctactgcaacagtatctcttgttgtccacctctgatatgtagccaaatcctcttgattagcacaatatggaaaaagaataagctctccagatgcgatgtttgagttaccccattttcggtttagatgttctagcacagatgatattttctttctagagcttaatgtgagctctagatgaggattatggtcatccttctccaatgccttccgagtagcttcatttattggaaataactgtagcttcagcttcacaggtgcctgtgaatctgcttccttcatatgatttgtgctaatgccatcaatgctagaaagtctttctgataatgaagtcagtgttcttgcatcaacattacaaaaaatgcctgggttaatcgtgttgcgctcgagctcctcagctgcatcagcaactaaagaaacaccagccatggctgctctctcccatttcttatatgcagcagatgcaacagcgccacctgccttccttttttgtttcacggttcttgtggcagagagttcccctttagttgtccctggcttgttagaaatcggttctgcaacaggaggattctcattcccaggagctttgctgataattggagatggagaaggtaggcacatatccactcgtgaacgctttctcctggacttatttctgtcctttagcagttgtttccccagtgcttctacaaatgttttgaacctccgaggtttgagatgcaactttgatgcagtgcagctaaatttctcaagcagagaccaccagcgaagcatagcagcaatggtatccttggagttttttgcatcaagtgagaacctaggacccagtagcttcttcatgcgccgaacaagacgataatagtaatgcctgacctgatccttgtttttactctgaacacggtgtgtaatcttgtcaaagttttttcctacttgccgcagcgcattgaaaaaaatctcctcctcttggtgtgtccacgcagcccattgtcgagtctgcttttttgcaggtttcctgttaggatcagaaggctcgggggcggacccagtgtaggacatgggtgtacacatgtacacccgataaatggtgggtgttgatcggcgaaggacccgacgaagaccagacggcggtggcggtcgtctagtagctacacgagagagcgcctcgcgcacggtggacgggcagaagaaaaggtttttcgattaggatgttctaggtaatggtctcgtgc

SEQ ID NO: 23864 - DNA, 963 bp, Zea mays
atcctgccttcggaagccactgctaaccgctttctctgcccttctctacctacataagcgcgagggagcacgcctcccggcctctcctcatgggacctcgacccggccggcccggcatccaattcctatgccctgcacccgcagacggggagctcgcgtcttccttcggatggtggatgcatgcatgcatggtagacacgccggcccaaccagaattgacaagtggaagcgtatgggtattaccagcaacgacgcggcccctcgtgccgtcctcctccgcttcttgtttctgctctgcataggctgcaaatgcctggcatcagaggtagaggccacccagacggcgaccctcgcggtggacgcctcgccgcagcttgctcggaagatccctgatacactgttcgggatcttctttgaggagatcaaccatgcaggggctggtggcatatgggctgaacttgttagtaacagagggtttgaagctggaggcctccatactccatcaaacattgacccatggtccatcattggagacgactcctctgtatttgtggagaccgatcgcacatcatgtttcagtcgaaacattccgttggcctcccccgggatggggggggcccccttttccgcaaaaaattgtccccaccccgggggggggcctccctcgccccctcccccccccccccctcccccccctcccccaccccccctcacctatcccccccctccgccccccccgccctcccccccccccaccccctcccctcccccccccctccccccccccccctccccgccccccccccccatcccctccctcccaccccttctacccccccccccccccccccccttttttcccctcccctacttcccccccccccccctcacgccccctcccccccccccccccttcacctcctcaccccacaccctcccctacaccaccccccctcccccccc

SEQ ID NO: 23865 - DNA, 909 bp, Zea mays
ttggccgccccggccggccggccgggctccaattcctatattccgctgccctgcacccgcagacggggagctcgcgtcttccttcggatggtggatgcatgcatgcatggtagacacgccggcccaaccagagttgacaagtggaagcgtatgggtattaccagcaacgacgcggcccctcgtgccgtcctcctccgcttcttgtttctgctctgcataggctgcaaatgcctggcatcagaggtagaggccacccagacggcgaccctcgcggtggacgcctcgccgcagcttgctcggaagatccctgatacactgttcgggatcttctttgaggagatcaaccatgcaggggctggtggcatatgggctgaacttgttagtaacagagggtttgaagctggaggcctccatactccatcaaacattgacccatggtccatcattggagacgactcctctgtatttgtggagaccgatcgtacatcatgtttcagtcgaaacatcgttgctctcaggatggaggtcctttgcgataactgtcctactggtggtgttggtgtttacaacccagggttctggggcatgaacatagaagaaggaaaggtctacaatcttgttatgtttgttaagtcaccagaaacaactgacttgacagtttcactaacaagctctaacgggttgcaaaatctggcttcagctacagtaacagtttccggcgaatcaaactggataaaagtggagcaaaagttggttgctaaaggaaccaatagaacctcaaggcttcaaataacaactaacaagaaaggagttgtctgggtttgatcaagtatcactcatgcctgaagacacatacaagggacatggctttcgcacagacttataatccatgatttttggatttaaacc

SEQ ID NO: 23866 - DNA, 826 bp, Zea mays
  misc_feature (777)..(777): n is a, c, g, or t
cggccgggcgtggttttcgggttccacctaactcttgtatctgccttcttctctcgtgtgttaggtagacacgccggcccaaccagagttgacaagtggaagcgtatgggtattaccagcaacgacgcggcccctcgtgccgtcctcctccgcttcttgtttctgctctgcatacggctgcaaatgcctggcatcagaggtagaggccacccagacggcgaccctcgcggtggacgcctcgccgcagcttgctcggaagatccctgatacactgttcgggatcttctttgaggagatcaaccatgcaggggctggtggcatatgggctgaacttgttagtaacagagggtttgaagctggaggcctccatactccatcaaacattgacccatggtccatcattggagacgactcctctgtatttgtggagaccgatcgcacatcatgtttcagtcgaaacatcgttgctctcaggatggaggtcctttgcgataactgtcctactggtggtgttggtgtttacaacccagggttctggggcatgaacatagaagaaggaaaggtctacaatcttgttatgtttgttaagtcaccagaaacaactgacttgacagtttcactaacaagctctaacgggttgcaaaatctggcttcagctacagtaacagtttcccggcgaatcaaactggataaaagtggagcaaaagttggttgctaaaggaaccaatagaacctcaaggcttcaaataacaactaacaagaaaggagttgtctggnttgatcaagtatcgctcatgcctgaagacacataccagggacatggctt

SEQ ID NO: 23867 - DNA, 1514 bp, Zea mays
cgcttatcaacttaatttttcggtaattagtacaactttaaatgtctcccttattcttgtaaatcggtaccactatacttcactcgccaggcatcttgttcggtcggaagattggttgaccaacttggttaaccatactatagctatatccccgaggtatccccatacctcaattaggatagcattagggatcatcttgtcaggcatcctttgattgccatattggccacaggaaataagtgcatctgttaccgatgccaatggaacggcataatgcacacgtaaacctacctagcgttgcatgcccttactcccagggttccacgccaactgtcaactaaccagtacgtataggttaaacagcaacgaacagtctggaggtataagaatatttcactggtgcattccacaaccaaatcacaaggcatacagagaaggtgggggaaacagacctcctgaagggcggcgcggacagcatcctcgacgtcctcctcctccttggcgggctcggcggcggcggcggcggcccatacggggcgcggcggcgcggtggtggcgaagtagtcgtcgtcgtcgtcgtcctcgacgtctgcccaggacttggtggtgagcggcgcgggagcccagaagacatccttctgcggcggctcctgctgctgctgcgcggcccccgcgccgtgcttcttcctggaggacggcccggccgccctgcccttgtcgcccttcttcttcttcttgagggactcgagcgccgcgaacacgttgccggtgttgagcttcacctcctccgccgccgctcctccccgcctcccccctcccaccatgctccccgaccgccgcggtgggaccccggcgaggctagccgagcgaaccacggacccgaatctgaatctgccccgcccgccgatctgcggggacgagtcggcgcgggagggtcctcgccgcctggggaccgaacttggattgggatttggggtagggatggaccgatggaggcgcggttgctagggttttgagatgggtggagccgtggagggtggagactggagacgcgtgccgcagccctcccctgtccggcgtttgtttaagcagcggcgcaacgcagatacgagagagagacacaggcacggtggtcagctggtctgctttgctcccgtgctaccttacttatcgctagctacaaacgagtcttatccacccccaccagcattttacacattgccagactgcacacgccacgcgctgcctcgtcctcacgcgcctgatgtgggacgccagctgccagtctcagaaagaggactcgcctgcggcatacgcatggaacctgtagaaatgtgaaattgcagagcagggtagttgtatagtatcaccaccagccatgatatcatcaggttcgcatcaagtcgttttaaccgtgctaaaagcgccataaaaattacaaatgaaacaaaaatagggctcagcgcaaaaggaagcatcgtccatgatgccaggatccatctatgtttgtcgta

SEQ ID NO: 23868 - DNA, 674 bp, Zea mays
gctgtgcgtccctcgaggcggccgggagcagtccaccactcgttcgttccaaacggagaagaggatcaggttcgttccaagggaaaggagaagagggtcaggagagagagagagagagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcactgcgctgtgctgcttctgctgctacgagacctgcgagtgctgcctcgactgcctctgctgctgctgcaactagccggggctagctccggaggacggtcgagacgcagcagatggaggtcgcctccgtctcttctacctacctaccaatctacctagtgatgatgattcagttcccgtttagtctggtggtgtgcaagtgcaaacataataacgcacgcatgtcgtagcgtagtacaggagagatgttttactctgtcagttccagtttgagcattcgtaaaccaaccaaccatggtctgaactctgaacaaaagcatcaaaaaactgttatttgctcgcccccccccgactccggcgactctgaacacaacgacgacacatccgtcc

SEQ ID NO: 23869 - DNA, 974 bp, Zea mays
ggggtaccctccgggtccggccgggattgccgtgcacaacaaggcaggaagagagctgcctgaagcggcggtgcctgaaggaggagaagcaacgaaccagcgacagcgaggatgtacaacgcgccgccgccgccgccgcaggacatgtcctactacgagcactgccagaggcggcacgaggagaagggctgcctctacggatggcttgggggtaaggtggacaaccacgccaataatcgcaccagacagtcgctgccagatgaggtccatgcctattgtcagccgaagacgaagccggtacacgatacacgtacacgggtgtccccttctttctgttccccgtctataaattcggctccctcgagcccgccggccggcaggccccactcgttcgttccaaacggagaagaggatcaggttcgttccaagggaagggagaagagggtcaggagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcacggcgctgtgctgcttctgctgctacgagacctgcgagtgctgcctcgactgcctctgctgctgctgcaactagccgggctagctccggaggacggtcgagacgcagcagatggaggtcgcctgatccgtctcttctacctacctatctacgatgattcagttcccgtttagtctggtggtgtgcaagtgcaaacataataacgcacgcatgtcgtagcgtatagtacaggagagagatgttttactctgtcagttgcagtttgagcattcgtaaaccaaacaaccaaccaaccatggtctgaactctgaaccaccgcatcgatcaagcaaccctagagagccacgctcgcgta

SEQ ID NO: 23870 - DNA, 817 bp, Zea mays
ttggggtccccggagccggccgcggacttacatcattcccagactactgcttccacctatgtccattatttccgccaagtcgagaacgacatgcagtcgtagtatcatggataaccaccttatgtcgtccttcaccatcctactgctttcttcttttgctgcaacggttgcatatcctgctcgcaatgaattacagcctaaccagatgaaaaaccaccattcttctgtatcatcatacaacccacaaccgaaggatttcccaactgaacaactctaccgcgcctaccttataatccagcgcttcaagaacaccatcattagcgaccccaagaacgtcactgccacctggattggtcatgatctctgcggagaaacgacctatgtggggttctactgcggatcgccggcaggaggagataagaagttgacagtcacaggtgtcattttgaatgggtataatctacatgcaccaacgttggaaggtttcgtcaatcagctccctgatctagctcttttccatgctgcttccaacaattttggtggcgatataccccaactaaccggcctagggtacatgtacgagctcagtgtcgccgttaaagatctgcaattacaggctcggccaaaaagggatatccctccggattctacagtgggtttgggcggcaacactcacggtcacgggcatcttggtaactgtataattgcagattttaacttctcatttaacgtcggaatcggtaagggtcacaaatttccaggttttacggatgccaaggctctccttctcaaccacacaatttgtccggtccacttc

SEQ ID NO: 23871 - DNA, 858 bp, Zea mays
  misc_feature (842)..(843): n is a, c, g, or t
cattgggtacctcgaggccggccgggacggacatcactcccagactgcttccacctacgttcattatttccgcaatgtacaaccgagtatgatatgcagtcgtagtatcatggataaccaccttatgtcgtccttcgccatcctactgctttcttcttttgctgcaatggttgcatatcctgctcgcagtgaattacagcctaaccagatgaaaaaccaccattctgtatcatcatacagcccacaaccgaaggattttccaactgagcaactctacagcgcctacctagtaatccagcgattcaagagcaccatcactagcgaccccaagaacgtcaccgccacctggattggtcatgatatctgcggagaaacgacctacgtggggttctactgcggatcgccggccggaggagataagaagttgacagtcacgggggttattttgaatggctatagtctacatgcaccaacgttggaaggtttcgtcaatcagctccctgatctagctcttttccatgctgcttccaacaattttggtggcgatataccccagctaaccgcccttgggtacatgtacgagctcagtgtcgccgctaaagatgtgccattacagactagggatgcggatgattttgtggggggggaggggcatcggtcgcgtgcaattaggtagatgcgtaactgctgattttgacttttcatttaatgtcggaattaataagggtcacaaaatttcctggttttacgcatgccaaggctctccttctcaaccgcaacaatttgtccggtccacttccgtcaaacctcggtttctcaaaactgagctaccttgccctcgnncacaacaaactcacc

SEQ ID NO: 23872 - DNA, 3452 bp, Zea mays
gattacctacactttttctgtagaatcgattttatagagtagctaaatcaataaatttgactagcctttttagctaatctcttggagttgttcttatgggttttcttatagagtgtttgatttgaggaattaaaccattcaaattgaggtggtgcatcatgagttcattcctcaaatttggtggaatgactctattcctcatattagtactaactaactataagaaatggggtggtgatggatcaactcattctattccacaaaccaaacaaaaatagtgagaagtgagaagatgatagactagctcatttctcaaaccaaacaccccattagagatgctctaatggctcaaattttcagcttcaacttacaacctataggagtcacgagagtttcggtttcctgctgtttctttaaatatagttttgttggtccggtcgtccggataaaatattacagaaaacatatataaacttctgtggtatggaaaaaaatgttcaaggtgaattagtgatactaattcaaggaagcaaatgatgtacatcaaagtttgactaaaactaaattcaaaggcggagtatatttttttagacattaacaaagtttgactttatttggataaaaccctaaacaaatacagtgtatgttctaaacttatgcggagatgtttagcgagtaaaacaatgggtagtttgttgaaaccgcgcttggctgcaactggcatctcacgagcaacaacagcctctgttaacctgttccttgctgctctgcagctagcaataggcgcaccaccttctgttgctcaacatctctgcccttccattgtcgacaaagcgtttcttagagaccgtttggcaggctctggtttttctatataaaaaagcagagctctctcaaacactattttttaaaacggctacgaaaagtacataaaagtcataactatttttgtactacacataaaaaccacaaatagtagctttaacaaatttagctctaactctatcaatttaatacaggaaaatgattctggctctaagataaaccgtttctgtcaaacggtttatgaaatggcttcggctctactaaaaatgctgtttttattttttagaaaaaaacccattatttttaggcaagccagagctctatcaaacaggcccgaggaaacagctctcggcgctcccaggaaccaccaatgacatagagccaaagaggtgaggtcaaattgcactggaactttttttagtacctataacccaagcccaaccatcccagtgatgtgacagtgatactctctcacaagcaaaatagtttcccgatcccgatgtggcgctccaacggctaatgcggcttggtcctatcttacgctttcgcttctgcaaatctacgtcttcacaacccatggaaatggtgccagtggtttagcttcgcctttgttgcttcagcagcctccccaattcaggcagacagcagaggcgggcaccgtctgaaccggtcgatgagaatttttgctccaagctactacgggcacacatgtgtcaggcacgagcgcgagacctctctgcacatccgaatcgtgagtgtttagtcggcatgattgatcgaatgctgaagggtttgacgccattcgccagtcacgctgacagtctgactgacacaaacaaattcacgattccgtatcggctgtgcaagcaaagctggtggcgcatgtgacatacacctccgataacttgctcgctttggctgtatcaaactgctatatagtcaacaatatgattggtctttacaaagttccacaatggcgttattacgtaacaaggatggtttatatatatcatcattttattcaatccaggtagctctctggagtacagaagcttctgcaagtggctctgcctctgcaggtgctttcaccgccaagaattcctcctgaaaccctccatgtgtgacacacgaaaacgatcggttactctggaaagaaggacgtgagtcacagaaaaccaggcgagttcagaataacgctgtgcacggcacacatatcagacagaccttgtctctgctcttaggttctgaacattccctgtcatcgagggctcacttgtagatcccgacgaggaaaaggtcatatagaagtgtggagtttccggggatgttgcagtctcctgtcaaaaaaagaaaaacaaaagaaaaaactagagaagcagtctccttgacaattctagagcgagagcagtttgcttatctatggtgtacgaagtcatttagcgcagttctgaaaatcgacctgagaagcagcctgccggttcaggcccgtacgccagtgacgcaggtatcatcagcttgcgctttccacctgaggcaggtttgcaacggagtcatcagtcatggaacagcaagccaaattagcaaagcctctatatttaatgcacagctaaaaactgctcaagttcctgtccgtaccaacaagcatgggcggcacaccgccgccgccactgatcccctgttcaagccctcggaggatctgcacgcggagaacgcgaaagaaacagacccatcattttttactggcatgaaaactgaacgtcgttttcagtgagcgacaatggatgcttatacatgcacaccttgcctgcgcctatgcgcatcgtcagtggcctcccgcgcttgtagctgctgtcgaacagcgtaccgtcgggaaatctcgcggtgtagtgcacctgatgaccatcgagaggacgaatataattaggatccgaagcaagcagcacacagaacgcagaacaggatggcggcatatgttgctgagttactcgtgcagaagggaaatggaccactgtactattacagagtaggttaagtcagaggaaggcgcaaggcatgcaggaaagaagagacggtggtctcggtactgacattgatgagctcgccgcgcgggggctggacgccggtgccgacctcgacgtcgcagtacgcgaggccggacttgacgaggctcaggtcgcacatcttgtccccgaccgtcgcgtagtactcgatgcgcgtggcgccggcgtcgcccgccggggacagcagcgcggccgaggccaggaacccggcgcccagcgccagcagccccctcctgcccgccgacgccgccaccggatgaggagtcgaggaagtggacggcgacgaggacgacgcggagccgcagggcgcgacggagagcgctctgccgctggtcttcgggagcggcggtggcggcgtcgggattgggctggacgccatcagagacgacagggacgtgatgggtggcgccatggctgcttgtggagtgtggattattatccccagactgtggctgcaaggcgcgcaggctcgggtctttataatgacgccccgaaattcgtcgcgcggaggcagcatgggctctggatgtttcagccggccactgcagcagcaggccacgtggtgac

SEQ ID NO: 23873 - DNA, 1018 bp, Zea mays
ttttttttttttttttccgataacttgctcgctttggctgtatcaaactgctatataagtcaacaatatgattggtctttacaaagttccacaatggcgttattatgtaacaaggatggtttatatatcatcattttattcaatccaggtagctctctggagtacagaagcttctgcaagtggctctgcctctgcaggtgctttcaccgccaagaattcctcctgaaaccctccatgtgtgacacacttaggttctgaacattccctgtcatcgagggctcacttgtagatcccgacgaggaaaaggtcatatagaagtgtggagtttccggggatgttgcagtctcctgagaagcagcctgccggttcaggcccgtacgccagtgacgcaggtatcatcagcttgcgctttccaccaacaagcatgggcggcacaccgccgccgccactgatcccctgttcaagccctcggaggatcttgcctgcgcctatgcgcatcgtcagtggcctcccgcgcttgtagctgctgtcgaacagcgtaccgtcgggaaatctcgcggtgtagtgcacattgatgagctcgccgcgcgggggctggacgccggtgccgacctcgacgtcgcagtacgcgaggccggacttgacgaggctcaggtcgcacatcttgtccccgaccgtcgcgtagtactcgatgcgcgtggcgccggcgtcgcccgccggggacagcagcgcggccgaggccaggaacccggcgcccagcgccagcagccccctcctgcccgccgacgccgccaccggatgaggagtcgaggaagtggacggcgacgaggacgacgcggagccgcagggcgcgacggagagcgctctgccgctggtcttcgggagcggcggtggcggcgtcgggattgggctggacgccatgagagacgacagggacgtgatgggtggcgccatggctgcttgtggagtgtggattattatccccagactgtccccgccccccccggggtacccaatg

SEQ ID NO: 23874 - DNA, 2084 bp, Zea mays
gaaaaaacgcaggctaccattagagttgaggaaaccttggaatcaaaatacatacatttcagatacccgtaggacgcagcttccttaaatgttgtttccagcataaacctgtggaatactcaaggcacagcgccatctcaattgccaacatggctaaacacatacatgaccgtggggaaaccatcttataaacttatatatgtaacagttcaaatcccccagcataccaaataagcatcaagtacacctgtgacagaaagatagaggttccacatcatgttatggcacgaacaacatgagactccgacaaaagtgcaactctcatgatcttagccttttaaggtccctttcgtcacgatcgtagttccggtactcacgcacatcctttctcttccgattgtcatgctccggagaacggtattcttgactgtccatggacagctcaccctcttcggtattctcacggttggtgctctggtggtgtgcaagatgaggccagctctgctttctctcctgcttgaccttctcatcctcggcagccaactccacgccatgttccagctccctctcaatgaggtcatcgtcatccatcacatcgacctttcttgaaaaatcacctttcgatttcctacgcttctccagtgccgctttcaccttatccttgtttaccttcttcatcgcatccatcattgaagacgacacattgggaccttcgttgctattagcagtgccatcccttgcatcatttggaggtatcctatagttttgcttatctgggtgagggtggtcatagccacggtggtctagcatgttctgctggctcgatggtctgggtgcttggttatggtcatgggcaggaggttcatcagctactcctggaactttaccaggaacacgttgattcgcaacacttgcagaactgccttcagtatcattgccttgtgatggtggtggttgaacacggttttgctcatacagttccaacatctggttgctaacctcttccagctgccacggagttacatcaaactcttgccaccagaccttctcgccatctgatggaagcttgactttgagaaacttcgcagcgaggaagattgcaccagccgcaatatggtgcggtttaaattgcaggcaaagtgaagtgcggagcccatcattgacaaaattccaggcaacttgagcaagtgcattttgagcaaccttgaatatttttattgcttcaaccaagggcttgtaaggatggttcacattcaaatcaaaaccaagtgtcacaagcacaacacgttccccgagtaaaataagttccttttgttgttcatatacttccttctgttttattcgttgaactgcagcaggatcctttttgtggatgatctcatatgaaagaagtatgacatccttcagaggtctgggtgtttcttcaacttttcccgccaagaacatgcatactgttgcaattgtccgtctgtcatttttggcatgcgattgacgaagaaagaaccgatgacagaacactatagcagtagcaattgtcacttgaggtactttaagtctcatccccaaatcctgcagaaatgtgcaatatgacttgcgaagataagactctttcttcagatcaatgccgtctctcctcgaaagggaattctcctctatttcttttctactaaaataccatgaagcaccaagttgaccaccttctgcatgtctgtcatatggaattctgtacgggctattttctacaattccatgatgtgaagagtcactagtctgcatgatatccatgattatattccccttctcaacaacctgctcttgcgctcgtgcagcgtcccttggatctgaggggcgctccgctgtgacggaagacggctgtcgctgtaggcgatgggtggcgacggctaggtgatgaagcagcggtgaggaggagacggctgtcgggagaggggcgctcggaagtgaagctgaccacctggagcgttggggctcacggtatgctcgtccggagatgaacttggcctcgagtccgaaaccctaactgagaggtgcgtggacgcggaatcgccaggcacggtactgtttac

SEQ ID NO: 23875 - DNA, 2831 bp, Zea mays
  misc_feature (1845)..(1845): n is a, c, g, or t
  misc_feature (2495)..(2495): n is a, c, g, or t
ggaagtgctgtaataaaactatatatctaaaacccaaaaacaaaaaccataacttaggaaggagagaacatgcacattacatggtatcaaaatcaacaacattatgtgcacgacctcatccccagtacccgtgtttttttttttttttttgaaaaaacgcaggctaccattagagttgaggaaaccttggaatcaaaatacatacatttcagatacccgtaggacgcagcttccttaaatgttgtttccagcataaacctgtggaatactcaaggcacagcgccatctcaattgccaacatggctaaacacatacatgaccgtggggaaaccatcttataaacttatatatgtaacagttcaaatcccccagcataccaaataagcatcaagtacacctgtgacagaaagatagaggttccacatcatgttatggcacgaacaacatgagactccgacaaaagtgcaactctcatgatcttagccttttaaggtccctttcgtcacgatcgtagttccggtactcacgcacatcctttctcttccgattgtcatgctccggagaacggtattcttgactgtccatggacagctcaccctcttcggtattctcacggttggtgctctggtggtgtgcaagatgaggccagctctgctttctctcctgcttgaccttctcatcctcggcagccaactccacgccatgttccagctccctctcaatgaggtcatcgtcatccatcacatcgacctttcttgaaaaatcacctttcgatttcctacgcttctccagtgccgctttcaccttatccttgtttaccttcttcatcgcatccatcattgaagacgacacattgggaccttcgttgctattagcagtgccatcccttgcatcatttggaggtatcctatagttttgcttatctgggtgagggtggtcatagccacggtggtctagcatgttctgctggctcgatggtctgggtgcttggttatggtcatgggcaggaggttcatcagctactcctggaactttaccaggaacacgttgattcgcaacacttgcagaactgccttcagtatcattgccttgtgatggtggtggttgaacacggttttgctcatacagttccaacatctggttgctaacctctgaaaggagtaaccacaaacataaggcataagcatgtagctttgatggtataattcataaaaatgatctttcaaagcagaaatatgtcaaaagtgaagaaaaggaccaaaaaaacatcatgacggcaaaaagatatataacaaattgcaagactggcaagacctaactaaacagatgcgctaaaatgacatcaccaaacaactattcctgactacatttggcatgtccccagaatgcattaaagtcaaataggattgccttgagtatagagccatagatcgtggaattatatgtgcattcaacctatcttagttccacgatcagttttggacatgccagttatctttggctatccaatttccatggggttactagatagctaattagtaggaaactagcacttacaaaaatgaattttacagtagtgcagttaaggtgcacactagtgactttgcatctagagaccaaccttccagctgccacggagttacatcaaactcttgccaccagaccttctcgccatctgatggaagcttgactttgagaaacttcgcagcgaggaagattgcaccagccgcaatatggtgcggtttaaattgcaggcaaagtgaagtgcggagcctgtacaccccttttaaggcgtagtaaatagggatgtttgtggattactatttgtaatgaggaagagtaatnttagcatacccatcattgacaaaattccaggcaacttgagcaagtgcattttgagcaaccttgaatatttttattgcttcaaccaagggcttgtaaggatggttcacattcaaatcaaaaccaagtgtcacaagcacaacacgttctccgagtaaaataagttccttttgctgttcatatacttcttgaagaaacaaaacaaacaacctcagtttttttgcgtgccacagtaaacaggacgtaaaattgcataaaaagagtcatcctagccttgccttttaaaaaggtactattatatgataaatgaaaaggaagagccatcaatagaataataataggagaaaaggataataacatcataggtcatgaagttcggaacttcggattacctagaacagcaatatcaagatattaaatgctctaaatcaaatcaccttcagttttattcgttgaactgcagcaggatcctttttgtggatgatctcatatgaaagaagtatgacatccttcagaggtctgggtgtttcttcaacttttcccgccaagaacatgcatactgttgcaattgtctgcatgttgtaatgaacttatatattaaaacttccattagcagataatgaataactatcaagtagaaataagaaagcagngccagtatgctaaaaagaaatgcatgtattgagaacaaacttaaatttttatgatgatttcatgaggattttattttttgtcttccacgtgtaggtggtaccagaactgtgactgtgagcaccagaggtttaccagttactaccaactgagattgcgctgactatagaagagggtttctctggaagagcaggaatgatgtcaaaggaggacattgcatgatagcttagcccaatgtgactcggccactacaattgggaggacttggttcatctcatttgcaaaaaatggggtgggccttgagaatgtgctgattatggttacagaaacagtaccaa

SEQ ID NO: 23876 - DNA, 1532 bp, Zea mays
cggagcagaacatcctatttgagagcatatcgaaaggtcaccttttgatctccgcttctccagggccgctttcaccttatccttgtttatctttttcattgcatccatcatcgaggctgacacgttgggaccctcgctgctgttagcactgtcatcccttgcttcatttgggggtaccctatagtttcgcttctccggatgagggtgatcatagccatggtggcctgacatgttctgctggctcgattgcctggttgcttggttatgttcatgggcaggaggttcatcaactactcctggaactttacccagagcacgttgattcacagcagttacagaactgccttcagtatcattaccttgtgatggtggtggttgaacacggttctgctcatagagttccaacatctggttgctaacctcttccaactgccgcggagttacatcaaactcttgccaccagaccttctcgccatctgatggaagcttgactttaagaaacttcgcagccaggaagattgcgccagccgcaatatggtgcggtttaaattgcaggcaaagtgaagtgcggagcccatcattgacaaaattccaggcaacttgcgcaagtgcattttgagcaacctcaaatttttttattgcttcaaccaagggcttgtaaggatggttcacattaaaatcaaaaccaagtgttacaagaacaacacgttccccaagtaaaataagttccttctgttgttcatatacttccttatgttttattcgttgaactgcagcaggatcctttttgtggatgatctcgtatgaaagaagtatgacatccttcagaggtctgggtgtttcttcaacttttcccgccaagaacatacatactgttgcaattgtccgtctgtcatttttcgcatgagattgacgaagaaaaaaccgatgacagaacactatagcagtagcaattgtcacttgaggcactttaagcctcatccccaaatcctgcagaaatgtgcaatatgacttgcgaagataagactctttcttcagatcaatgccgtccctcctcgatacggaattctcctctatttcttttctactaaaataccatgaagcaccaagttgatcaccttctgcatgtctgtcatatggaattctgtacggactattttctacaattccattatgtgaaccattatgtgaagagtcactgctctgcatgataaccatgattatattcctcttctcaaaaacctgtcagctccaccgaacagctctgactgcgtcccagcagtgaactgcctcggatctggagtgacggaagacggaggggcacgccgctggacgtggagcttccgccgtctcacactcactcggtaccggcaggagcacccgccgctgcagctgtatactctgcatacggagctagcgactgcggcgctctcgccggcggcggacctggcgacggagtcggaagtggtgtcgaagttgtgagcagtgcggtgtcggagacgggaaccatcggacccgagcatacgcgtggg

SEQ ID NO: 23877 - DNA, 2600 bp, Zea mays
  misc_feature (1)..(238): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccccggccccccctcgtgtttttttttttttggcaaaaagaaaatgacgatactcagcgctattgttttgactcctaccattaaattcactcaaggatccaaataagcctgacacatgtatgcttaatcgtcctgttagaagttcgaaccaaaacgacggtacaatgaaggttttgctctattcccaacttcccgtgctttatcctaaactaccacataaacctttgtgttccaggctcatgttcccaacggaatggtcggaacagaaacatcaccagggtagacaagtcaacggctgcataaagcgatcccatggcaagcaatttgccattgccaattgatggagagtgaagaaccagtatcacgaatggaattgtgtagtatctgaattcaaccagcggggcaggtacaaggaccagtgcaactgacagcacaaatgataacacccaaatccttgtctgtgatttccctaagatgttgatgattgagagccatgagtacacataaagtggaatcaacatgtacttcatcatccagtttacttggataaccttcctccaaatatagaaggtatagtgtctattgtcagcaagaagatacggatgggcaatgctgaaaaaatgtacagcgacaaagcttaaaccaagacccattaatactgccagagaaccacaggttttgttctttccagacaagtggaatagatccaatactcggttgggagtgaaatgccatggaaggagggcagcagctgacacaaggccaaagtacagaaactgtgcaaagtgtggcgaaacaacatgagcttccttagcacctagtactataccaccattccagattatgaatgctacgaatgccgccatgacaactacaaatggtgcaaatgcaatcaaaatttcacactttgagttccataacttcaagctgatgtcacacacttcctctgtaagactgttgtaagggttagcagattcacaaacaatgaccttatttatgggactattgattcgccgtcttctcaagctttgaacactagttttgttatccctggcagaagctttttttgactgatgtattggttcactgttctcatgagaagcattatccttgggatacaagtcttttacgtatgtgatagctccattggcagcaaaaaatataatccatattacatttgtctgacgaaaaagtattgaaaaaacaccaaacattgtgctgatccagaactgtttcttcaagcagaataggtacactgcaagaactgcggctaatgatgcaacatcagtgtaataaagaaaagtgaagaaccagtgaacaggatacaatgctacaagaatagcgtaggcagttgccttcctttctcccattcctggtcggatgcacaaaagcaggtcatgaataagaacagcgcagaccattgccaagataacattagttgatctgagagctgctgtggagcaaagaacatcaaatgtttttgctacccgaaacatccaggcaacaggaaagaaagaagcaatatatgctagtgaaacataatacctgcaaaattgcaacaacgatccatgatgggataaattggagcttgaagcaatgaggaattgtcaaaaactcacaggccaggaggggtggtgatcatgggatcccatgtccagaaatctccacggcaatactgctgtgcttgtgaaatatggaagatctcatccatgtagggctctggcactacggagttcaccaaagccgcaatcgggaacgcccacacggccaccgccgccgcgacgaccagccttcccatccccaggcttgcgcggccctccaattcgtcagcgcctcttcagatccagtcttgcgtccgtaaatgcgttccctcgattctcaagagtcaaggactcacgagactgtcggaggcagcggcttagaggcccgcggcgtcgggaactactcggaagcaatttcccgagcaacacgatccggaggggcggggcgacttctacgtcccggactcgccgtggtccggccgccggagtgcacaggagacaggatccttggtctcggctctggtcagtctctgatggctctgtgcttcagactcgattccgagtttccgactatcagctcgggctcggacaagactgatttggggccgcaagtacgcaaggcccagtccattatggcgtgtttggtaggctgcatatgggccgactaggctggtgagacagcgtacgcttgtttggttgcttgtctctgtatccggtggactgaggggcggtatttggttgcctgtatgcatgtgctcacctgcattgcgggatgcagcatctcgctgcgagctaggctgtgaagaaacgggttttat

SEQ ID NO: 23878 - DNA, 1951 bp, Zea mays
  misc_feature (1748)..(1748): n is a, c, g, or t
tttttcctgttcaatatcaatccatataattgctgttgcccttaaaagccgtgtgatcaaacaatgtatccactgcctatttttgacttgtgcaatcgttgattagaatgcctagaatacataaaggctggcaaaaagaaaatgacgatactcagcgctattgttttgactcctaccattaaattcactcaaggatccaaataagcctgacacatgtatgcttaatcgtcctgttagaagttcgaaccaaaacgacggtacaatgaaggttttgctctattcccaacttcccgtgctttatcctaaactaccacataaacctttgtgttccaggctcatgttcccaacggaatggtcggaacagaaacatcaccagggtagacaagtcaacggctgcataaagcgatcccatggcaagcaatttgccattgccaattgatggagagtgaagaaccagtatcacgaatggaattgtgtagtatctgaattcaaccagcggggcaggtacaaggaccagtgcaactgacagcacaaatgataacacccaaatccttgtctgtgatttccctaagatgttgatgattgagagccatgagtacacataaagtggaatcaacatgtacttcatcatccagtttacttggatacccttcctccaaatatagaaggtatagtgtctattgtcagcaagaagatacggatgggcaatgctgaaaaaatgtacagcgacaaagcttaaaccaagacccattaatactgccagagaaccacaggttttgttctttccagacaagtggaatagatccaatactcggttgggagtgaaatgccatggaaggagggcagcagctgacacaaggccaaagtacagaaactgtgcaaagtgtggcgaaacaacatgagcttccttagcacctagtactataccaccattccagattatgaatgctacgaatgccgccatgacaactacaaatggtgcaaatgcaatcaaaatttcacactttgagttccataacttcaagctgatgtcacacacttcctctgtaagactgttgtaagggttagcagattcacaaacaatgaccttatttatgggactattgattcgccgtcttctcaagctttgaacactagttttgttatccctggcagaagctttttttgactgatgtattggttcactgttctcatgagaagcattatccttgggatacaagtcttttacgtatgtgatagctccattggcagcaaaaaatataatccatattacatttgtctgacgaaaaagtattgaaaaaacaccaaacattgtgctgatccagaactgtttcttcaagcagaataggtacactgcaagaactgcagctaatgatgcaacatcagtgtaataaagaaaagtgaagaaccagtgaacaggatacaatgctacaagaatagcgtaggcagttgccttcctttctccaattcctgcaaaattgcaacaacgatccatgatgggataaattggagcttgaagcaatgaggaattgtcaaaaactcacaggccaggaggggtggtgatcatgggatcccatgtccagaaatctccacggcaatactgctgtgcttgtgaaatatggaagatctcatccatgtagggctctggcactacggagttcaccaaagccgcaatcgggaacgcccacacggccaccgccgccgcgacgaaccggggggggggggggggggggaacctaggaattttnttctttctctttctctccctggagcccgggggatcccttagttcctaaagcggccccccccccgggggagcctccgctttttgttcccctttaggggagggttaaatttcgagcctgggggaaatcatgggccaaagctggttccctgggggaaaatgggtaatcccttcaccatttcccaacaaacattcgaagcccgaaag

SEQ ID NO: 23879 - DNA, 1902 bp, Zea mays
aaagggaaggttcgcttgtcgtacttttgaaaaaatcaagcaggttaatgttgtgctattagccattacttatcaaggagggtttcctttgcaatatgtcgatatgcattcttctttgttaaaaaacagaacttataggtatcttgcatcacttgtttttttgcagagtatcgaggatgctgctgagttagaagaactgctacccccaaaagctgggcctaatttcaaattccatagcgatgaaagcaacgaaagcactgatggcctgaagttatccaaggaacttattggcttgattagagggaagaagtctacatatgatattattttatgggttgaggaacaaataattccaaaaaatggtactgaatttgcacttgatgttgttagccagacgcttcttgacatgggttcaaaaagtttcacccatcttgtcactattttggagagatataataagataatctctaagctatgtccaaatgaggaaatgcagctactgttaatgaatggagtcagtgcttattggatggacaagtacccagatgactgctatagctattgacagaatgatgggttatcgcctgatatccaatttggctatagtcaaatgggttttttctcctgccaatgttgagcaatttcatgtttctgatcgaccatgggaggtgcatcctttgtccttaattttaccttcatttgtggtaaaaaagtagtacatatatcaaccaaataaaactaatatttaatgagttcaacaatttcattataattataattgtgatagtttttttttttttataaactgggagttctgttttgtttggatgcatatttatggtgatttgtgtcttctcgatgcttcttttccaatagcccagttataactcaatttctcatcttcagtttaaatatatctgattgaaagtttttccatcagattcttagaaatgctgttagtaaaacatacaatcggatcagtgacctccgcaaagaaattcaatcactcaagaagggtcttcaagttgctaaagaggctagtgcaaaaaacagaaaggagctggaggaggccaaatcagtgcttgagattgtagtggggcaacctgcaccagctgaaagaacaggtaggataaggcgactagaatcacatgtcaaaaatgcagaggatgaggaaagaactcttgaagaatctttagaagcgaagggagttctccttgctcgggctcatgaggaaagcaaggacttgcttaagctactctttaagagctttgttgacgtgctcactgaacgtttgccgcctgtctctgttgatggggaaattcctaatctgcgcagtggagatcaaaatgtaaattttgcagctcaaaattctgaagcagcaacaatggagattgacaatgaaaatggagcagataataatagtgaaccgaatgagcgaaacacaaaaaatgcatataatgttggagagcttgagcagtggtgtctctgtacactgggttatctcaagtcattttcccgccaatatgcaagtgagatttggtcaaacatagcaatgttggatgaggtcttcgttggggatgttcacccacttatccgaaaagctgctttctctggtttgcgcagatttaccaatgaagggtctcatccttgaatttgacaccatacccatattctttatagaactgagtgtattgtacctgtatgatagaggacaacttttctccttgtttaactaatcaaataggcataaacatttttccttggtttcgtatgccttttttttctgttcccttgcttctcggccactaaatgaaaatttttaccaggtaactaagttaatgttcttttctgaagtaacatcagaatatgcatggttcagtgttaatttaacatattggctgg

SEQ ID NO: 23880 - DNA, 891 bp, Zea mays
ttttttttttttttttagttgaaaaactttgcttcacaatcaatgtgatagatcaattctatctcttcaatgtacatataccatatcaacatggtatctatgatgtttcacgttacaaaactgtgtgcatcatctcagctccataattacttgttggagatatttgaatgacttctcatagctgacaaagcccatgaaccaaaaatcaaagccatcaacagtgactacatcaatatacttctcatctggattgtataaattttcccgcactgaagcacttttcatcctctctgtggggattaacaccttgtaaggcacccttgtactgcctcctttaggagacgtgaaactcaaaggcctatcactatggaaagcaatcttcttagttgagatgaaaagcattccagctattggaccagctgtggttgaaagatagcactggaaagccttccgtagtttctcatctttctcaactgcaaagtattctctgaagactttatcaataccgccagcttggagaacctttgcaccgaagcttagtttcccttttatagtttctgaaatttttggtcccatggttaagtgttctttgaatccttgcatgtagctatctgttttatggctcagtttgttcatccgatgaatgaaggaactcttcttattttttttatgaaccatggcagaacaggaagattttccttgtctttcctcatcggcatatgcaaacgaagtcaatggaattccaatgacatgctcctgggtgaaagtctccatggcttggagaaggtctatctgcaaatctgctttgatgctaggagacttctctttgcctgtgagaagtggatgcctgctagtttttggattaggatgttctaggtaatggtctcgtgc

SEQ ID NO: 23881 - DNA, 1500 bp, Zea mays
taccgggccccccctcgagttttttttttttttttttgttcctgtcagaaaaaaaaccggacaaatctggtattggcaaacatagatccaatacaacagccccaccaggcaccaagaattccaactgatgctacagcagttaatcgacaaggtcaaagcctgacgcacgccacgatgccacccacaagaaagaacacagcactcttcgtcccgatttaaacaatgctaaactgctaaccagtaaaaaaaaaaccctctcaccctgtcacggggggagacaacgcattgatccgccacgtaccaccagcctcgccatggccagactcccgatccctcagcatcctcacgtaacgctcgagggtgtgcgctctctcctctacgcggtcgctggacaccgtgtcctcggccagcttcactgcggccctctgggacacttcgaagctgtctgcagcctcctgcacccgacgggccgtctccgctttccccagctgtattagagccacgagcaggctcttcagctcgttttgggcaccgcctgtcaacgccatccccctgagatgctccacgagggccatttcctccccggggcttccagctcgtattttgccgcccttcttttgccgcctcgccgcccgcgatttgctggcgttgctggacatgaccgaagcgctcgactcccttgtggtatatgcgctcatttcactgaagctagtgctcgtttctgaaacgctgtcatcttcaacatccataaaccgatcttccgaccggagtttggcagcgagcgacaatctcctctgccgtacggccaaatagcgtgctgcatatttaccgatcttcaacagtccttcctggtactcggctatcagtgatgcggcgcattctgaagctgcgtctctgacagcttcaaccagatcatgcgtgctaagcatgtaagcgactctaagagcctcttcccattcccttgccatgatatagtagcttacacctctttcagcatctgaacagtactccagtgctactctagcagcatctcctggcttgccaagcgcctggaactcatcacataactcgtgtgcgagttgaacggtttcttccctttttaactccagaagacctgcgacggtaaaaacacctctccagtctccacaggcacggtaagctctcagtgacttctgatatgatgaacagcactgataagtcaaagcggcgtcttcaaagcatttctctccagagagatggtcaccccatgcctcaagaatttgattccttttatctggttcattaaataactggaggcccagtgggaacagctgaggattatcattgaggagtttcatgcaatcctcatggtacgcgtcgccagcagaaacaatgtttctgagagcactctcgtatcttccaagtcttaaatcaatcgtatacctcatgatagcaggaggaaggcattcaagactcttaaggaaaggaaggaactcttttggatctttttgggaattcaac

SEQ ID NO: 23882 - DNA, 2766 bp, Zea mays
gccgaatatcaaatatggagccgagccaaagaggaaaaaaattagctagtcactaatgatttatgttacagtaataagtaaatgttaaggttataaatatacttttactcatgctgcgtcacgtgcctatcgtactgttcacgctggatgataatcgctctcgcgtcaacaccttcaaacaaccgaaggtcacgtgcctatcgtactgttcacgctggatgataatcgctctcgcgtcaacaccttcaaacaaccgaaggtatcaacgttatgtaaattttgttaatgttcaggtgtatattgtgaaaacatatgtaaatgaactgaagggatacattcattatctctatatactctcattattatgaataatgaaggtttatctttcatgacttttgtctgaaaatcattatatctaagaggatataaagcttcggaggaccaaggtctttgacttttgacaattgtattgtcttgtttttgattcacaacatttgagaacaagtgactaacatggtccgactctgccgattttttgtttgttcctgtcagaaaaaaaaccggacaaatctggtattggcaaacatagatccaatacaacagccccaccaggcaccaagaattccaactgatgctacagcggttaatcgacaaggtcaaagcctgacgcacgccacgacgccacccacaagaaagaacacggcactcttcgtcccgatttaaacaatgctaaactgctaaccagtaaaaaaacccctctcaccctgtcacggggggagacaacgcattgatccgccacgtaccaccagcctcgccatggccagactcccgatccctcagcatcctcacgtaacgctcgagggtgtgcgctctctcctctacgcggtcgctggacaccgtgtcctcggccagcttcactgcggccctctgagacacttcgaagctgtctgcagcctcctgcacccgacgggccgtctccgcttgccccagctgtattagagccacgagcaggctcttcagctcgctttgggcaccgcctgtcagcgccatccccctgagatgctccacgagggccatttcctccccggggctgcatgcataaagataaaggttagcccacacgacaaacaaacaaacaaacgcaaatcaacaccaagagcgcaggttgccgaccttccagctcgtatcttgccgcccttcttttgccgccttgccgcccgcgatttgctggcgttgctggacatgaccgaagcgctcgactccctgtccacacagaaaagccagagttccacactgataactaacttggcacggaaattcgatttttagagctctttctgagacaggacattatggaactatgcagcgaggaaggaaaccataaacagaggtggcacgagccgcgcaaacccaaaatggtgcagggcgcgaccttccttaccttggactcccttgtggtatatgcgctcatttcactgaagctagtgctcgtttctgaaacgctgtcatcttcaacatccataaaccgatcttccgaccggagtttggcagcgagcgacaatctcctctgccgtacggccaaatagcgtgctgcatatttaccgatcttcaacagtccttcctggtactcggctatcagtgatgcggcacattctgaagctgcgtctctgacagcttcaaccagatcatgcgtgctaagcatgtaagcgactctaagagcctcttcccattcccttgccatgatatagtagcttacacctctttcagcatctgaacagtactccagtgctactctagcagcatctcctggcttgccaagcgcctggaactcatcacataactcgtgtgcgagttgaacgatttcttccctttttaactccagaagacctgcgacggtaaaaacacctctccagtctccacaggcacggtaagctctcagtgacttctgatatgatgaacagcactgataagtcaaagcggcgtcttcaaagcatttctctccagagagatggtcaccccatgcctcaagaatttgattccttttatctggttcattaaataactggaggcccagtgggaacagctgaggattatcattgaggagtttcatgcaatcctcatggtacgcgtcgccagcagaaacaatgtttctgagagcactctcgtatcttccaagtcttaaatcaatcgtatacctcatgatagcaggaggaaggcattcaagactcttaaggaaaggaaggaactcttttggatctttttgggaattcaaagcaacaatagcagcaagattcagatcatacaatcccaaggcagcactaaaaacagcttcagtgtccgttaaccaaagcaaatgcttcagtgactcttcagcagaagggtagagctttcgcttggcatcgtcaagcccaagaagttctgattctcgaaggagctttattctattcagtgcctgctccaacaatggaggttcactacgggccaaagtggtcaatatacaaagttctcttgatgagctctcttctatttgttcctcaagggcttttcgaatggccataagtacagaagtgactttgttacccaaaaataaaccaggtgaactttcattatccgccattgggattgcacactgatcaggaaatgatatataggcttcatacaatttgctgctgacattgctattcttcattgagcaaacaaattcagtgacatgggtaaggttattaacttgtttaacgaagtctgcagggggatcctatagagtcg

SEQ ID NO: 23883 - DNA, 5213 bp, Zea mays
  misc_feature (519)..(519): n is a, c, g, or t
  misc_feature (1081)..(1081): n is a, c, g, or t
  misc_feature (1355)..(1355): n is a, c, g, or t
  misc_feature (4208)..(4208): n is a, c, g, or t
agactgaagaagagacttcgatggaatcacgatctacatcatgttcatgtggaacatttggaaagagcgtaattaaaaggattttcgagaatagctcactgtcggcgttgcagccttgcaggtgggtgcagggaaaataaaagagtctttcgctttatatgagtgctgatgttcactagcagcctcgcctattgtgtttgatattctcttagtttcacctgcgggtctttttatgcaggaggaggtgtgctcctggtgtgtgtgagatctgtgatcatgtttctataactcttttccctcttcaatgaaggcatagctcctaccatttgctttcaaaaaaaaatatccgcaggagaagttccagggcaaggtatctcgagccaaagttgacacgactgtcatatgaaaactgacttgattcttcactaatctcgcagcccatcacccaagttttcagaacttaaataaaaccaagtgctgcacacacacatttcatcgaacacatgaacctcacacaantccgaatccgcatccatctgaaggccgaagttatacgaagaggataatactacgaggagagcgcggtataaacaaacagcagtagccgcacctgtcgttggtgtgcatgagtgcgagcttgagcggccccgactgcagctcggcccagcggagcgtgcagacgtttacactgaagtcgagaccctccgagtagaaccgtgctgcccgcggtacgtcccggtgcagctgcagcacccaccggagcgtcgccgccgccattccccaccacccccctccctcctctagtcctccggatcaggccgtcaacgaacgaggacagcagtcagcagcactctcacatccaacggcccagacggcgagcaacacaaacccaacgaatcaaattcgactacttgggccgtgttgggcaataaaagcccaacttatcaaaccagagcgagcccaccaagcagccgccttcttcctttgcggaggcgaaaacccgaaaacccttcctcttccgccgacctctcgacagcattagacgcaggcgccgccgactgccgtggagagcgcgaggtanctgcgggtgctagggtttggctcgagatggggaaggcaaagagcaagggccctaaattcgcggcggtgaagaagattatcaccaagaaaaccatcaataagtaaggcaaccatctccagctgccagtccgctcccctatggttaggttcatgctactggaaattcgaatttttgtgtatgataggtacaaggaggatgtgctgaaccacaagaagaaggacgtggacaaggagaaactcggccggaatgtgtgagtgtttgtttgcgctcggantggtttcctgtgcttgtttggattgttgatgttgttttcttctgtgatttacaggccgcaggtttcgtcggcgttgttcttcagctacaacacagcattggggccgccgtatcgggtgattgtggataccaacttcatcaatttctcgatacagaataaggttagtcgtttaattatctgctgctctcctatttcactgatatattttttatgcaacagaggttcaatacttgcatgcccactgcttcactcagttaataattgaagatactgagttaatgtggtggatttaattgattgttgacccgttccagcttatctgtactctgtatgctgtattgtcacaagaaatgtcgtgcacaatttcacgttgttcgctggagctactgactcttaccagatactgaaaccttagggaaattaaaaacaaatagttaggatgactgttaagtaagttaggatataagcattgtgatccgttttactgttttagcaaatagcaaaacaaacagcagccaacccctctgggactgggaatcatgttataactgtctcgatttcccatccgatatggttgctgtgctaagaatgttcccttcaactcaggatttgattcattaactgtagtgttcccttcaactctggattctgattcattaacacataataatgggggccactcatatttgtgactaaatcctcttttccccccatgcagctggatttggagaagggaatgatggattgcctttatgcaaaatgtaagcatttaactctgttatcttgcattcccattatctttttggtgaactgagatacccctttaatatcttttcaactctgatgccttgttatgaaggtaccccatgtatcacggactgtgttatggctgagcttgaaaagctggggcagaagtatcgtgtggccttgaggtgtgctcctatccaatgctgttcccacattgtgttatttaatgtcttcttttggctttatctgcttcattgtctcaaatagaggttagattagttttttttatctatgcctcttgttgttatcttccactataaagatgtcgattgcatgtacttgctgttatactcaattcttcagcataactttcatctatctgcacaatctaatttacctccctcacagaattgccaaggaccctaggttccaaagattagcatgcacacacaagggaacctatgctgatgactgcattgtggagagggtcactcaggtaaaagctctctcttcttgaacactctttgtttgtttggagcatgagtactgggagtattctattaagtgctaactctatagcgagttcgtaagatagctcctgctagggaacttgtgacttacacttatcactagtaaactgcgacattgggcacaaaagtgaattaattgtgtatataatgtatattcctagtttcttttcaaatgttaatttagagatatatgcaagttcttgaagcattggctgttcaaatttcaaactttatgcttagccaacatttgagaggtgtctgattgctttagaatttacttttgcccaatctttgagaggtagaagggcagccaggtgcagtggtgagagctgtctcactgagtcaccatgatgtgggttctaagggttcgaagcagacttgcatttgcgtggtaaggcttgcctcggtttatccctctctcagaccccactcatgtgggaatctacggcactgggtctgatctgcccaatatttgataggtgtggctgaatgctatgttttccgagattagagattttactatatctgttcccaaggtgaaccaaaaatagcacttgtgttttctccgctgaaatccttttcccatgcttgtctaaaggattgtgtctgtatgtagtatccaaatttgttcctagttaatcaactggaacttgcatgtgagtgatatcaaatacccgtgtgcacctatagatgatatgtcctattctttttatcttaatgtatagatctatttgttatgcttttgctttgattaatgtgcatttcgttgcgttagattgtattcttcaccttcacaatacctagtcaaatgattattttggtttatttaccttgtatgctacgcatcttgttttatttgttctaaaccatatattttacgtggcagcacaaatgctacatagttgctacttgtgatagagatttgaaaaggaggataagaaaggtatgtttggtgtttagtgctcatagctcaggacatgcttctaatatcgcaaaagctttttcatgcatgcttgtaccatgggcatttccccaatcttgcaggttcctggtgttccaatcatgtacatcacaagacataggtattcgatagaacggctccctgaggccacaattggtggaggtatgtgatatcttcatctgacaaactttgttactgtgttctctctgtccctagcttatatcctacaatcacataagattgcagtactctgatgcttttttggcattcttgcagcaccaagaatctgatcggtgcagacatgagatgttctgggatgtaatactatggcggtacttgtccatctgaccaagtcactatttcatgtttgagtccacgacaaggactaggataagaacgctgctttctaggttgagcttactgtaactactaagaaatttttattatgtaccaaccttatcatttctacaatgttgcgggatgtctgaagtaattctttgttaaaagatcgggtatcctgctcccttttgcttctcaatcttgtgcgctacaagccataatcccaatagagtggctcttcctgaatctctcatagaggatgaacataggagtccntcataatgtgaaacggaggcgacaacaatctgcaacagtcgttggatatttaggccttgtatttctacagtgctacaacactttactaaagtttagcacatgaaatcaaacaagcatattgaaagagcagtgctaaagtttagcacctattaacactggctcttgttttgatactaaattatgttaaaagtgtgtcccctgacacattaatggtccatgtctatccttagcatctccttcagcactactgaagcttataccgagtacaacaatggcactaaattacccaccaaaaggcaagcaaaagtacaatcgaggcactaggaatgaccaaacccattgcataggcctgttttgttcaactcttttgaacagcttttctgagaatctgacagttttaatggtccatgtttgctgactttatttcatttctttcacgttgattgcagaaagattcattgatggatttaagttttcatgttccgacttcgaatactcaattcattggagatgagcatcgtacttcagcacaggtgagattagtagattactgataagaacagtatgaaaataaaaaaaaaacgcatttatgcgtggaggaaatgataaaatttctcctttttagatgttatggcaggctatctcggttgaaattgatggtggtggctcctcagagatggcagttgtcacatttgacggaattgcaattcttacaccgaaatgggaacatccaacaactctgtagaatatcattcataaaaaatatgacatgttgagtgtagttttgttttgctaaattctccttttttttattcaggggtcggtacagtgtggagcttcatcagtcattcttgcgactccaaggacaagctaatgatttcaaaatccagtatagtagtattctccgcctatttgttttaccaaaggttgtatttattttgcatgcatgctgagatcttttattgcacctactaacatatgattccatccttgcttttcacatat

SEQ ID NO: 23884 - DNA, 2856 bp, Zea mays
  misc_feature (13)..(13): n is a, c, g, or t
tgacgaggtaaanttagttttaagctgcttccattcgcattggttgtccactacatgacgtgtgatgattttacagttacattgattttatagttaccattcttgaactaagtttagatgctccatgtcttataggtactgtttaattttgctctttgatctaagcacgtggagtgatacctctgcacctcagttgctttatcgacgaggcatcattgatgaggtaattgacattagttttaatttactttcattcgtgctgcttgttcactccatgatgcatggtgccttacagttacatattcttctcatgtattcgcaggtattatattttgcaagtattagaagagctccatcacttttgaatataaaaaccttttatatacatatgaaccaactgttggagcatttctaaaactgtattgacttatacaacctccagaaacacactattattggatcttgaagtatactacttaaattctacttgcgatgtattgtaatctcattcaggggcggagggcccattatggctcattatggcccccgccccccaaaaaaaaaacgggccgccggcccaacatctaaaccctaatcactgccgctccgagcgaccgcgcctccgcccgccgtccgccgccctaacactgccgacctgtcgactgccgtctgctcagccggccagccactatccgccgagcgcccgacggcccgagcaggcgagcagctccgcatcgcgcgacgtcccaagcaggtgagcaaccaggggcagtaaaggcgttcgcgcgacgtccaacagtgcacctgcgcgcgcgacgtctcgctgctttctccaactcctgttcggtatcgccgtttctcgcttggaggttgtcctgtagcggggacgaccgcccattccggcgcccgctcttctgctcctcctcgccttcctgtttctgctgcggggagttcttccgccgcgagccgggacaccgtcgccgccggccgcccgctgtccgacgcgcagagcctcgtgtccaagcgtggcaagttcaagctcggattcttccgtccagggtttggctcgagatggggaaggcaaagagcaagggccctaaattcgcggcggtgaagaagattatcaccaagaaaaccatcaataagtacaaggaggatgtgctgaaccacaagaagaaggacgtggacaaggagaaactcggccggaatgtgccgcaggtttcgtcggcgttgttcttcagctacaacacagcattggggccgccgtatcgggtgattgtggataccaacttcatcaatttctcgatacagaataagctggatttggagaagggaatgatggattgcctttatgcaaaatgtaccccatgtatcacggactgtgttatggctgagcttgaaaagctggggcagaagtatcgtgtggccttgagaattgccaaggaccctaggttccaaagattagcatgcacacacaagggaacctatgctgatgactgcattgtggagagggtcactcagcacaaatgctacatagttgctacttgtgatagagatttgaaaaggaggataagaaaggttcctggtgttccaatcatgtacatcacaagacataggtattcgatagaacggctccctgaggccacaattggtggagcaccaagaatctgatcggtgcagacatgagatgttctgggatgtaatactatggcggtacttgtccatctgaccaagtcactatttcatgtttcagtccacgacaaggactaggataagaacgctgctttctaggttgagcttactgtaactactaagaaatttttattatgtaccaaccttatcatttctacaatgttgcgggatgtctgaagtaattctttgttaaaagatcgggtatcctgctcccttttgcttctcaatcttgtgcgctacaagccataatcccaatagagtggctcttcctgaatctctcatagaggatgaacataggagtccctcataatgtgaaacggaggcgacaacaatctgcaacagtcgttggatatttaggccttgtatttctacagtgctacaacactttactaaagtttagcacatgaaatcaaacaagcatattgaaagagcagtgctaaagtttagcacctattaacactggctcttgttttgatactaaattatgttaaaagtgtgtcccctgacacattaatggtccatgtctatccttagcatctccttcagcactactgaagcttataccgagtacaacaatggcactaaattacccaccaaaaggcaagcaaaagtacaatcgaggcactaggaatgaccaaacccattgcataggcctgttttgttcaactcttttgaacagcttttctgagaatctgacagttttttctaaacatcttttctggtacgaagagaatctgttgtgaagagaatctgaatatagtgaagattacgtgcggaagaagataaaatagtccacagactttagtatgtagaaagtgacggttttctgctatcacagtgaagttagaggcatcttaccgaaatatccaatgactattgtccaatctgttctttttatattgattccatccaacaatttctcagttcatttttttagacgcgtccatctcatacaaatttcgcaataacaaaaggagtcaacacaaaaaaaaaaccagtcaaaatgaacaattatgcaaaaatcttgcaaaaataaaagcaatgagaaactcgccaatatgcaatagagttataggtagcagatgaatttgatgctcgctgtgatctcacccaccggacacatcaagaacatgacgagtcgctggagcctttcacctctacctc

SEQ ID NO: 23885 - DNA, 1647 bp, Zea mays
gcgacgtcggcctggcggcgacgctggacgaggggatcgaggacctcgaggagatgatggaggagctgcgcgtggaggagagcgggaggagggcgatgagcggtgtccgtgagctgcagcggagccacggcaggaacttcgatcggcaggcgtcctcgctccgccgccgcctcgagaagatgacgccggccgaccccgagccctgcatcaaggacatccgcgagatcgccctgcccgtccctgcgccaccgccaccaccggccgagcgaagcgacgacgacgaacgcgtccacggcgccaacacccccgatgtggcacggctgaggatgaagatggaggggatgtcaaagggcatgcgcgagcggatggcggagtacagccggcgcctggaagccgtcgcctccggcgacaacactggctgcgagtcagggaaatgcggcaaccggcacagccgaaaggcgagcgcgagcagccagagaagctggagcggcggcagcacggcgagcaacggcaacgcgccgtcgaccctcgacgccggcccgcacggccgcagccgccagaacgtggcggccgagaagcgccagcagcagcagacgattatggctggagagtgcaaactggtgggctcggcaagttgctgcgactgcagggaaatcgtgtggaaggtaatggagcaagtaaaggcagaatctgatcaatggactgagatgcaagatatgttgaagcaggtgaggttggagatgcaagagctgcaggcttcgagagatgcatggcagcatcgggctatggcttcagacattagtctacgctccttgaattcccaagtactggagtggaaaaaccgggcacaagcgtccgaacagcgtgtggaagagctgcatagggagatttcagagctcgaaagcaagctacacactttcaaagcccacttaccagccccagccgctattcctaaccaaaagcaatggtcggatgcgtgcaagatggagtacccgagagcaaagcctcagcacccgcggtcccaggaatccggcaaggaggagatcaagaagcacgtcctcatctgccgcgtgaagcgctcacccagcagcgtgctctcgaagcggtcgccgttccaggagataggcaacatcagcttgccgcggcattagtgaggaccgaggagcatgggtggcgatgttgctctgtgacctgtgtgtgagtgatggggatactgcagcgaaaccgcgaagggttcagccgtaagcgggagagagagtagcatcgtgatcgatcagcatctacgtaataaataatttatgtatgacccactgatgagtaacaaggcctgacttctcgtcagatcggtagtaataattataagtagtcagtgactgagttgagagcctgagatggagttaatctgcccggagtacagtgccggtgaataggtcagatatgtatgtaacgataacgcctctttttgctaatatatatgtgcaattttgttcctcctgcattccaatttttgttcgttgtgttctatgactacgtgaccagatgatggtggtgattatgatacattgattggtgtatgagctcgagtcaaactctgaatcaacttagcgctacaatgaaatttcatccagtacaacgacgcatgtatac

SEQ ID NO: 23886 - DNA, 11605 bp, Zea mays
tggagccaaacaatattcagggttcatttagaccagacagaacaatatctacctaaataacctgtgctgataaagttataatttagcgtgagcacctgagatctatttgggccgagcctcaacaaatatgagatgatttgatgcaggtcatagctatagccacgagagagtggattaggactagatataggctcgagggcatctatgatgcacacatcctgttgctgccctgggaaattaggaatatgaacgcagccaggcgcaattttagttactactcccccatgttgaaatgtagtgtatttaacttatattgagtctgaacaaatatatagaaacagaaaagaataataatattgttaacatcatgtaaactatattggggacgttgtagaatgtatttttattataaattatctctttaacttatgacaaaataaaaatacaatatagagtgaatatctcactgcagacaatgtgggaatcaaatagcgtcaacactcctacttttcatgccagcgtggcagaacagacagcaatattcctacttttgagaacagagaccgaaagacattcaaaatggtagtagtagaacatgccgcagcctggatgcctgctttctctgcaaagcacgtcccagacctcctgcaccaaacttgtccgctcgatgcccatcccatcacccgctagtcattgctctagcggtctagcccggcttggatgaattcggatgtctgaagatccgaattacccacgtttgtattcggataaaatgctaatatagatatccgtattcgtattcgattttaatatgggtgttaaatagacatatccgaattcgtttcttctctatctggtttaagattcgtattcgacaacattcgacaaaaccgtgaaatatccgatattattcgtatccgaaagaaaaagtattcaataaaatcaatttcaacttacttttattactaattacaagtaattttaaacattaaataatatactaagaactgaagtacaccatttaaagtgttaaaaatatttatatcataaacaaatgtctgtgttaattttacattactagtgatatacaatgataaattttaataatattaaaaagcctaattttgaatacaatagattattggagttttagagtccaaaatacaaatatacttaatataaaaaagattataattagagtccaaaatataaatataccaggtataaataatttatttaaaaatatgatattcaactatatgtttcaactaaataatgtatatgtactattgttcataatttacttgtaatgtgaattttatcaactataaatccatcgataaaacaaattaatacttgttatgatgttatgttctaaatcaagtatccgaatataaattcaaattcgaactatccattttgtattcgtatttgatagtattcgtattcatattcgtattcgaattaaaatatggtaaatagtgacattcgaatccgtttcaatgtgtatcgaatccaaatccatccctaagcccggcgtggctgggctgctgccgaatcggagctccagcccggcgtagggcaatccagtcattttcgccgcgaagatcctttcaaatcgtggcatctcacggaaaacgagaaacaccgcctccctttccatccacctgtcgtgcgtgcagtcgtgcactgcacccggcctttttcctcccagcgccttctccctctccgaccaacaccttccacagacccaaagcaacccgaccgttgccggtgccgcctcagccccaggaaaaaggaagcccctcgtccgtcaacatccctggtcctgtcatccacgcgcgcacgttcaccggcggcccctctctttcagttcggtcggagggccaacccgacctccgaggcctgagcggcctcgatgtcggcgcggcgggcggccaagagccagcacgcggcggcgacgccgaggaccatcaacctcaacctggcgaggaggccgggcggcgggaggcccagccggggcgcggggcgcgcgcagacccgcccggcgccgccgcagccggcgaggcaggtgcaggtcaacctcggcgcgctgttcgagatggagcgccgcgtgcgcgggctggagtccgcaccgccatcgccggcgccggcgtcgcagtcgcaggaagacgccgaggaacgggaggagaagtggcagttccaggcggagatactccgcgccgagtgcaacttcctccggatggagcgcgaggtcgcgctgcgcaagctcgaccgccaccgcggccagatggaggccgcgctcaagtccgccgtcgaaacgctcgtatcggtaaatacacacggcgacacaacacgcattattccatttccgactagtcatcggctccatcaaagcaccgcatgttgtgcaccgacatgatgatgttctcgtatgggtgctgctataccacaggggaggaagaaggtcgacgggaagggcgacgtcggcgttgcggcggcgctggacgaggggatcgaggacctcgaggagatgatggaggagctgcgtgtggagaaggagagcgggaggagggcgatgggcggtgcccgtagagtcacctgcagcggagccgcggcaggaacttcgatcggcaggcgtcctcgctccgccggcgcctcgagaagatgccgcctgccaatcccgatcccctcgtcaaggacatccgcgagatcgccctgcccgtccccgcgccaccgccaccgccaccagcggctgagcaaagcggcgacgatgaacgcgtccacggcgccaacacctctgatgtaagtcgcagcggtactgatacgcaaatcgcatacgcaatgatgttgtgtcgctgtttcagtctcgggattttgccgatgactaaacgtacggtgtctcctctgcacgcttgaaggtggaaatgctgaggatgaagatggaggggatgtcaaagggcatgcgcgagcggatggcggagtacagccggcgcctggaagccgtcgcctccggcgacaacgctggctgccagtcaaggaaatgcggcaaccggcacagccgaaaggcgagcgcaggcagccagagaagctggagcgggggcagcaccgcgagcaacggcaacgccccgtcggccctcgacgccggcccgcacgcccgcagccgccagaacgtggcggcggagaagcgtcagcagcagcacgtggtacgatactacgattcaaatttgctccctcgcactgttcataacacagttcattagcttggtcactactctagcttcgatattcctcgctttctcgggaagcaagattaggagtaccaagggaatgcgaatcgctgaccctgggggtacttctggtcagcgacgcacactccacttgccgccattatcagtccacgattaagctggttttgttcccatccgggttaatcagggcgagctttgaaattgcctacagcaccggatgcagtgctggtcgttgctgtaccgtggggatcactttgtcttgtacagggtttgtagggagatgagtaattggctgatgatcacctctggggccacgaatctatggattggcacgttgctaccaacatctaaaacattatggccctatgggttccttctcggactgatactattacgctgctggtaataatcactgttttcttttgctgtggagcatggaaccatgtgtgagaaacttggcacttttaagccttttatctttgcttcacctcgctactactggagggtactatatagatggatttagcatgtgtttccctgatttgaaatcgtcaatgattgcgataccgcccaagctgtcagtgactctgtccagtggtccttgggcctgggccaaagagttggagcttttcgttagttctgttctgttctgtttgttactgctcatctgagacgtgggcggtgggcctaagggaggctctgcttgaacatcatcaaaattgttttgtttttctgggtgcttatatttctagaccgcgtctgcacttgcactgcatgcatatgtggcttgtccgcctgactgcatctcgtccaacaagtgtttttgtgagcactagtcacttggcttcaagaatggtgatgccgttaccgtagccgtaccttttattgttttggcggatgaaagattcgctgtcaatgggaaagtttgaatacgcgccaacaaaagaaaaaaaaatcaatctgttctgcaaatttgaaactgcaaggaggtgaagttcagtaatcagttaagacaaactggcacgtgccagagcaggaactgaagtacctactttggcaaaggcgtatacatagctttgaaaccacaaaccggcacatgatctatctcagtatctgggccaagtatgagcttcaatagcctataggagatgttgcccccacaacgagaaagcaaagctttttcctggccagttcgaaaggcctgggccaggcttagggcatgtgttcgtcgccgagttgctttcgctccgactgctccgtatcagatagaccatgtctgctcaccagcagatgtgcatatcaccataataagtttgctatgagtgcatatagatcgaccgaagttggttgggtctccagttcttaatggcaatccagtactatgcattgacagtaaagctagttggtgaggcaatccattcaaatctgaagcaactggtaatcatgctttcgaattttgtcgacacatactgggtaaaattttatggcgttcgcccgcctgcaccctctccttctgcccctatggcccagtgacgtttcttgcattactccttccgtcccataataagtgtcatttgtcgagaagttgaagttttctaagtttcatcaaatatatataagacaatactaatatttgtaaggtgtaataactatcattagattggttgcaaaatatacttttacagtaaacttatttgaagatataaaaatattgatgttattttttatatactcggtcaattttaaagaattttgactcctccataagtgtggtgtgcccttaaatcatgacagagggggtagattttttgatcactgaatcatttgtcagtcttcagactaaagtcatgctaaatctactcatattgcttgcgaaaagttttagtggtaactgttccttttttcccagcagattatgtctggagagtgcaaattggtgggctccgcaagttgctgcgactgcagggaaatcatgtggaagataatggagcaagtaaatgcagaatctgatcaatggactgagatgcaagatatgttggagcaggtcaggttggagatgcaagagctgcagtcttccagagatacctggcagcatcgggctatggcttctgacatcagtctccgctccttaaattctcaagtaagcagaggttctacctatgcttatgccctcacaattgaagttattcgtgtccaatgtaaatgcactgtagtattgtgcgtagatcaagtaaaaaactattttgaatggggtattgctgagtgctgaccacacttaataaaaaaagactattttggcactaaaaaattactgcatttggtatgatgaattactgctgaactctgtttgtcaaaaagaaccgcagaactgacggtgaaatagtggaggtacgtaagtataatgctatattttaggtttcatctttttgaggtgttattgaaggtctatgtattgcgttatacaaatctggtcactaacttataaaagttaccatcagaaattggtaaaaacatttttttgaagactaatctaatgataaaatgttatatgtcaaaacatggcattacttgtattccatgcaacctgacataatagtacctgttttttgtattgtactggaaacaaaatgctatcctggacggaagactagctattgctctagttcattatatgttgaacacaacatttgtttgcgtgtatcagttaagtgtattgagcctgaatgcgaaaatatttgttgctaagttggttaggtgttgttcgacttctcgtgtcttcttcttgatacaacgtctggggcttatcaatgtgtgcccgaagtatccattttgtcaatgtcaatttgtgagatagtcaatctaatcgaaaactttcaacgtgcggcagttactggagtggaaaaatcggggacaggcgtacgaacagcgtgcggaggagctgcacaggaagatttcagagctcgaaagcaagctacacacttccaaagcccatttaccagccccagctgttattcctaaccaaaatcagtggtcagatgcgtgcaagatggagcacccaagaggaaatcctcagcaccagccatccaaggaacccggcaaggaggagatcaagaagcacgtcctcatctgccgcgtgaagcactcgcccagcagcgtgctcccgaagcggtcgccgttccaggagataggcaacatcaggttgccgcggcatcggtgagcatgggtgggcaggtggccatgtgttatgtgagactgtgacctgtgtgagtgatgggctgctgcagcgaaactgcgaaggattcaggcgcaagagagaactctctttcggtttggcgtccacagtagcatcgatcagcttctacgtaataaataatttatttgtgacccactgatgagtaacatggcccccctgactgtcgtcagatcggtagtaataatcataagtagtcagtacagtgatgaataggtgagatatgtatgtaacggggtaacgctttatgtatgtgcaattttgttcctgctccatccaattttccatttttttgcccactgtgtgatttgttcatggtacattggtatatgagctcgagtcaaattctgattagcgctgaaatgaacacagaacactgatggtacattggtatatggtttcatcaggcccacggccgcttttttttttttttttttaacaatggaaattgaggctttattggatttggatctaaatatactacaggtacagcatccatatgcaactaacagcaacgatcttttctaccttgaagatcagcaacggtatagatgattacagcaccaagtcagtggttaatcatagagagccaagcgcagtacgtgcacacgagcttctgagagatgtacacgtacacggcgaaggagaagctcatgagcgtgacgtccttccagtcccccttctgcttggggctcaggctctcccgcgctgccatcccggccttcaccacgtcgccgcgcagcctctcggccgtggcagcccaccacggggtcgtcttctcctcaccacctcctcccccgccgccgccgcttgccggcggcccggacgggaggtgactttggcagacgaggtaggatctcggcctagacgacacggcgtcgctacatcgtcgcctgcagccctgcggaacatgtggggtgctgctgatggtaaacatgcacagggaagccatgcatggacggtcggtcagatctagcctgtggccttgtgggctggagatgggtttgttcggcccggccgggaggagagaaccccagccggcctccagcctgcccgctatgtcagcaggaggagaaaggacagcgacatgttggcctggcatggcatgtagtacctgaagcagagcaggcagttgggcgaagcaagttcacgctgtagtgatcgagtgttttttgtttctcagatcaagaaaagttatccaaacgagacgtcttgttgttttctgaaaggtaaatccaaagaaaattgctggaaacatgataaaactaaaatatctatgattgtgtttcgaaatagtgaagtccattgccccccccaccccaaacctgtgccaactttcaaaaccgcgaacttcaatactaaaaaaacagaagtcaacttttaaaactggacaaaatatccatttcgaccatttcagagtggtttctcatgtgataggttgctgcagcaagtgggcaccgcatgacatgtttttttagccatactatatgctattaaatattttgagttctaaataatcttaagaaaaatattcaacaagaaccatctagatatctcaagtactacacttctggtacaaagcgtttgtccatccaaggtgatttgcaaaaaaaaataaaaataaaattgactttcaaacttcaataatttaaaatgaatattttagcatataacagtttcaaaatgaagaacttatcagttatgaggtcatagatagggtttagtgctacagcttggtacagatcatatcaacatcctagtgagtttgaaaaagtaaaactaacaaattttgataacttcaaatgaatatttgcgcatttaaaacaccctatgtaaaatgttataaattataatgttgcaaaccacatggagatctacaacttttgtgtatgtattgtcaacatctgaaactgttaaaaaaattaaaactcaatgccaaattttgatgatttaaaacgtgtacttgagcacctatggcacccctctccttaaaatcacccttccatcctagactataagttatttcatttttagatagtaaaatcatctaaaaaatagtcaaatttatgtaataaatttataatatttgtgacactaaataagtattattgtattcttcatcaattatattttatagtatatctcatcgatgtcaatcattttgcaaaattatctataattttaatcaaatttgagatgttgtgaccctcctagaaagctagaatgacttgaaatagtcaaagagggtggtttatttggttttgaaagtcgaaaagattactcccttcatctcaaaatataattcgttatatactaaacacacattcattaattaacctatgaatatagtttgtatatacgtatatctacattcattattatttatttaaacacagacaaaaaagggctagaaagaactatattttagaatctagggagtataatttttagtattgaagttgagtttttttattaatgctcggcgccaaaatagggggttaaacggacctcactcttttctaaaatgttatttaatgttaatatccggaagtgatgggctctcgttttaaaagggctacgtaagttctcttgggctctcgtttatctggttttgcagttggtcgacccaagtagcgctccatcggcgggggtctgggggggagtacggatggcaccaggacgggcctgccagcgtagaggtcaaaaaggtcaaagcggctgattcggtgattcctcttctctccgacctagggaagcagcagtcaaaaagctgacccacacctcccccacccccacccacgagccatcaactcacctccccgccgcatccgaccactcaccagtcacccccaccaccggcaccaacccaatccctgcacctctactacacccatcaccaccgccacccaatcctgtgcgtccacgctcccgccctcccgcgacgcgccgagcggctgcggcgtcgatcccgtgctgcctgttccgcccgcgcgccccggatctggcgccctgcgctttgccagtccgcaccggctctcacgtggagtggacggagactgcacgtctccacctccaccccacctcatcttctctgcaccggggccctgctcgctcgatgacggcgggccccggcgagccgcacgcacgaaagccagtagcacgcaggccgcttggccttggcgtcttggacgcaggagccgcgtgtccctgaccctagccttggacccagggcttttctctgttaccgcggtaagcctctgccctctgggaaaatctccgacccgggtccaaatccagtcgacggccgttgactgcgagcgagaggcagtggctgtggctgggagcgagcgagaggagtgactcggaagcaagcggaggcggctggagggacggcagcggatgcggtgaccatctcgcgcacgcctttccccgtgagcgctggtcctggctttccttatctccccgagcaaccccaccgcacccttctcggtggatccgagggctggagtctcggcggcggcatgaagcggcagaggtcgtacggcgacggtctggacgacgaccggcggaggttctacgaccgcggccccccgccgcgggactacgacggcgataggttcgatcgcaggaaggggttcggtggcggcggcgggttccacgacagccggtaccgagactacccctccccaagggggtatggtggggatcgggccttgcaccggtccgagagtttctctggcttccgtcgggagttccccaagggtttccggtcggagcgtgacaggtcgcggcgggatggtgacggcagctcgacgtggcgtcggccgggaagcgggtggacggacgccgagtgttttgaggagtacagggcacccgccaggctgggagcgtcatcgctgcctgggcagccgcggcggtcacggtcacggtcgcccagtgagccgaggaggaggtttgaggttgccaaggcagagaagccgaggaagcacagtgccggcatcaatgaggtggaggaaggtgagctctcaccagttgctgagcccaaggccaggcctgctgccgtggagcatcggaagcaggttgagtcaagtcgtgtaaaggagaagggactggagcaaggtaaggcgaagaaactgaattctggggtccaagcaaatttgggagctcgagctaatggatcctctagtgcatctgatcctaacaatgcagcgagggaggaaggcaagaaaagggatgacatactggtagctgaagcaatggatgaagtgcgtgagaagtcttcaacaatggttacagaggaagtcgtcagtggaggacatcaggtacaagcactacatgcggctaccactgattctagtgagtttgggctaaccacttcacccatgcagcaaggagtgctgcaggaggaagtgaagccacaagaggagactaccaattcggttgacatggttggggagaacacttcctctaccatgctgaaggagggtattcaggaagaagcaacaacaagagataaaactaacaatgataccgatgaagtcagagagagtgcttcatccaattttagtcaagcagtgcaggaagaagtgacggcattacacaagactggcaatgctgctattgaggttggaaagaacatttcacctctcatgcagcaagaagtgctacaggatgcggtggtggagttagacgatactgcacatgcagttgatgaggttgtgaagagtgcttcctctgatatgctgaaggaagttattcaggaagaagtggtgcaacataatggaagtgccgatgttgttgatatggttgacactgacacttctgatctgccatgggaggcaatgcaggaaaaaacagtaatactggatggaaatgaccataattttgatactgtggaacctgtcagttattctggtatgctgaaggaagcgatgcacgaaggagagttgacaagggatgaaactgccattaacactattgtagcaggacaaggtaattcaactgatatggtggatgaagtgatgctcggtaaagcagctgtgcgggaagtaatctccagtgctgttaattcagttggcgagagcaatatgtctaccgggctgca

SEQ ID NO: 23887 - DNA, 1105 bp, Zea mays
tgcagcgaaactgcgaaggattcaggcgcaagagagaactctctttcggtttggcgtccacagtagcatcgatcagcttctacgtaataaataatttatttgtgacccactgatgagtaacatggcccgcctgactgtcagatcggtagtaataatcataagtagtcagtacagtgatgaataggtgagatatgtatgtaacggggtaacgctttatgtatgtgcaattttgttcctgctccatccaattttccatttttttgcccactgtgtgatttgttcatggtacattggtatacgagctcgagtcaaattctgattagcgctgaaatgaacacagaacactgatggtacattggtatatggtttcatcatgcacactgatgcaagcacaactgcacaagtaacaatggaaattgaggctttattggatttggatctaaatatactacaggtacagcatccatatgcaactaacagcaacgatcttttctaccttgaagatcagcaacggtatagatgattacagcaccaagtcagtggttaatcatagagagccaagcgcagtacgtgcacacgagcttctgagagatgtacacgtagacggcgaaggagaagctcatgagcgtgacgtccttccagtcccccttctgcttggggctcaggctctcccgcgccgccatcccggccttcaccacgtcgccgcgcagcctctcggccgtggcagcccaccacggggtcgtcttctcctcaccaccacctcccccgccgccgccgcttgccggcggcccggacgggaggtgactttggcagacgaggtaggatctcggcctagacacggcgtcgccacatcgtcgcctgcagccctgcggaacatgtggggtgctgctgatggtaaacatgcccagggaagccatgcatggacggtcgatcagatctagactgtggccttgtgggctggagatgggtttgttgatcttttcagggagaagagaacggataagtagctgcagcctatgagaggaggaggagaaaggacagcgacatgttggcctggcatggcatgcggtacctgaagcagagcaggcagttggcgaagcaagtt

SEQ ID NO: 23888 - DNA, 1836 bp, Zea mays
  misc_feature (863)..(863): n is a, c, g, or t
tttgtttctatatattcattaaaaaacagtagagttgttcgcttcatattaaagtcaattgttcgaattattgtagctgctacaattgatagagacaaaacaacgtaaaaacagccgataaagattaaaaacaaatgaacaggctgagctttattctacaaaaactttctcaaacggtctaaattcacaaaccctggattcatcgaaacaatgcatctaagtgccatattcaccatttttgtgccgcgcctcaattgaagtttcatcaaagttgattacacaaatgtgttggtttgttttcttcttcactgaatcactggtggccggcctcgcccctcgcccccaccacggtccacagacagcaatccgcccgaaccatcatcaatatcgcagcgcaataataactcctgtgaatcaccggcagatgcgtgcatcattgtgggctggaactgcactctgctgaaacagaacgctcttggcgaaccttccctctccatagtataatctgttcatctttaaataatataggaatgcatggaaccaaatctcagttttgtaagtggtggcgaattcaatcctctgttcctcaactcttttgtttcctcgaaagtcaacccttcagcaacgttttgcacgagcttaggatagataggagctaacggtttccacagcatcaatggtacgccaggccttttctgggggtcatagttccgaccgcggtacagtataatgatgtttatgctgcgggatacgactttgccgcctgttttatccgtattatgacctcgagatggaagcaaatgttgtccatgtcgagcgttggcactcccagacatttgatcctcacagcctctgcacgtttnccaatggttgtggatgtcatcaagcatattgtgtgttaccccacctttccccaaattgatctgccgtgagcaatcactgtgccggtacctctccaccagcgccgccacctcctcctccgacagaggttccccgagaacctcctcccggctcctctcgtcgccactagcatcatcgccgacgcgtgccgcggctgtgccgtcccatgggcggtcgaggcggccggggccgaagggcgagaaccgggtgggctcgcggaaaccgatgggcctccatgtcgggtctgtctccgagtacgagtaccggaagtcaaagggaaggtcggagtgcgcaggctcatcgggcctgatcttgcccgccagggccttgggcttcggcggcggcgtcgatggcgcccgaggtgggagcttaggaacccgcgtgaacggagggtcgtcgtcgtcggggtcaaaggaggatgaagaggagcgcaggaggcggcctgccagggcctgggcgtcctgagcggggcgccgccatgggagaagcttacgaggaagaagcatctttttgatgagcttattgcaaaaatgagactaccaatatggccgttttcacctttgttcatcaacgttgcactctttcagatatgggactgagacacactcacacacttgccttaagcccttaacgccgctcgtaatctgctggaccggagctggagttcctcatttgcccttggttctctctcgctcgagctctctctctgtcttcgccagcgaccgctcctcctgctcctctgtaggtcacggtcaccccagtccccagccaaggcagccgctcaggcctgttgccctgttgagctgatagtcaaggccactgttctgagaatatgcaactgcttatcgccggatgcctggatggatgaaagctgctgctgcagtagcagccgaacggggctggcggagaacgggacttcaggctggtggagagcgg

SEQ ID NO: 23889 - DNA, 1713 bp, Zea mays
ttgcccatgatggacacagtattcatttgcccttttttgtctggtagagctccacatattcatattcattaaaaaacagtagagttgttcgcttcatattaaagtcagttgttcgaattattgtaggtacaattgatagagacaaaacaatgtaaaaacagccgataaagattaaacaaatgaacaggctgagctttattctacaaaaactttctcaaacggtctaaattcataaaccctggattcatcgaaacaatgcatctaagtgccatattcaccatttttgtgccgctcctcaattgaagtttcatcaaagttgattacacaaatgtgttggtttgttttcttcttcactgaatcactggtgggcggcctcgcccctcgcccccaccacggtccacagacagcaatccgcccgaaccatcatcaatatcgcagcgcaataataactcctgtgaatcaccggcagatgcgtgcatcattgtgggctggaactgcactctgctgaaacagaacgctcttggcgaaccttccctctccatagtataatctgttcatctttaaataatataggaatgcatggaaccaaatccctcaacttcacaccaattttcttgcagtcagtagtcccaacatgagtgcaatctagccggacaacttccacagtcttaaacgcttctctcactttatcaacaacattaacatacacaccgttcctagctgctcaacacagaaagactcttctttgatgaaagaaacagcttgacaacacaactatacgatggcaaagtgagccccatataacccaaacccaaatggttataaaaaaaaacaatgttccaacttactcagttttgtaagtggtggagaattcaatcctctgttcctcaactcttttgtttcctcgaaagtcaacccttcagcaacgttttgcacgagcttaggatagataggagctaacggtttccacagcatcaatggtacgccaggccttttctgggggtcgtagttccgaccgcggtacagtataatgatgtttatgctgcgggatacgactttgccgcctgttttatccgtattatgacctcgagatggaagcaaatgttgtccatgtcgagcgttggcactcccagacatttgatcctcacagcctctgcacgtttccaatggttgtggatgtcatcaagcatattgtgtgttaccccacctttccccaaattgatctgccgtgagcaatcactgtgccggtacttctccaccagcgccgccacctcctcctccgacagaggttccccgagaacctcctcccggctcctctcgtcgccactagcatcatcgccgacgcgtgccgcggctgtgccgtcccatgggcggtcgaggcggccggggccgaagggcgagaaccgggtgggctcgcggaacccgatgggcctccatgtcgggtctgtctccgagtacgagtaccggaagtcaaagggaaggtcggagtgcgcaggctcatcgggcctgatcttgcccgccagggccttgggcttcggcggcggcgtcgatggcgcccgaggtgggagcttaggaacccgcgtgaacggagggtcgtcgtcgtcggggtcaaaggaggatgaagaggagcgcaggagacggcctgccagggcctgggcgtcctgagcggggcgccgccatgggagaagcttacgaggaagaagcatctttttg

SEQ ID NO: 23890 - DNA, 1066 bp, Zea mays
tggatcccccgggctgcaggttttttttttgccttagagaatttccacattcgccctcttcacttgcttgcttcttcgggtgtgatgtggtgagacaaagcatagcttggtgcctatattgacacagtattccccgaacacatcactgatgaattgagtatagttattagtgacgagtctactgaccccaaagcatgctatagtctcacacatacatgtccaatgctccgaattttacagcagaatacttgtcaataactcaatcgataccaatgctagggtccgaagcctctttgatttaggtacctatattatataccattgtctttagtcaacttaacacggcacgcgaataaagctgagctctgtgatcaggttggcgcaaaacacgcaaacatgctgcaatttttccttcactggaccttagtttgtctactacaggttatagctcatccttgacgttgtcaggggccgctactgtctccacgtctggtatttgcagcttctccttgatcagtttggccatgtccttgacactcgatttctttgaaagcttgatcgggttgtttttgtcttcagcaagataaaggaatagcgtcgggtaattattcaccttcaatttgggatgttcattcacagaagcatctatgcgcgcaaatttaagattgtccgaaccactaaaatgcttcgccaacttctcaacatttttacttatcgcttcacagtcaacacaccaaggtgtatgaacctcaaggaagacgttttgatgactttccagcacagaagaatcaaatgtacgaccaacaaccttttcaataagtcccttctcttgaggcaatggttctgatttgtggtatggcgggagcgtgccatccagaagacttaagcagaactccctcaggttgtttgcattgatatctgcctccatcagatacttggctccattgcttgtatcaaatgctgtaacagtaggctttttttctgattcaaggccataaagactgaggaatggttttgacaaaataataaacgtgtacgcgtgggcgaacgcgtgggcggacgcgtg

SEQ ID NO: 23891 - DNA, 1928 bp, Zea mays
atcacagattcaacagtattaaacattaaatggcaatatcatgctttcaaatcacacaaaacatagcattgattctacaaaactatggacaaaacatagcattcattttatatgagatacataaatccggacccacgtgtcatatattagcgggttacccatcgggtagcgggtatggggcaacagagaacatacccacgcccaccatacccgatgggcataacaaatgacccaataaaatacccatgggtatcaaaatccgccatacccgtgccctaatagggtttttacccatcgggtttcgggtttcgggtacccattgccatccctaatgctagggtccgaagcctctttgatttaggtacctatattatataccattgtctttagtcaacttaacacggcacgcgaataaagctgagctctgtgatcaggttggcgcaaaacacgcaaacatgctgcaatttttccttcactggaccttagtttgtctactacaggttatagctcatccttgacgttgtcaggggccgctactgtctccacgtctggtatttgcagcttctccttgatcagtttggccatgtccttgacactcgatttctttgaaagcttgatcgggttgcttttgtcttcagcaagataaaggaatagcgtcgggtaattattcaccttcaatttgggatgttcattcacagaagcatctatgcgcgcaaatttaagattgtccgaaccactaaaatgcttcgccagcttctcaacatttttacttatcgcttcacagtcaacacaccaaggtgtatgaacctcaaggaagacgttttgatgactttccagcacagaagaatcaaatgtacgaccaacaaccttttcaataagtcccttctcttgaggcaatggttctgatttgtggtatggcgggagcgtgccatccagaagacttaagcagaactccctcaggttgtttgcattgatatctgcctccatcagatacttggctccattgcttgtatcaaatgctgtaacagtaggctttttttctgattcaaggccataaagagtgaggaatggttttgcaaggttttcttcagcagtgtcaacatatataaacattatctttgtcttgaatgctctggctatttcttcaaccatagattccagatcttcaaaatcataagcctctgcaaaggtgaagacctgtagcttaatagggcttgaatatactttaccagaattgagctcagtgaatacagtaattagaggaaacttgttgagctccacaaaccgcaaaatttccttttcttcaaatttcccatcgaacttttcaaacttctctggctcgcttttaacgaggcccacaaatttctcctcggacgtaatacctggaaatagaactttggcaacacttgtatcactggtttctacaaactgtacctcgttgtctgtggttgctgccttcacaaattcttcatggtctgctccctaaaaattcttgaatagaccaataacaaaggtcatgtcctttttgaggaactcctcagctgaatccttagactgaagcctaatgattggcacgccagtcttctttcttaccctcgtgcctatggcgtccttggtgtggaggccatggtaggcgtgctcggtgccattgacgaagaggagcacggtggggaagcccttgaccccgacggcggcagccgccttggggtagcgctccccgtcgagcttcgcgaaggcgacggcgctgcccatggcgcgcagcggaagcgtcacagcccaccctggctgtctcccttccactcctccgagatctagctccagtagagcccgcacgacgcgccaccgccacgaggggatcgaaggaatcggggggtggggtggcacgagtgcgcgatgcgatggtgccgtaaattgctctcgagctcgag

SEQ ID NO: 23892 - DNA, 2630 bp, Zea mays
  misc_feature (185)..(185): n is a, c, g, or t
  misc_feature (2577)..(2577): n is a, c, g, or t
gggggcttttttccttttttccccaacctgggaaaaagggggatttttcccaaagcggattaaatttggtaaaccccaggttttttccaatccccggcggtttaaaaggcgggcccgggaaatttaatttcgcccccctttagggggaaatgtgtttccgggcccccccctgaattttttttttntttttcccttttttttttttttttttttttttttttttttttttttttgttttttagctagcagaaatttgcatccaatgttattaagaagtgtcttacttttggttctcatgagcaacgacagattctgatcaatgaaatgattggtagttggcacaactgatgagaacgaaccgttacatgtttgttttcaacaatgattttcagctcacctttttcttttaaaatcagtagttggcacaaccagtctatagcacagctcaaagcacagaaacatacgcctaagaaacataacacccgccggtaccagcgcagcgtgttgccggccggtgacacaatgacgcgcaagacattatggtgtcggctaccacctccttggacatcttcaggaacgggtccatgttgtggtggtacccgccattttgcctcactcctatggatgttgctctccaggacaggtgagttcatctttaactcacagcttgctgctcattgttggaccggtagccatcatgtctcgcatggctaggccctcatactcctcatctgacttggtcgagtgttcgtccatagagccgacatctatctgcaagtaccctcgtgcatgtgcagcatgtctctttcttcatcggaggtcttctcctggactcggaggcccaatcgatgacggtcacgatggggcggcacaacccacaccaacataggtgtcatggaggtcctcaacctggaccatctcaatggtttgcattcagctatggacgctttggtagcgcaagtcgtattctattgctcaccgaagggccctagcaaatgctttgaaagatgtgaagattagctgtatggagcaagattagcttcaaaagacattttttccaggaagcttcaaaagacaatatggagcaatattagctgttttgaagagaatttgaattgacagatgtgaagagtcatcctagatgtgttgaccagatattgtaaaaagtgctcaaccagcttaaaccaaaatgaatagataagacttttgtataacttcattgtaggagcttacaatgcaaagagggctcagatgcattgtcgatgaataaatcattgtcaagccttgtttgaagatttcacaaaaactatttcttttcaaacaaactaagtgttgtattttaaaagttgatggaatataaatgaattaatgtagaacttgaaatgaatgttttagatgtggctaccaagaatgttttgtttaggtctaagcatagaaaaaacatcaaacacacatatggttgataaatgaaaaagataagcataaaaaacatgtaccaactctctgagtaggaatatctaagccacaacttaaatgagggcgaccaaacaagggggaataataaccaacaatttgtttcagcttattaaaaacaaatgaggtggttaaaatttgcatgttcatattgcagagaagttaaaacaatgaagctagctaattgtgcattgtaagctacgcaagggcatgtagctaattatttctgaatcttcacaaatctcaaccttagtcataaacatgagagcttataaaacaacaccatactttctttttgaaggataccagtgagctatagagacaccatcagctagaaacccatcatcatgtttgaaggatgatgctactctcaagcccactgatctcaccctagtgctgttttaatttgtagcgaagaattggcgggtcgatgcctttgtcttcttggacacattcccaccctttcaagaactggaccagtaggccttttctgattcaatgccataaagagtgaggaatggtttttgcaaggttttcttcagcagtgtcaacatatataaacattatctttgtcttgaatgctttggctatttcttcaaccatagattctagatcttcaaaatcataagcctctgcaaaggtgaagacatgtgattgatcatcaaagtagagaaaaggcagagagtgccaacctgcttaagggacatggggaaggtgatcctgccgcactccttgagcgtcttcaccacctccttggtgacctcacgccacgaccagcaaacagcggcgcacgccacgacctggcgccgcgccggccacgtcgtctcgctcgactccaccctctggattttcatgagctgcacggtcatcttatgaaacaccagcattgtttcgcagtatttatcatacaacaaattgagcaggatgtttgtcgtcgctgatgcccgcctcgagccaagctacaactgcatgtcggggggggggggggggactagtgaggggagctccgggccgcatttcctgcaagcccgggggaatccacatagttctagaggcggcggcccaccggcgggggagcttccagcctttttgttcccttttaanggaaggggttaattttcggaggttggggggtaatcatggggccataagctggt

SEQ ID NO: 23893 - DNA, 1538 bp, Zea mays
ccaaaaatatggatatgagtgaggactggatatgagtgagcacaaattgaacagatgccaaagtttattccacaagtttttacatttcgagcaaactaaaacttgaaaacgatacattttttccgcatccagcatttcataacgcaccagtacctcaaaattcttgaatagaccaataacaaaggtcatgtcctttttgaggaactcctcagctgaatccttagactgaagcctaatgattggcacgccagtcttctttcttacccaagtaactatggcgtccctatcaacatgagatgcatataattcccagtcaattggtcagacacatgaaagggcactccagcagacgatagattggtaataacataacgaaaagagacaagagaaagcaaagcagcgtcctcacttggtgtggaggccatggtaggcgtgctcggtgccattgacgaagaggagcacggtggggaagcccttgaccccgacggcggcggccgccttggggtagcgctccccgtcgagcttcgcgaaggcgacggcgctgcccatggcgcgcagcgcggcggcggcctcggcgaaccgcggcatgagctgcgcgctgcgctcacaccacggcgcgtacccgagcagcagcagctccgcgtggtcctccacggcgcggcgcgcgttgtcgttgtcgagcgacagcaccatcgactgcgcccgccgcaccgcctccccggcgccctccgcgtccagcagcccgccccgttcggcctcctcgtcgatggccaggagctcgtccagcacgcccgagtcgtcgtcgtcgtccaggtccagccgcgccgccgacgcggtgagcgctaggaccgcgagcagcagaagcgtcacaggccgccgcgccctcatcgtgctcgacggaatgcgcggcgccgcggtctcccttccctccctggctgtctcccttccactcctccgagatctagctccagtagagcccgcacgacgcgccaccgccacgaggggatcgaaggaatcggggggtggggtggcacgagtgcgcgatgcgatggtgccgtaaattgctctcgagctcgagtgttcaaacggcaaggcggacgggaggcgtgcgccgcgactaccggagcaggctgcagtagcacgaggtggggtcgtggggagctgcagcacagagatgacgggtgggcctagctggcggtgggcctggtggtgtcagtggattatagggcgggccgcgtgcggaggacgtgtcggcgagagggaggacacatgggcttgcggtggccgacggcgacccataagccaaggagagtgacggagcggcatctgcatgtgattacgattagattagagtgtggcgagaaggtcagcacttcctcttcggacggacgcaagtcaaagccgcaaaagggattgagattcagatccaggtcgaattgcttctattgatcccaacatttatgtcccatttgtaacaaaagatcgcgccggattggcaaatggtgagcagggccggccatgagggggatgcggagggt

SEQ ID NO: 23894 - DNA, 1089 bp, Zea mays
gtacccgggcccctcccgcggcgaccccccccccccccccccccccccccaaactctgatcaatgaaatgcttggtagttggcacaactgatgagaacgaacaattacactgtttgttttcaacaatgattctcagctcacctttttcttttaaaatcagtagttggcacaaccactctatagcacaactcaaagcacagaagcagacgcctaagaaacacaacacccgccggtaccagcgcagtgtgttgccgaccggtgacacaatgacacaagacattatggtgtcggctaccacctccttggacatcttcaggaacgggtccatgttgtggtggtaccagccattttgcctcactcctatggatgttactctccagggcaggtgagttcatctttaactcacagcttgctgctcatcgtcggaccagtagccatcacgtcgcgcatggctaggccctcatactcctcatctgacttggtcgagtgttcgtccatagagccgacatcgatctgcaagtaccctcgtgcatgtgcagcatgtctcttttttcatcggaggtcttcatcagtttcagcatcacgaagatcgtcaacttaaaatatatatatagatatatgaaggcaccagagtccacctatgcttgccaaccaactttcctatcaagctagtgtgttgccttctgcagtatcacatacagttttcagcataagagttggttcaaatgacttgtttaaaacgtgcactgcaggccttttttgggcaaaatgtttccctcaaaataaatgcacaaatataaagcatgtgacaatccgggaggaaacacagcttattcactagccctgctttggcgacagagatctggtggggtaagtttgttgcccttgcttcaaacaggaagcatgccgagttgagcttctttcttggccccgagatcaatgttgcctgtctgtacaaaatggattaatggcgttctctgcatgacagcaccatcaggcccaccatagaactgtagctttgcttctttccaagcagaaatgggctcttcgttgccaataacttgaatgtttctctgcaactttctcaag

SEQ ID NO: 23895 - DNA, 3736 bp, Zea mays
  misc_feature (3444)..(3444): n is a, c, g, or t
cgacacctcactgccgctcagcggccggatacggatcgcaacctgttgattggagcagttaaacgactagaaacatagatgtgctcgatgaaatgctaacgggcgcagtcccgcgcgagcttagactagagcactccagctaggggagagaaacgatggctgagtggaaggggaggtccggaggaggcaactcgcattgaggcggataaaactctacctgcacattattgtccttccagaaggaaggatcctcttggagctcaaagcgcgcgggggagggggcgcagctgccgcctccgagctcgtcgtcgacgccgtccagatgcatcgcggatatgctggagcccgaggtggacttccggcgcctgggcaggggagacggcggcggaggcggatcggagatacggcagaacggggtcgagatggggtttcggacctttcggtttgaaatggggagcggaggtcgcgagaggcgagacgttgggcaatttcgaatttggtcgcgtccggcacagattgaggtgtgcgaaagcaagacaattgctgcggcctgcggagtgggccctgtctctatgccagtggactttgaatgcaggtacggagcacgaaaaaaaatcaaatacgagtgaatggctacgtgcatattttaaccgcatgttcccggataaaaactctacatgatacaagtttagctgagagtttgtgggtttgattctcaatccgatgaatttttctcacggatatgaaaatattataccggagctcgcaaacccaagtacctgcccccgccatgaatatacttgggtatatatgtagttgtatatgtggatatattatatgtatacatgtttttatatgtatatttatatgtgtgtataagtatatcccttgatgatatatatagatatatgtggataattatgtgtccgcaggtatattcgtaggtttgtgacacccgcgggttgtgagtatgggtagcatattgcaccagttgtgcttttagagatactatggctttagcatagcatagcatggtttagaaaggtttgatctaaactatggtatcaatactttaaaaaataatgcatttttggtaattctgaggtattcgaaactttgttttacaaagttcaaccaaacacctcttgtctataataatacaatattttaaatatcatagtattatgttggaaactataaataaaccttgctaccaaataggtcctatgttttgaaatagaccacaacggacgcatcggcgaacgattaatctagtcgatcgactagtctgctaaccgattgggtcgggcgacaagagcggcattggagcgggcacaagtggtactgacctgcacgttgaggtcgtagctgttatagatcaagtctggttggtaacgacggtcaatagccgatgtgaatgtctttgattggtccgagttgttttatccgttcgaatgtgaaaaatctaaaaaaattaaacaattcaaaaaactaatccactctataaatataggaagtgattgattcgttcacacactttcacctttacttctcaaattctctcctttatttacacactttcatctctcttttgatttagttgcgattaaacctcaatattgatatgaatctgagatgaagtccgaactattaagcactcaaagagttgatcaacgagcaatctccgcaacgtaccaagacaacaactagtgcgggccaagtcttcttcaatggtctttctcttgtccaccgtcgtcgagagaaaaaatttcctcatccgtgtggcctaactcctcgacctctctttccttacttgtatgctcttcttccatatccatactcacccatgttgatgctccatcaactacaagcctccaatgatcgacactcttccttctaacaccgatgaagccccttccacctatgtttgtcctccataacttttcacttatatatataccaggtgagtgcccgtgcgttgcaacggaaacatataataccacaaaaaattatgtacaaatgtgtgttatattgactcggtttttgtttgtgttgttgtgctagcagaaatttgcatccaatgttattgagaagtgtcttacttttggttctcatgagcaacgataaattctgatcaatgaaatgcttggtagttggcacaactgatgagaacgaacaattacatgtttgttttcaacaatgattctcagctcacctttttcttttaaaatcagtagttggcacaaccactctatagcacaactcaaagcacagaagcagacgcctaagaaacacaacacccgccggtaccagcgcagtgtgttgccgaccggtgacacaatgacacaagacattatggtgtcggctaccacctccttggacatcttcaggaacgggtccatgttgtggtggtaccagccattttgcctcactcctatggatgttactctccagggcaggtgagttcatctttaactcacagcttgctgctcatcgtcggaccagtagccatcacgtcgcgcatggctaggccctcatactcctcatctgacttggtcgagtgttcgtccatagagccgacatcgatctgcaagtaccctcgtgcatgtgcagcatgtctcttttttcatcggaggtcttcatcagtttcagcatcacgaagatcgtcaacttaaaatatatatatagatatatgaaggcaccagagtccacctgccatgagaaccagacttgaagaggctaaatttaaagatgcacgagttaaaggcaagaagagtactgatatcattggtgaagtggttacactacctatgcttgccaaccaactttcctatcaagctagtgtgttgccttctgcagtatcacatacagttttcagcataagagttggttcaaatgacttgtttaaaacgtgcactgcaggccttttttgggcaaaatgtttccctcaaaataaatgcacaaatataaaagcagtgacaatccgggaggaaacacagcttattcactagccctgctttggcgacagagatctggtggggtaagtttgttgcccttgcttcaaacaggaagcatgccgagttgagcttctttcttggccctgagatcaatgttgcctgtctgtacaaactacagagtggttaaaaacatagttcctcactgaataaaccaaaattgttgatggaatggaagtccaaatgatcaaacatacaatagaaataggtaattctgaaagttggggaggagaaacccaaacaatttctccttatttcaagacataagatgatttgtaattttttaacacaaacgacattaagcttaatgttgtattggagaccatatctagaatttcatacaagtaatatatttatattatgaaagtgctgatcttgcaactgcttacacattgaatcaaatgaaagaatcagcaaatatatggagaantacatggattaatggcgttctctgcatgacagcaccatcaggcccaccatagaactgtagctttgcttctttccaagcagaaatgggctcttcgttgccaataacttgaatgtttctctgcaactgcatagcaaatgataattagtaagaacataaaatgcttccaagaagaaacaaagtaatttattccacccacctttctcaagattaaaacaaaatctgatgcagtgagcatgcctgttatggttccctgacggtcatcccaaaaaggaaccagagcaagaccctagag

SEQ ID NO: 23896 - DNA, 2102 bp, Zea mays
tttccccaactggggaaagggggatttttcaaaggcgataaattgggaacgccgggttttccagtcccgccgtttaaaacggcgcccaggaatgtaattccggcccctataggggccgattgggtaccgggccccccctcgagtttttttttttttttttttttgcgtgaaattgcatggcacagttattttctgacgccatcagcggcacagcacatgacaagatagtttaaagacctcaacaggttaaggtcagtatcataattccatgaccaggtaatgagcttcccctgctgctcatattgagctgcacaagtgcagcacaagatatggccgcatatttacattacaaaggtgcagctttgctaacagtaagttgtccactaatagtcaaatctgctcagtgcattacaaagccttgtttcactaatagtctgacaaaagtcgttgttcctgccagggatctgcacgaaccagaaaccatcaggaataagcatcgctgtctgagaaatatggcacaggcttcagactgaatgtttggcatagcctgtgatacagcctacagcttcagcacgagaccaaggggactgtgatcactggcagagatgtccggaagaatatatgaatcatgcactttttctgcgattgattcggacacaagaaagtaatccaggcgccaacctttgtttgtcttccgggcattatgtctgtacccccagtaactataggcaacaacattaggatgctgtttccgaaacgtatcaacgaaccctttggacaaaaaattggtcccaaatgattctctttcctcgtttgtgaagccagcacttctacgatttccagcagggtcatgtatatcaatctcctgatgcgcacaattaagatcaccggttagtatgacaggcttcgatttctccaattctttcatgtagttaccaagggatggatcccactctgtgaccctgtaagtcaatctttttagaccatcaccagagtttggtacataagcagttaacaggtagaagtcatcaaactctacagtcacaaccctcccttcagtatcatggtctgatataccaagcccatacttgatcgacagtggtttgactcttgaaattattgcagtgccagaatagccaagctttgacacactgcaagtccagaaactatttgtgtagccatcaagcaaagtgtccttaataacttcaatatccttctcctgcatttttgtttcttgtaagcaaagcacatcaaagtcctccctctgtgctaactgctgcacagagaagcctcttgatttgagcaatgctttcaatccattgacattccatgacataatcttcagagcccgtgtatccttgctaagaggtggaggcctcatagtcctagggttgtatggaatccagctggcttgtggtttcttatgcacgagtatagtccaaggctctgaatcatcatcaggacttaatccggcaactgtttccttctggacaacagtcttacttagcttgacattagtcaccgaaatttcctgacaagtggtgttcttgcttgatttttgttttgttctacttcttttcttgttaggtgtttcagaaataatctcagaactttctagtttttgttcaaccacaacagaagcaccaccttttcttttcaaaggtacttccaaggggctaaccagctcaacggatgactttccctcttcaccatttgcttccacggccatagaattcatcagtgctgatactaaatctttcttggtacctttcacagaaatacccctcctcctcgtgagctccctgagctccttgacagtcattgattggagctggctagggctgctgctcctccctcgctccatctccaaatcactttcagcagcatcttccttctctgtgagtggctgctcatctttcttgacctcactgttcttagaggcagctctacgtgaatatgtggcccgcattccgtccctcatggcgttgagattcactagtaccgttactcttgaactaaatttcacacttgagagcccactggtacactggcagaggcggaggagggaggcgccgcgcagcagcagcggcatcggtcgccgt

SEQ ID NO: 23897 - DNA, 1722 bp, Zea mays
ttttttttttttttttttcgacgacatgccaagtttataaaaacgacatcagcaacgagctgcagacttggggtagatcaaactgaaagccctacgcatacatagatagttgaagacttgagctaaattggattaattagctcgaccagaattcgaaacgaacgagatcgtcccttacacttcttcttctaccttggcctgtttgactggctgctcctgcttcccgctgctcccagtctcacgcgagagatccaccatctcctccatcttgggagtcaggtacgcgctagccttgctcgtcgcctccacgtccatccccgaggcgcgctgctgcgcgtgcgagctcatgccgaccagcagacacgcgcgccccgtcttctggtactccgcccggtcgccgacgcgggcgctgaggtcgcgcagctcctccttgatcgcctcgcacgtggggtcccccggcgccgactgttccacggccttgagccgggactcgaggatccgtgcggcgccggcgttctgcccgccgtcagcggctacccgagcggccgcgatgccctcggtcgccgcgaggcggacgcgctcccgctccacgtccacggacggagcgggcagcgtcgccagctccagcggcctctgcaccacggctgcgcgcgcggcgacgtggcgcgccaggcccgtcgcggcctctcggtaggtgcacctcgccttgacgaggcgggtgacctcctccgtcgaccggaccctcggcacgtacacgagcaccaggaaccgcctttcctctgcttcgtagagctcgccgacgtcgatggtggcagcgatgccgtcggcgcccaagtggctgacgtaggcgcccgacttgacctcctggatccagacgccccggtgcaggcacgtgacggcgacgcgcgcctcctgcacggccaccgagaggagcccgccgacgcagcgcgcgaacgagctctggatcgccgcctcgttgccgacgaaggagaaggtgccgcccgtggcctccgcgacagcgtgcatcgcggcggcgtcgtggttggtgccgaacccgaaagtgtggatcggcgcggacgagggcggcacaagggctgcgtagctcttggtgccgtcgggcccgacggtcggccagaagccggaggtgtcttgaccgtccgagagaagaatcatcccggcgacgacgttcttctcccggcgaccggctagcacctgagcgcccacacggaggccgcggccgatgttggtattcttcaggacaccaagcgacaacacggccatcttcgcgcaggccttccccgagtccgacatgcgactgaggcgggtcaggcggctggcgtcgtcggcgaaggtgacgacggataggcggtcagttggaccgagctggtcgatcacgaagcacatggcctgcttcaggagctccagcttctgccccttcatgctggagctgacgtcgagcacggtgacgaggtcgagcggcgcgcgcgccacgtcggacggcgccttggcgtgcacgagcaccgcgaatctgtcccgggacgcgctcctcgcgatggccgggaactcgcactgcgtgctcagggccagcccgccgttggctgtgggggccttcgccggtacggtcgaacgctgcagcggctcgtcgtcttggtactcgccagccggcggtggcgccgacatcgctgaggattgtttggtggaagtggaaaccgcaaagaatag

SEQ ID NO: 23898 - DNA, 3828 bp, Zea mays
  misc_feature (1834)..(1834): n is a, c, g, or t
gttcggttagatatgcggtccgtccggctgtgtgcgtggactgtccggctactatgcgcgaacggtctgaattgtttatttagggtttgcttagaacgtggtggctcgggcgcgggtctcggtaattcagttctaaaaacgggaccgacaaccgttggcccggacggtccgcgatcacgcgtgaatggtccggttgtgcgtagatcggtgggtttacctccgatttgcgtaggatgatgtggttgtctagggtatgtgtctattggcatcccgtaaagggattgtgattggccatgccaatctgtagcctatgtttctcttgtgttttcccagatcaacctcgtgcgcactagcctcttttgcataccccctatgatttgttgcatttgatctaactgctcatctatatgtaagctctaagagattggatttcgtttgtctcgcttaccttggggtagtcatagcaggtcggacagaaagcgagatcagtcgcccgctaccggacgaccttgtgattccagcccactttgaagatggctaggaatttttcctgtgcttccttgatcagctagtccttgtgctcctcaaactcctgatgatattcaactggtagagtttcccaggtcggctcaatgatgttgctgggagagacgtcagagctatctttgaatgggccattgaggactgatctgatagatctttatgcgagttccccagcggagtcgccaaaaagtgtgttggcactgatctgggcaccaattattgcgatgactaccggcggcggtgctctctattgaagcgcgaacggtccgcagccgagggccggacgatccatgacatggcgcagaggctagggtttctacttgacgagtcgaaccgtccacgtctggttgccggacggtccgcgcgtgcgcagttcgccaacatatttaagggtttgtcttaggtcggcaggccacccaaaacgcctctaagcgacatagagtcgaagagaggtaaatattagagagaggaaactatgttactgtctactcctagtgcaaaatgtaaagaacaaaagataatttgattgtttaattgattgttggttgtttaattgatcataccccttcaactatataacgaggagtctagacttattcctagacgtcctccaacagcttctgcgagattagagagatagacacgcgagaagatatgtacatatagccaaacgtcagcgggctggaccatccggtgccacctacaaatagtgatcaatagttcggaaccaatattccctccgcgctctattataaagaaaattactcgaccatcgtcacaagcaaataaagcaagtgccactctaaggcagcagcttataaaatgtttaaattgtcgaacggatccgatgaaagaatagtcatttttattttatttgagttgaattgaattagctaaagagcaacttcgacgagttgtttgttcttgtcatggtttcatgacgacggacgagactcgagaggcgccggagccgacggcgcgctgtcgcacctccagtatatatatatatatatatatatgcagccacgcaggcacaaccaagcatgcagaatgccggcggcactaagcgaggccagcgatggtgaggctgccaccggcggtggcgcgcttgacgaagcggcccttcatccgtggccgcttctcggcgttgagcttgcgcacctcgtaccggatcttcttggagaagagccgcgtcctgcgcttctcccggtaccgcgacactcgggcctcccggccgacgtcgtccatgccctgccccagcctcggcgtgcccagcaagtcctcaccgccngtggccgaccattcctcgtcccacaacccacatgttctgtatttagaacaagaattgaattcgacgttaacacaatcactccgatcgagcgaagccgtgcatgcactcaaaaagtcagggatctcgatgatgtggcggggcccgggaattgaacgtaccgtgcagtcgtggggccagctgtcgtcgagcttgacatgtggtcgttcggcgccgccggtccacggcgagctcccccagctctggatgatggcctcgtagttgagggtgagcgagaggctcgtctgcaagaactggccgtcggttcccgtgtggctgctgctcgcggcattctcggtcgtcgtcgtgtcctgaggcgagccgtagttgaagtcgatgtccagcatctcgtcagatgcatctgggtccagcagctcgagggcgcacgccagcgtgccactggcttcgcaggcactgccggcgtcagtctccaccttgactcgcgacgcgtcttcacccacttccaccggttccaggaggcccagcgtctccatgcagaacgacgagctctcctcgttgccgtcgtccaggccgtacccgagcaaggcctccatgtccgcggcgaactccctgagctcggcgtcggtcggcccgaagttggcatgacctccgtcggggaaaaactgcaccagcggcgccgctgcaggtgtctctcgatctgtcttcgccgggtcctcgacggcgccgtcttcgttgcaggacgacgcgagagcggccgcgtcctcaagaggctggggcgagcagaactctgccagggcagggtcaaagacaggcacgcggtaaagcacctcctcctccggctcctcggcctcgaactccccctcgtcgttccgaccatctggcgagtccccgcccgccgcatggggcacaacgaggcgccgcgacaacgtccgcacatcgcttttggcgcgcccaccgcgcggggtgcgcgccttgcgcttgaaccacgccggcaccacctcgtcgtggctctcgcgcttcgctgacgccggcgtgggaggcggcggcgtctgcagcggagacgtggggcgcagacgcagcctctcgtgccgccgcgcgagcgagttcgcggagtgcaccgacgtgtcgcaggcttggcacaggaacgcgtcgtccgctgcgcagtaccacctggcccgccggcgcaggcacgcgtcacaggcgcgcgcctccttgccacccaccgccgccgccttcgccgagctgccggtcgtggtcgtggcaatcatttcccttcaaagcggtgtgccggcgtgctactcagtgatggcttcttctacgctgaatgtagtaggatgggacctatagtatccacatgtgccgacgtacactctgagtttttgtatgtactgtagatgttagggaaaaaatgtgctgaaaatatcgcggtgctcggttttatagaaccgaaggagaagatgggcccatcttgcgcgctttctgggccccgccggctgcactttgcttgcacttttggtgtcgcgcaagggcaccactacctgcgggtcttatctgcaacgtgattggtcgaagggtagcgcaggatgcggggcaggcgcttgtgattggctccgacgggatttccagtggggccaccaccttcagctacgcacggcctacaggctagagccctttccacatcgctctcacggttgctggcagtggcaggggaccgctagggcaaggcgagaaaagtctttcttggtcttcgtagctcaagttatcactaggttattactatatgctagctctggctaaggctaccatgcattatgcggaagggaggtgtcgaccgtaaccatgacaacgtgaaagaaaacgttgacggtggataaggaataggatgatgtattactggaattcggctctttgccagatgccacattcggtaaagttccactctcgataacgactacgtttaccgagagcaggactctcggcacaggaagacactcagc

SEQ ID NO: 23899 - DNA, 1524 bp, Zea mays
atactaataccatactccatgtaataatattattaataacggcaaaaaaaacaagtatttgtttcgtgggctttaatagaacagcacagagtctgttatatatatagcctgatctacacacagccgcatgttgtatacatacacacacggcaaaaaacacacacacatgccccacccgttcatccttgtgatgggacaaaaaaattttgtaagatgcggcataaaacacgcatgttataagttccatactagtactacaatgggcaaaactggaggggcagagaataaagaaaaaggcgcataaacttgcaacatgtgggtcgagcaaaccaagctatcctaaagctgcttattaagatatatgtacatacgcatcgccttgctcctgagtgtgacgactccaaacgaccttcttgccttcaggccagccagctgcttctctcacttgctcgttatcatgaacgggagatgaacgcgggaagagcccgactcttgatccatgcttgaggcatccgaagagagcaacctcctatgctcctcaaagtttggactagttaggttgattgacagatttttcatcagcaacagtaccgtttcagcatcaatgggatccatttccttcaacttctgcaaatgcccatttgtctctggatcaaatatgcttcccaggaagttgtatacacgagcaaagtctggcatggcttgtgtatgcctcggactgaaatgttgaacaggaaaagcattatttacactagagtctgtagcaacagtagctacatccataggtgtaccacagccttgctccattatgtgcgaaacttgttgtggtaagacaacttgaagggccttttttgaggacttgtgtggatatggatgggcagcctttcgctttggcctaggtgggggcaaatgctcacctgttccattcttttgaaccttcaaaaagtacttctgtgcgtgactcctaatctgtattactgtcttggagccaacatatgcttcaatctttttccagtcacggtcaaagagctgcagtgcctcgaggaacttgtcgtgctcggggtcggtccagctctcgcgcgacttggtgatggtgtagggcttgcgcactctccgggggccctcgtcgtcgtcgtcgatcccaaccggcggcaagggcgtggcggcggcggcacaagactccaccgcctcctcctcctccttgccgccccccacgacggccgggacggacggatccagagggtgcggcgtcgagctcatcgacaccatcggctgccgctgcgctgctcctccctcccccctccttcctcgtagacctagagttggcgtggtcgtccgctgctggtgtttggcgcttctgctggcgtgagacgtgaggcaggagaggacaaaggaaggagcagtagtgacgtgacgggtggtgtggtggctgcgtgctgcgtgctggtgctggcggggaagagcaagacagcagctggagacgatgactaaacttcgcccggccggcctcgaggggtcccattg

SEQ ID NO: 23900 - DNA, 891 bp, Zea mays
  misc_feature (819)..(819): n is a, c, g, or t
aaatattcttgcccgttctcctattggggctttgggtcccccgggccgggccgttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgccatacttttgtatgatgactctttaatcgcataatatgctcttattgcatcttgaaaaaaaaaaaaaaaaacaaaccagcccatctccggctccatggtcacgcgatgttgtatttccagagctttggatgtgcggntttgcttcatgatgctcctccggaactgggagggacattgtaccaatcgttctgcgtcatcgtgctattcga

SEQ ID NO: 23901 - DNA, 691 bp, Zea mays
tgggtaccgcgacgccggccgggcccgggcctgcgctcgtggttgcgccatccctcactctcctccgaagccatcgtccccgtcccagcctccccggactccaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgccagaaaaaaaaaaaaaaaaaggcccccggggccc

SEQ ID NO: 23902 - DNA, 2960 bp, Zea mays
aatccatataaaaattacactgaaacatataataccatatattcactatacctctacactttgagaaatgaggaacaagatatatggttttgtagtcaaggaagaaaaaaaccaacattcgttaattgagaaggtgtttttttcagaaaaaataacaaaactaacgggccaggctccccgtcattttagaagcccatattggctcattcattactcgagtacacgtattcggcctactaaagcaagatggaccacttctaaaaaaagtcatattagccacaaaagtgtttggcccatttaatgtaaccctagcccaccatatccgcaacactgcactggatacaccagaaacctcgatgcagcaccattcgatcccagccgttcacttgcgtacctgacgggtacttaagcactgctaccgccgccgtctaggtttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtgagcttattatcctcctcccccctccaaggccgccgcgtagtgactctgcgtgctggtggtgtgcgtggctgactggctgatgcaggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatggtgagctggaccgatctcccagtttccgttcgtggctacgtcttgctctgaattctgtgctctgtgctgattttgttgctgccccctttggtgcagggccgtaaggtcagggtgttcatgtaccccagcagcatctaaaggttagtgtcaattgcagtctactcaactactctttctaatcggacgccctgattatttgctgaatacttcatatctgtacctcatcctatacggctatagccattagagttgatgtgacctgtacgcaaatgtgtctatttggcagttggtcttgatttatgttatgaaacttgcctaattaaggattagcggctggctatttcgctgtactctctgttgtgtgcaccaccaaataatcatgcatgtcaacattgatattctacatgaacctttcattgtgtcttgatagtatcattttgttgccacgttaggggaaaaaagagacatcacagctatttctccacgcatgaataggactagcagaaattatccacatgacactgtgaaagtcatttgcaacattggtgtcctaagaaaatggatagaacaatagctgtcttaattggttgattgtatgcattttcatttttatatttctggaattatagtcacttgtttattcgatctctaccaggctcccacacttcccagcgaagtgcatcttacatttcatttcctgttttatgtgggattctgttgcttagcatagcagagtgccgaaattatcgtgccttaaatcccatgaatttaggaatagttgcttttgcaactatctgttcttggtatcatcaaatgggttttctgagatgagatgcttgctgtaattctcctcacagttttgttatgtgcttctaatactgtctcatccattgcagataatctgaatgtgtggaggacccttttcttctagattttatcttcagctgtccttgtaagggttgtgttcaggttgagagttagcaggttgagctgtctatctgagaaccatttaaagttctctgagttttggtgttatggatcactggaagtattatatgaagtttaagttagaactaatttgtttgccatacttttgtatgatgactctttaatcgcataatatgctcttattgcatcttgatcaacggttctgtgatttcatgagcccatctccggctccatggtcacgcgatgttgtatttcaagagctttggatgtgcggttttgcttcatgatgctcctccggaactggaggaacaattgtaccaatcgttctgcgtcatcgtgctattcgattggcctccgtctctgtcgattttgttatatttgtaacaggtaaaattctaagcatcagctgtggctgcgaggtagttttagtatgatgtttgtaatagggcttgtttagcgtccagacgtcggaggcactattttgattctccgaaatatttttaacgtataatatgacgtcgggggcactattttggcaacatatatacgttggttgtacgaaaacggttatcttctaaatacttcaaaagcttatgcgatatgtaccaaatattcagatcatgttaaaaaaatcagatcgtcgtcaaatgcagtgtcgtttactgcatcagatcgatactgcatctgcaggctcgcttgctctcttttttttggtagatcgtctgatggccattcttttgtgcgattttgtaataaaaaatataggacactttgcatttgcaagacagaaacgtgggccgcaagactgtctttatcagcttatgtatctcactatttgcaaccgggaacacttgtgaacgcataagttattgtttagtgatgcttatctaagaattgtacgagataaattgaaccagagaaatgtaccagagaagctctatacgatccttgatgcatttttggtccaatgaaacgtcaacaacaaaaagagatagcatgagcatcaacagaacaaattctcctcagtacccttgtccataaagacacaccataatttcagagacaagcacatggctctctggcatagcacattta

SEQ ID NO: 23903 - DNA, 1265 bp, Zea mays
ttttttttttttttttgccagcggccattcagtttctgttttgatatcataaataaatatagcaaactccatggaatttctgacaaaaccactggtttcaaactctgcatttttttacctacaactacgattctattagtactcgtctagtacgtttaggcccatcagtattcagcacgtggtcccaagtcccaatcccaacaagcttctgtccttgaatttcatggatgctactaggtttccatcccaattttcgcaggccaaagcacaacagaaatttacagtggaatcagttcttcagctccagctgtacacgatccatatgccataccataaacaatgtgccgcacagtatgggagcaaccgcaggaatccagcataaatggtcaggcctccagctatacaaaaaaagcttcatctcgagagcgctttacgatgattcagtgattcacacaacaatttcgaagctactatacagcagctcactgttcgatcttcatggagccagagttgttggtgccgctatcagctgccacaccagggttgaagttcatctgaggcatgctctgaagtccttcccacatggaaggtatctggttcattgttgacacgtcatgaatagttccgtgcaaaacatcggcaggattagaaatgttgcacatcattgctggctgcacgattccttggttgaatggagcagtaaggctgcttgatcctggatcgactccatagaaagcaagatgtctgtcttgtgaaagcatcatttgtttggatatgatctgctcaatgtcaaagccaagttcagggttaacagttgaaagtttcattgacaagaactccacttgtcgttgcaatgactgtacatagttgataatctcatcgagcatgactgccttgccagtgatcttactgcatccaggaacaagatcttgaagaagcttcattctctcacttatcttttttctcctcagtctttctgcgaggctgtggctgttagtggcttgacctcgctttgcccggatatgaacatagtcctctttagtaccatcaccatcagaagaatcttccttgctttgtattttgggcgaaatctttctgttcccctcctccattgaattcctttctggctgagatgaaccttctgtttgttgatcacctgcattctatagccagcaattacaagacagccagtcaataccataagaaaccatcaacatataattctagacatgtagattagatgaggaagtgagctcttttcgatt

SEQ ID NO: 23904 - DNA, 1976 bp, Zea mays
  misc_feature (6)..(9): n is a, c, g, or t
  misc_feature (1688)..(1688): n is a, c, g, or t
tttttnnnntttttttttttttttttcgattttggacaataatttcactagtgtagttgtagcagatatctggcaataatattccactacacctaatttcgaaagattagagcagatgttgtgcgtctttttgccaaaccattataataaaaatagagacatgagaaacgtaatagatatagagatatagagaatagagatttgtatcacgtaaatattctactacagctaatttccaaagaaacagatcgatttatatccttgctcgcttctcgtcgtcgccacaatgtcgccagagcctcccttgtcttctctgtcgccaccatagaggaacttgttgctgactttttcacgccaccctcagcaagaagtagcatgatgaaaggaaggtggagaaactcctactgcgtgcttctgttagccatgctgagatgacagtaagagagacgatggacttctctttcaagatgcttggaaccaataatgaatttggtaagtcatactcttgactatagtgtgctattcatttagaagaccattggagtgtgctgcaatttataacaaggcaaactcaagaatactcaagaatgaagtatctacaaaatactcaagctaaaccaaaatttccatggcatctatactgacacaaatttcgtgtttgaatggaatgacaaactcagagacgataggagaagcaataagaagaaaaaagggtgtcatcaataaagtgggtcaagatcttgatttagtcattaatgtaaccactataacttgtaggaaaaaaatacaaaacaggacggctaattaacacaacaatgccattcgaattgaacatggaagaaacatttaggacccaactcacagctagtctctagaaggatatgccgaattgagagtgtgaaagcatgtcctattcaaaggagaggagtgcgccataacgtaacacgacctttttcatctagtaaccagtaagcatgcacagggaagaaagctatacaatctactatgatatgatgatatgacccagctctgattattagttgctggcggttggcacaacatagaatgattaaaactaaatttgttcatgaaaactggactaactgttagaagttgatagcagactttggggaggagaattgtaggacttcctaaaatcacaatgcatgtgtaggtctatctatatttgtccaagtcaaacatttttaagtttgaccatgaatatctaaaatttatatagaacgataaaaatagcattggcattgctaaattcattactaaaaccaaataactctgcttatttaagacaattattttttatagatatttctaatcaaaattaaaagatatgtttgacttaggacaaacctagatggctagatggagttacatgtgattagagaaactatggtgtcatataatgttaattgttaagtatcggaacattttgattaggatgttctaggtaatggtctcgtgctatttggttattggattcatcacctccaccgaaaaaagcacaatatcagaagaatataactttccacataaaagcatttaagtattcatattgcgattgaacttgattatacttcattgtatgcattattggcgtgattggttgtcgcgctgcttatatctaggctgagtagatgcgttgacttggaatgtgcatttgtttggttggntgtacagcataaaacaagctcgtatgtgcgcatgcaacacaggtgttttttccacctcacacctgcatgcgtggggaaggcgggaaggaccatcactgctgatccaggctgacgcgcgcttggcgctgttggtccttccaaccaatcacgctgtatgtgacttgagctagaagccataattttcttttctatctagagtccagaaatgaacaattatcgtagtctagactgcaatcttggaagccacaagatttaggggtaagttcagtgtgaactgtgactgtagat

SEQ ID NO: 23905 - DNA, 1345 bp, Zea mays
aagtgccagctcccattcagttttactgttttgataacataaatatggcaatctcctactatttctactaaaattatgatcacacgtttgaaatagcgaggattaacaataatgagtttccttccattgcatgatgaaaccttacattgcatgttccatggaatttccgacaaagaggcttcaaactctgcatttttgtacctactattccattctagtatgttggcccatcagcattcagcacctggtccctagttccaacaagcttctgccattggatttcatggatggtaataggtttccatcccaatttccacaggccaaaacacagcagaaatttacagtggcatcagttttccagctccagctgtacatgatcctcatttgccgtaccataaacaatgtgtcgcacagtatggaagcaacagaaggaaaccggcatgaatggttaggcctccagctatacaaaaaagactccaccccgtgagcgcttttcgacgattcatgattcacagaacaattccggagctatacagaagctcactgctcgatcttcatggagccagagttgttggtgccgctatcggctgccacgccagggttgaagttcatctgaggcatattctgaagtccttcccacatagaaggtatatgcttcagtggttccccgtcgtgaatagctccgtgcaaaacatcaacgggattggcaatggtgcacatcaattctggctgcatgattccttggttaaatgggccagtaaggccgcttgatcctggttcgactccatagaaagcaagatgtctgtcttgtgaaagcagcatttgtttggatatgatctgctcaatgtcaaagccaagctcggggttaacagttgcgagtttcattgacaagaactcgacttgtcgttgcaatgactgcacatagttgataatctcatcgagcatgactgccttgccagtgatcttactgcatccaggaacaagatcttgaagaagcttcatcctctcacttatcttctttctcctcagtctttctgcaaggctgtggctgttagtggcttggcctcgctttgcccggatatgaacatagtcctctttagtaccatcaccatcagaagaatcttccttgctttgcattttgggcgaaatctttcggttcccctcctccactgaattcctttctggctgaggcgaaccttttgtttgttgatcacctgcatcgtgcaacaatgtgacacagtcctccactcctttcctcttcttcacaactccgctatgctcttcactcatctggatgtcctgactcagtgtaccagatgaagatggatacaaccccagtttatcc

SEQ ID NO: 23906 - DNA, 2588 bp, Zea mays
ggctgagtttgatacggatgaaaccctcgtcaagattaccaatgctccatgagtaataaaattaacgaaacttatgaaataaaactttaaattaagaatgagtcatagaattatcatctgacgctagtcgcgtccgagacaggtgggaatatcgcaagagagaaacacaatttcaacctaagtgtatgtgcatgaatccatagtagagttggtttatgttaaattctaggtctaaatttactttttttcattaatagagctctaccaaacacaacctcagttttttttgtttcagttttaaaaagcagcttcacctttaaagataaagttgcttttacaaatgtttagcaaaatagtttctcaagatagtataaactaaaattgtttttttacaaatagttagtaaaatagactcctagtagtctagatagcagacagaaagctgaaataaaccagtatttttggcttcacctattagataaagtgaatatgaagagaagctaaaaacagcttacaaaatagtttcaaacaagctgttttccgaagctgtttgacaggagaagctgaaagtttgacaagaggctgaaaacagctttataaagcaagtttcttttcaatgtccgcacagaaaaaaatagcattggaattatagatgtttttttttgttggttttttcttgaacattaaaataacatattacgataaattccgcaacaataaagcaaagagagtatatcgacactggcgtctgaaagcagcctagaacaccaaagttcacacgtcctaacaataacaatcttgagttctcaacagatgaatagactagcaaacaaaaccataacgataaccctccttccctaagtctgaggcaagctcttgctccggattagtatccatagctcgacgagtatggtgcagcaccataacttccaccgttgtgaggcgctggagctggagcacctggaggagacccataggatgctccaccgtaaggtgggtacgagccgtaacccgtgtccactggttgaccgtgtggacctggggctggtggtccctggggagaagcttcagccatgaaattcttgattagctgttgagcagtctgtacttgtgaagcacttcctgtaatctccactgtcatctcgccaggagcgccttcttgaatacttatagttgctccactatgcctgcggatgtagctgatactggcaccagctgcccctatcacagcatcagcataggaaagaggaacttgcatgctgtgtgtcacctgagatgacccatgtgcttggttttgattccctgggggagcacttggaggtgcatctcgtccatatgaagaaattccatagtgtggctgcttttctacagggggcacatcgggaggaggataatagttctcttgtggccgtggaggcatgtagtgtgggttcccaacataacctgggccaccaggaggaaggtttggtggtggatgaccccagggtgacggaggaggggggccccatgcctgtggaggaggcataggttgctctctgtgcatattgtgtgctttaatctgtgtttcaaacaaagggaggacactgcggtcaacaagaaattttcttaaatgacttgcaatcagttctacggctttgtgagaatcatgaggttcaccctgtatctctacaactctgtcatcgtttaatgcaacaggtggaacattctcaacaatccggagaacgcactttgaagcatcctgtattgacttaatagttgctccttgcttcccaattaggctgccagcttgggaagctggaaccagtagccttgtcggcccagtgttgacagtagctcgttgaggctgatcagtttcagtttctaaaccatctgttatccttctatgaactctaagcaacccatcaacagctggaggtagctctgtgtctggttcatcctttgctgaaatcattacagctctttctggcacagctggtggtccctcaagaaccttgatgcgggctcttgattcctcacacattttcttgatgaaatcccctttgcgcccaatgacggcacccacctttgtggtaggaaccagtatacggaacacactctctccaggccacccaggccatttcttgtcatcaggaactgtagcatcatgctgcttcaccccagcttcctcgccgtgctctgtgggggtagcttggtccactttgttctggcctcccacatcttcattgttcatgctcacatgcccttggttacccaactcgtcttgcattgggtctttgggttcctcgtaaagcttttctggttcttccttggactgatcttgcacattagcataagtagtggcttcttcctcattgccaagggtactaggacttccagtgaggttctccacagggtcatcaacaggtacatccatattttcttgttactaggggggagactcgccggagaagacacccggtcgccagcgccgccgccgccgccggaggtggggagggttttcagacgggggagcacgggatttgtgcggacgcgagcgagaggagagcccggccggccccggggtgctccctgcctcgaggtacccaatg

SEQ ID NO: 23907 - DNA, 2884 bp, Zea mays
tgacagccaccaacattctacagatcccatgcttgcggaaaaaaggcatgtccacttcaaccgtgaccccaagtgtcgaacccactccccaaatgtgttggtaagtgcaaagctgagccggcagtccatcaaactgcacccacacatccgtcagccttgccttgacccgtccttcagccatgctagtgctagctatgaattccagcactgccttctgtgatttagcacgaaccggcccccactccaccatacgctgcagttccgaccctcctataacaaatagttgggtggttggatgtataaatattgtgctaactcgttcattctagcactattgcctatttattcatctaaataaacattctgaagtgaaataacgagtatttgcctactaaggtgattgagattgataatcctaagactagtgacattattagtgcattgagagtagcaagtgtgcatccaatgtttttattaggctcgatcaggtcaagtaggagtttatgtttgttatttttggtgaccgacatcaggagtttggtgatgatctagtggaaataaaattataggtggcctaactcaatatgtaagtgattggagtgacaaagaatcaactcgtaaaaagcacttaatgcttgtacgaatcagatatgaggcacatccttcgccagtgctccaataaaactagtgaagagtatcgatcctattcttacattactaattatcagaacatgaatgcaatttaagatgcaaaacttttatgacaaaatagataatatttagtcacagggggcaaagtggactatcttatataatttaattgttatgataaatttaagattagactaattcagtcatgtcttggacatctaatatgtttacggaaatttcgggtgccccttcctgaactcagccatagttagcacaattctattgcattttagagtgcaaattgcacgagtcgttcggctagctatccatagaatcgccacagaatagccaggtgcccctgctgcattttgaagccagtacatgaagaacgcaaacgcgagttaacaaagcaggacagaagtaaaaggagcattgatcaatctgaaacattaagtttaaagtctgaaacacgatgtttaaagttttaagtccgaaacacgaaatttaaagtctgcgacacgaagtttgaagtctcaacaaatgcgtctcgagacgacgcagaaacactttcagtcaactctctgcagtgcgacatttccacaaacacgtagcgtgcgctgccatggaccgtgaggcagcgacaacggaagaggtcactacctcaccgctagacatgcgaccacaggaccgtagaaccaaaccgcggagaagaagattcctcgagagagcacgctactggtcctcggcggcggcggcaggcgcagggtgggcggtgaagatgcggcggaggtgggacgcgagagcgccggacgagtcggcgcccgcctccgtgcggagcgcgtcctggaggtcccgcatgcggtgggagaggccgtcgcgctggcggcggaggtcggcgttgtcggcggcgaggtcgtggaggaggtgcttctggcccaaggtccgcaggctcaccaagaggacgcccgtcatgaggaacagctgcacgaacgcatgcttgttcttggccgcgttctgcagcagccccggcgggttccggcccccgaagccgttgcgggtgacgtccgccatctttgcctgcgaggttggactggactcagtggactcagtccggggggggcgggggggggccggccggctgggtttggggacgcgctactcttcttcccgttcgaccagaaggcgtcaagtaacgcggcgagcggcgactagccgactacagtaccagcacggcccacatgtaagtgcagcatctttcgagttcgaggtagagcaagccacgcgcgattctgggttttattctttcgtctggcccattgtctatggcccaaacacaagcccactcgcctcagttcccacaccgctgctccccatacagcgcacatagaagcagtccggcggcgcgggaaaattgctttggtctcccgcgtctccccgcgcgcacacaaccgctgctcgatctctccccgcccgcagcgacggcgcaggtcattagcggtcgcagtgagaagctcggtgacgcacgccgtcacggaaagcggcgcggcaggtacactcggctcacgaaaaccgctgctggatctctccccaacacatggatgtcgttcccgatatgactcagactcaaatactcaatgccaccgcgcatccgtctctgcgcatccgtgtctgtactgtccttctttatctcgaatccaattttcccaatcaaccttcatggcttcaatacgaggttgcgttcttcacccatttttccatgctcgcgagatttcagagacggggtgagcttgcgtgtatgagtcgccgctcagtcagaacatggcttccaccacgagatggctcaagtaacctaagtcttcagcgtgttccgcgccataaaagcagcggagtaacagaaggtgttcactatttttttcagttttcgtctaggttgataactaatgtctgatggtgttttgtgcaagaatcagggggggggggggggggggtgcacaagcaaatccagtgattggttcttcaaaaggactatatttcgaaactagaaaaagcattgaaacttattcctatatgcactgttgatacaggattgcctctttgacgtcttgagagatgaggggggagtgcaggagaaccgccgaagcggaggtccgctcctatcggccaggtgacttagggggtgtttggtttctagggactaatgtttagtaccttcattttattcctttttaatata

SEQ ID NO: 23908 - DNA, 2334 bp, Zea mays
gagaggaaagccggaaccttttctccattatctaaaaagaacagagatgcatacacaaacataatcaatccttacattgcacggcaaatatacaacaatgaaagaaacaagaaaaatcgatgctacatcttgttaaatatgcaagatagtgatggtagtagttaactagttatagcgagaggagcactaatctaaatacgcagtatacagaagaatcagacacccacaggcattacggtttccatggggctggtggcggcggaggcgaagggaacatgggtggcactgcagagaacatggtgttcttgtccaccccatggccttcacccgacaaagctaccaacgctgcgactagaccagcattgcccgccagcgttgcttcagtgtagttataattcttgcggacatctttgaacccgtcatggcgatcggggccagcaaccatggcccctactatgatattggggtttggcttcttggtgtccctccacttccaccctcctttgcatccatagtgaacaccgttcttagggatcgaggcgccccggtggtgaacatgcttggggtaatggtttccgaacccaaccacatagctcatcttcaatggatttttccctaagatgtactcgatctgagtccttgcaaaactgcggagaacctcgatagagtagaaatgtgggccacaataccacccaggagtatccgcagcctcaagatagtcactgaacacagaagcaaggaatgcagcgttgaccacatactgaaggggctgtggcttcccatgatttaactgaatcaaaccacctcttgttctgttgaaagatctaaatattggaaggtaggaacacatgataatgctagtttggttgtggaatgtactcaaggtctcttcatatggatatccaggactcaagaaaagcctcaaccggcttagaagaacctgtgccccagtgagcttattatcccagctgaacacaccataatctggtccaccccagaaagcgccagcatgctttgcaagtttagggtgtgtggctagagtcaagtatgacgaattgccagttgcaaggtacatccatgaactaccccacacaaactcatcccagtaactggttgaattgtagaactttgcagcatctgagccacctgcactgtacctcccacgtcgttcccttgcaaactggaaaagagtggttgcaccatgtacaagcttctgtgagtaagccttattgtccttgaatacaatcgacgctgcagctaatgccgcagccatttctgcagcaagatctgaacaagcatggcactcaaccactggacgtgggtagtcaatgtcctctggcctcatccaacaataacgatcattgggctgccttgagccaggcgatgttgcagtacttcccacctgcgcaatgacacgatcaatgctatcggctgtggaattaaaggtcttcaagaagtaatctgaaccccacttgataatgtcacggacatggccaagttccccagcagcatcgtacttagcactgtactcaatgacgctccagctgaggagggtcatggagaaggcagctgggaaattgaatttgacagcgtcgccagcatcatagtacccgccgaccaggcttcgccgaactgcaggatcagaaagtccgtccttcatgcaagagttaccacgccatggtatattgttgtgcttcggaagcttcccggatctctgggcattgaagaacatgagcgccttgtgcagcgcgacggtgtagtcgtcgggcggcggcggcgggcggtggcgcctggggatggccttggcgatcccggccacgacccccgcgaatacggcggcggcgaggagcaccccgagcgtccagacgaagagcttgtggctgacgacgaggcagccgatgtcgacgtacttcttcttcttgcggccctggtccccgggccccgccagcagccagctctgctgcgtctcgtcgagcgtccgcgacagcgcgccccggtcgatgtccaggttccggctgcggtcgtcgtccgtggccgagtcgtggcatatctccagcggcccgccccaggggtccctcccgtacatgctcatctcgccgctccccgcctaactaagaccctgtcaacaaggtacagcctccccttcctcctcctaaatgccaccgcgccgatcgatgcctcctcgtgagacggcgggcgcagcgcgatcttcctgcggcgctggtgagggggataggcgagctggagcagctggagctggggcctggggaagtgggatttgctgggactaggagagagggcggcccgaatggtggcggtgggagggaaggtggc

SEQ ID NO: 23909 - DNA, 1237 bp, Zea mays
ggccgcttggccgctttttttttgcgccaaaaaaacttagaatggtttattggttacattcgttgagagggaattttcttgtaaaataaggacgaaaacatcatcgatcatgacaaagcacacgcgactctgacaacaatgactaatagctgtcacttggcagcctgtctcgcggaagtctcttgctggaccacgccgtctctgtcctgcagcactagtgcaccacgacatctctgattctcagaggccaatcttgccacgctgcttcagtttttttttccttattttgtttgtgttgggttgagctctgctcttgtaagcgacgctgcaccaatcattgcctatctgcccgagcaccgccgaatattgtattttcgttccatctacttgcctacttggtggacatttccaccaccttctccttggctgcggtgtcgtctgcttcagccatgtccgtgtctggcatgccgaacagcttgcccatctcctccagcgtacgaccacgggtctccggaaggcacgtgaagaaaaaaacccacccgaccgcggcgatgccggagtagagaaagaagctgccgccgatggtaatagccttggagagggacaggaaggtcatggagataacggcgctggtaacgcggttgcacgccacgccgaccgcaaagcccagcgcgcgcagctgcagtgggaatatctccgagttgtacactcccgtgatgggcccgaggccgatagagaagaaggcgacgaaggccagggtggacgcgatgcacagagcgacgaccgacgggatcttggcgtccgggtgatgccccacgacggtgagcgccgtcccgaggctgatgagcgagatgaccattccacccgtgctggtcagtagcagaggccgacgccccacgcggtccaacaggaacgtggccaccaggatgaagagcgtcttggtgacgcccacggcgcaggtgacgcccaggagcttgttgtcgccggtgattcccgcccccccggccgcccgccgcctgcgcccgacgacggaatcgcagccagaagcctgctggaagaagtgcaggccgacggccgatagcagtatgcgtcggatcgccggggtcggggacaagatgaggtccttccacacctgcatctcaccgctgtttcgctccttgggtacggtgaccacgtctccgtcgaggtccttcggaatccccgcggcaaccttgatgtcagccagccgctctgcggc

SEQ ID NO: 23910 - DNA, 1643 bp, Zea mays
gatttccaatcgcacggtccgcgttcgtccgccggccgccggccgggtatgctactgcgaccaagtcgagggctttcgtgccttcagcccttcagtcttcaccagtcgcgcgccgccatgtcggagaccgaatcggcggcagcggcgccggtggctgcggctgaatcgaagcctcggcgactgcgggggcacaagaagggcgccgtcacctgctgcgtcgcctcctccgcccgccccggcgtcgtcgcgtcctccggcgaggatggatgtctttgctggtttgatctgcgcaccaaagatgtacttttgaccatggaggcagcaaataaaccaatttcttcaatttgctttaaaccaggaaatgaagattttgtgtatatctctgctggaaatgaaatattgtcctttgatgttcgtatgggaactcaaacaaagccattagagacatataactacaatagagatgaaatcaatcagattgctgtcagctctaaaggttttctcgctgctgcagatgatagtggggatgttaagattgtcaataccattcagaaatgcctgtataaaagattaagggaagcccacacaagtatttgcagcagcgtgcaattcattccttggagaccttggacagcaattactgggggccttgactcaaagctggctgcatgggatttctccaaaggacgaacactgttttctattgattatggatcacctgaattgcaaaacggcagttcttccggtagtgcagggcaatgtttcaaccctgcttttgttcattccgtagcagtttctgaagagggtattttgggagggctctacaaggtttgtgctgttgcaaggggggatggtgctgttgatgtggttgatcttgagtatgaactggcccctgcgaaatcgaagggacctcctcgggcagctattttgacaacgagatcaaaaggcgctgaacttggagatgggagctgcaatcaaagtcgagcgaaaagaatccatcttgactacaccatgggcggccatactgcagctgtatcttgtgtagcattttcagcatttggtgagaaggggaagttcctcatttcaggtggcaatgatgcatcagtgaagctgtgggattggtcgaaaggattttactctgaaacaaacagcaaagttgatttggttttggatattgatgtaaagaaaaaggtaaattggctttgtactgctccaactgattcagataacttgattgtgtgtgacacatccaaggtggtcaaagtatatagtttccggtagatggatcaaggtgtagcctcagtttgtcaggcagttatctgagggagtgaagcttgtctgaccgttggaaccaatctggtcctgactctggtatccagatattacaagcctgccgcagacagttcctgagttgtgaggtcattggttagcaatttgcaatgtcagttgtggcgcagaacagatctgataaagtatatattattttgttactgtcagaactttttgtacaacttccagtctgctagcttagctggacttggcatgtatatctctgttgtacggtgaaatgaatttacgtgtttggagaaaataaggcttgtttgtgctggaagagattatcttggaaaaaaaaaaaaaaaaaa

SEQ ID NO: 23911 - DNA, 1526 bp, Zea mays
gacagatagtagcggactgaagagtcttttttgattaggtataaatcaaagctgggtcctatcaattatctcgaaaatacatagatatacagatagaaatatatgtgacaagtcattttttttgaacaaaatagacaatgtaagagtagaataactgatatatataggcaatgtaagagtagcataactgatatttggatataatccatatccatctagaaaattcaaatattagtatttccaaacctatcagttgattatgttgaataaaatgacgcctttgctctttgtctctcctttggccatggaagagtagcctctaatatttggatatccatatccatctagaaaactcaaatactaatattcccaaatgtatctaggataccgaactgtctaatgcaggccaccacccttcaataagtaccgaacacagacacacacattcttcgatcatcatcacttcatcagccatcagatacttagctagcactcctgttcatacgaccatggcgtcgtccagcaagcagaacgccgcggtggccgccatctccgtcgccctgctcctcacttcgcatcgtacgtaaatttctgcagtatttgttcgaaccactagctaatggttgaaaataataaaaaatctgaaaagggattacggtggttgcagtcgcagtcgcagtcgcagtcgcagctggagcagaagcgggaggagtagcgccgttgaacacatgcgaaacgccgatcgcctgggctccctgcttcggcaagacctgggtctgcgttcccctctgccttggactgcactacaccggcggtttctgccagcaggagcagatgagcgagggagacgccggcgccgagcctgctataatcggaggcgccatctgcgtgtgcaccaagcagtgtcttttggatgtggaggcggtgcaaggtgcaccggcaccgtcgcagccgcccgtcgccgagcctaccgcgggggatgcgtggggttgggatgctcaactgatgatggtctatattgcttgccagcggaaagctgctggctcgagagaatgtcaaataagcttctttttctaaaaaaaaaaatagatatagagatctcgttttatcaaaataatgtcgttctcgatcgttttctaatatgatatcataacatagtgcgagataattatcttgaaacagtctcaaatttttatcataagtctacatatgatatcatgagtcatgacatatgaacaagttttatgattttctgacttttttatgttttatacaattttaaaacaattggatagcaagtttacggtcatatttcatgagtatggtgctcgataattctggtatatgttttcctgaaataagccgtaacttatgctaaataacatgaatatcatttttgcattaacaattttccattttttgagtaattgcagttcaaatctgaattatccgaagaaattcaattaaacaaacaaaatcaaatagctatagcaaacaattttatagttatgcaaaaatcgaacatg

SEQ ID NO: 23912 - DNA, 3090 bp, Zea mays
ggtaccctcgaggccggccgggaaccgattaaaactatcccaacgagaacatcgttccccttccagcacctccattcccagccacgagacgacgaaaccctagcctcccctccccctctctcaccaggccaccacctcgccggaacccggcgcctcgacggagcacgggatcatcggccgccgtcggccgcggctgcggaggagcggtgtaagatgttgaacggcggcggcggcggccagaagaagcggaacacgaagatcgagccctaccggcaccgcgtcgagaccgaccccaagttcttcgacaagtcgtggcggaagctccatgacgccatccgcgagatctacaaccacaacgccagcggtctctccttcgaggagctctacaggactgcttataacatggtattgaacaagtttgctcctcagctctatgagaaactcacagaaaacatgaaagggcatcttgaagagatgcgcacatgtatagaggctgctcaaggtggtttgttcctggaagagttgcagcgaaaatggaatgaccataacaaggcattgacaatgattagagatatcctgatgtatatggacaggacatatattcccactaataaaaagacacctgtcttcgaacatggattagagctttggagggatactatagttcggtctcctatgattcagggggaggttgtttgacacgcttctcgagctcatacatagagaaaggactggcgacgtgataaatagaggcttgatgaggactacaactaaaatgttgatggatctagggttgtctgtttaccaggatgattttgaaaggccatttcttgaggtctctgctagtttctatagtggtgagtcacaacaatttattgaatgctgtacttgtggtgagtatctgaagcaggctgagaggcgcctccatgaagaatcagagcgtgtgtcacagtacttggatgctaaaaccaatgagaaaattactgctgttgtggtgaaagagatgctagcaaatcacatgcagaggttgattcttatggagaactcagggcttgtgaatatgcttgtcgaggacaggtatgaagacctgaccaggatgtacactttgtttaatcatgttcctgatggtctcgcaacaattagatctgtgatggtgtctcatattaaggatactggcaaaagtttggtaacagatccagagagactaaaggacccagttgattttgttcagcggcttcttaacatgaaggacaagtatgacaatatcatcaatgtgtcatttagcaatgacaagagtttcctgaatgctctcaattcctcatttgagaactttataaacttaaacaacagatcacctgagttcatatcactgtttgttgatgacaaactgcggaagggggtgaaagaggccaatgaggaggatcttgaaactgtcctggacaaagtgatgatgctgtttaggtatttgcaagaaaaagatctatttgagaaatattacaagcaacacttggcaaagcgtcttctttctgggaaggctgcttctgatgattctgagagaagcatgcttgtgaagctgaagacagaatgtggctaccagtttacttcaaagttggagggcatgttcactgatttgaagacctctcaggatactacacaagggttttatgcatctacttcctcggagctgccggcagatgcccccacaatgtctgtccagatactcacaactgggtcatggccaacgcaaacctgcaatacctgcaatctcccccctgaaattgtttctgtctcagagaagtttcggtcttattaccttggcacacataatggcaggaggctaacatggcaaacaaacatggggacggctgacatcaaagtaacatttggaaatggaagcaagcatgaactgaacgtatcaacataccagatgtgtgttctcatgctgtttaactcagcagatgtcttgacttaccgtgaaattgagcagtctacagcaataccagccgctgacctgaagcgatgcctccagtcactagctcttgtgaagggtaagcaagtcctgcggaaagagccgatgagcagggacattgccgatgatgacagcttctgcgtgaacgacaagttcaccagcaagctcttcaaggtgaagatcggcaccgtggtggcgcagaaggagaccgaccccgagaagctagagacgcggcagcgggtggaggaggacaggaagccgcagatcgaggcggccattgtgcggatcatgaagtcgaggagggtcctcgaccacaacagcatcatgacggaggtgacaaagcagctgcagccgcgtttcatgccgaatcccgtggtgatcaagaagcggatcgagtcgctcatcgaacgcgacttcctggagcgggacaagacagacaggaagatgtatcgctatctggcctaagagaaccacctgtccttgaattcgatttcatcatatctacccatgttgtataaacagaccctgatccatgtaacttgtccagagaaggaaatgggtctttctgcatcccgtgacacttttaagttgagacttttttttctggatctgcccagttagttgctagcttagcttctataacatcttgcgctgggttgcatgctaacgctatagattggctgcgacgtaatgctctcttttcgttgctgcttcagaaacgcgatctgatcgctatcaaggctgaccttttgtggatggttggatgtcactgaaacggtgctcggatgaggttccgctaaactgttctatccagcgtgcaatgctatgtggtgcgtggcttctagaatgtcacatatggtagcatgaccaaatttgatgtttcagcagcgtaaagtctctggcgaaggtggtaccagacggtgacgacgctggacgtggtgaaggcgtggctgtgccgcgctacccgcggccatgcgctgaagtctaacgcgctcacggagcagttctgcgtcatcttcgagagctacctggccgctgaaagtcagtgtggttcattcaatcagttttttaatataacacatattaatcgtcaatttatataaaataacgagttcaaaaac

SEQ ID NO: 23913 - DNA, 1478 bp, Zea mays
  misc_feature (2)..(8): n is a, c, g, or t
annnnnnngagttttgttttttcttcttttttgagatataaaaaatacaactttaacatacgtagtagctatatgcgtccactgcactacattacgcttcagaatgtggaaatgacaaaacaacctctcttcacgtcgaagacgtctgacccacgacagaaacaatggacccacgagagaaacaatggaccagatagcggatattgcctagattgtcaattgctctggtctagttacattggggccatgtttcgacctcatctcgacaaacctcctatgctctcatcataccacattgctccattgctcgagtgcttaaggttgtacagcttctaggagcttatcattcacttgttgtgtagacaaatcctcaacctcaagaaccaatgtagtcaccatgacaatataatcattgcaatcgatattcgctttgtgatgccgaacttgctcaagcagctggggcatacactcagttgggtgaacaacatcaccttcagcagtgcccaaaaagagaatgatcgttcaacttcctaggatgaaaatgaagatgttttccttgcaacagtttaatatccactcatagtgaatgatccttcgctgccgtaaagctgcttgatatttgatacctttttcttctccgcagctatgcagtgcacaacagatccattgagattcatggagaaagatccccccattttacacaaccagtttatgaaaatattcgagattatatgatgatggaatgttgcggacgcgtaagtaagataaagaatactctagatcattttgtgccatcattcttcaggctattatcatttgccaccctttgtattgtaccgttacttgaatgcactgtctcacagatatggtagtagtaatgtgaaagtgacccatggagtgtggacccaacaaggttagaccagaacatggaccaaatcaaaggttcgcttgcctttgtggcactgcaagcataagcagcagtagcacaaacaatggcatagtcagtaatcacaataatgatagaataggacaggtgaagccccgtcgacgtcaccccacatggcgagcccttcgatgtcgaattggacaaaccaagacatgaagttcaatggattatatgtaataagtttacttgcctgcaaaccatggatatgaaaaatcactaaactcgaaggttcacctcgtgatattggtatatttctcgtggcgaattcaaagtgtcaagcccagttgctacgtctccttcatcttccatgtgctcagaagtcctggttggaaaaatgagagtataagagtaaatgaaaaaataaaccattttagtagattatatatgacagatagttgctaaaatatgatgtcgggcgagctaaatgaagccaacaaggcaacatgtgcccacgaatgttgtggcatttgagatgaacagattatgtcatctatccggaaatgtcctgaaaatgaataccaaagttagaata

SEQ ID NO: 23914 - DNA, 622 bp, Zea mays
cgggccgcgctctcgcccgcgccgccgccgcctccctgccctctttgccgccgccgccgccgccgccgcccgttgtcgcggacgcctcctcctcgccgaagagatgacgaagcgcaccaagaaggctggaatcgttggcaaatatggtaccaggtacggtgccagtctgcgtaagcagatcaagaagatggaggtctcccagcactccaagtacttctgtgagttctgcggcaagtttgccgtgaagaggaaagcagtcggaatctggggatgcaaggactgcgggaaggttaaggccggtggtgcctataccatgaacactgcaagtgcggtcactgtcaggagcacgatccgtcgcctgagggagcagactgaagcttgatcgcggtcaatctgacaaaggagcctttggattttgtagttcagacgagactcattcgacgcaatgtagcctaaattgacagcatacaatgttatttatcggcttgttgggttctgagagtatctggctacgttacaatgtgtatctcgtttatgttgcttagatgatcgtctgactgtactctttgtgcgtgtcgttgattcttgaatcttaatgctattgccatctgttattcgatgt

SEQ ID NO: 23915 - DNA, 718 bp, Zea mays
acgtcccgcagaccgtcgaattccgggtcaccacgcgtccgggacctacgtcgggccgccagaactctggcccagaatctaccgtcgaccagaagagccctagaaaaccctagtagcctccacaattccacataacctcgcccgcgccgcctcccccacgagacgccttcttgctctcgcttccggtgacgcccgccacttcctccccgacgagatgacgaaacgcaccaagaaggcaggaatcgttggcaaatatggtaccaggtatggtgccagtttacgtaaacagatcaagaagatggaggtctcgcagcactccaaatacttctgtgagttctgtggcaagtttgccgtgaagaggaaagcagttggtatctggggatgcaaggactgtgggaaggttaaggccggtggcgcctacacaatgaacactgctagtgcggtcactgtgagaagcacaatccggcgcctgcgggagcagaccgaagcatgattgcgggcagcttgaaaaggagtacctggatttttgtagttcagccaagagccgtgaaccattttgcctttttagctaaatgaacaagaaatgtttatctatctgtagtgaccactttgtactcatggtttgtcatgctaaattgatggtatgcactatgcaatgcaaatacttgcgtaatcgtataaaaaaaaaagctacagaaccctagggccgcccccccta

SEQ ID NO: 23916 - DNA, 1760 bp, Zea mays
gggggggggggtgggatcgaaaccatgtacaatgagattattgagcattgcctctctctgttgccatgccatgtgtaaacctgaagatcaagtctgaaattcctcaaaacgtgaatatgagcagcatatgagctgatttccacatcataggaacaaaatccaatcaaggcatgcacagtaaattttagaccaaccactggcacgcatgtacagtttgcaaatatttacacgctttcccagcaagaatcctccagttgcaaacaacgcttctgagttgtgacgaactgaaccaaccagatgtgcaacacctgcagcagagcggcagtgccatggcatgcgcccggcttaccgcccgctccacgcggcaagaacgccatggaacacctcggccacgagttccctgtcggccgtctgcaggaacgcgttgaggtcgtcgtcgtgcatctcgtacaccttcctgaagtccacaaggaacctcaggcagccgcccttgagcctcggcagccggtacaggtgcgccgtctgcagccgctccagcacgttgcgcgcgtcgatgtcttccagcaggctctcgtggcaggcctccctgaggtcgccgatgtcgtacttgtcggcggcgcggaggagcgccagccggttcgccaggaactcctcgccgccgcgcacgtcgccgtagatgtagctgaggaaggcgcggcacgcgtccagggacatgtcggtgatgtccacggtggagagctccttctccctcaggtcgtgcgagaacatgctccggaacaccggcgaccgcgtcgccaggaccgcgcggtgcgcgcccacgctgccgtccgccgcgttgatggtgatgtcggtgaggacgtcctcgtgcagcatccgagccagggacgacagggccgtgctgtccgagcactgcttgacctggcgggaggcccaaatcgaggccggctccccgccagacggatcagcgaccttcaggtcaagaaactctatctcaatcacaaacctcccagtgacggtgctatcgattgtccacacaaaaccgtcgtatttcagctgtttgtcaaaaattcctgggtggactatggtctgctgattaggtggaagagatacaataagtttggcgataaaggaagctattggggctgaggaaccgttcttgagagaacttgtattctctgcaaagagcttaacacaggtttgcttgttatttctctccacagatatgcaccagttccagaggccgatgaggaaggggagtgacttgcggtaggtgtagcaggggagcgggtcgacgcgccattgggcgagcctgggcgccgtctcgacgcgcgcgccgtcggtcatgggcccccacgtggccgccaccgccgccaccacctcattgacgcagcccagcagccccagcgcctcccccgcctccttccccaggttgtctccctccgccgccgccgcagccgctcctcatgtacaggcagtcaagcgcggcgccgatcgatcgaccgctaaggccttcctcgaccgcgcactccgcctccccacccggcgaaagaactccgagaacacaacctgagtggccacggacgtcaaggaccagtaggactactggtggtgtggcgttggcggctactaggttgttatatggtggttggatgggcggaggaggggggagagagagagagtgaatccgccacccaacggcattggcgacgtccccccgaccgagctgcgagcgctgtaaattcaacgcgagtggaacgctg

SEQ ID NO: 23917 - DNA, 2157 bp, Zea mays
agtcctgtacctattacggctgatactagagatgcagaaatgttgaataagacaccactgtcgctgccacttaagaggaagcttgtggatgtgaaggataataattctgtatcagcaacgaagcgcctcgcaacaactgatcaaacgtaccaaccctctgtattccaaactcctgctcctactcgcaaaggtctgtcagtagcagtagattctcctacttcatttcattgtggccggacaaacttcaactatgtttctactgaaaacttggacaattctcaaagcacaccaggaacgttgatcaccacgacacttcctggtgtgaatgatcaacaatcaggaaatttggaacgtatgacacttgactcactggttgtacaatacttgaaacatcaacaccgccagtgtcctgctccagttacaactttgccaccactttctcttttgcaccctcatgtttgccctgagcctagtcgcagccttagtgcacctgcaaacatagctgctcgtatgggaagccgtgagataagaaggcagtttagtggtatccagatacctcgcagggatcgtcattttatatacagtaggttcaagcagtgtcgggtttgccgtgatgaggcatcactattgacttgcatgacatttcttggagatgcatctcgagttgtggctggtaaccacacaggtgaattaaggatatttgactgcaacacggcaaatctcctagagacccaaacatgccacctacatcttgttacaacgatggaggcgacatgttctggtggacacgagcttattctcacatccagcctaaatgaggttaagatctgggatgccttctcggtatctgcagggcctttgcacacatttgaggcctgcaaagctgctaggtttaaccactctggaacttcatttgctgccctttctactgatacagctcaacgggaggttcagttgtatgatgtgcagacatatactcttgctacacagcttcctgataacactagcagttcaggttcgggccggggttacatacaacccattatacatttcagtccttcagacacaatgttgctttggaatggagtcctgtgggatacaaggcagccaaattttgtacatcagtttgaccagttcacagattactgtggcggtggcttccatccggcaggaaacgaggtgatcttaaattcggaggtgtgggatctgaggaagttcaagcttttacggagtgtcccttccctggaccagacagtaataaagttcaacggcactggtgatgttatctatgccatcctgaggcgtaatcttgatgacgtgacatcatccatcaatgctcggagggtcaggcatcctcttttccctgcattccgcacgattgatgcggtgacttactcggatattgcaaccgtccaaatcgaccgctgcgtacttgatcttgccactgagcccaatgattctcttattggggtggttgctatggacgatcaccaggagcttttctcttctgcccgcttgttcgaagttggcaggaagcgaataaccgatgacgattcagacccggaggatgcaggtgaaaccgacgatgacgacgacgacgatggcgactctgatgatgatgttctccttgcgccggtgctggaaggggatacagattccgaagagattagtagcagcagcgatgatggtgatgaagatggtggtgacgatgatatccccagttcggatgacattgaagatgacccagagtacattgatggtggtggtgattttgaagggggagggggcttgatggatattttgggtgatgacgaaggggaaggcgatgagagtgatatgatggaatcctttagcagtggcgacgaggagggttggatcatgtagtttttttttgggtagtgcagccctgccgaagatggagcatggccctgtacaagtcaatatttatacgctcacattatgattgtaattattatttcctggttcttttgagcagctcctgccctgctagggaaatgtggaacataatggaagatggtgtaagtaaaggtgggaagagaacaatctaataccaatcgattaaaaatctatctatctattaattaattaatttaaaaaaaaaaaaaaaaaaaaaactcgagggggggcccggtaccc

SEQ ID NO: 23918 - DNA, 5059 bp, Zea mays
  misc_feature (826)..(826): n is a, c, g, or t
  misc_feature (1656)..(1656): n is a, c, g, or t
  misc_feature (1664)..(1664): n is a, c, g, or t
  misc_feature (2106)..(2106): n is a, c, g, or t
  misc_feature (4991)..(4991): n is a, c, g, or t
ctacaacatcatatatcacatttaatataatatatgagtctaatctaaagtgccaatactacatcgttgttgggtgtagacttttaaagtagcatcgtacatttgggggcatcatgtccttggggcagggctaggcatattctttagtctatcagtgcttccatacttagttgaatcgagaattcatttgtcctctttaacaaccattgagattatataaggctaaggcctcagggatctgatgtcctactagtggccacagacagtcgagagaactaagtctggaaacatcatgagggcctagcatgtggtaaccttataggtcagtggccagatcgcccccgacatggtatgccctttagcctaagctaaggtagatgcctggggcacagaccctaggagcacgagtccaaagtccagaccagcaatagctagtcctcgataatttcttctgttatgatgtttagaaggcatcttatcaatgtccagagttatggccttctccgtgcgctagctgaactataatatttttagaccaacaacatttatggttgctctattatcataggaattaacaatatatatgcatcttatcaacgtccagagtttttgatctactttcttctatttctagcttcttaatagcatggaatctattttttcttcattaatcatatttcacaatcatttattgttattttgttgaatcaaagtgagaagttagaaacttactttaatcttctatcattgtgggagagatagaaattcacatgtcttcgtttaacatgataatgacaccctcttactatgttcacacatcaactgntcaacttcttcaaacaaatctccatgtgcagacatgttgttttgagtgattttgtagtagaaaaataaacaaaatatttttgtccgaaatggagtcaccaaaacgtgtattgacatggcaatgtgtctcacactaaggcatatcatgtgcaaccctcactaatgtagttcgcatgagaaatcagcaacaacaacatcaacactgagatgagccttggcccattgaagcagctgcaaaatcctagtataactgagccattactgacttgatctcgtatacccattataagtggtttcgtcatagaagaagaaaaggacgggagccctagtacccatcaatccatcatatagagtcattgagcatgacaaatcaccaatggatgtcgtcatggcgacgataatggtacaatagtttttaaccctccctcccttcaaaacttatggaaattttgtagaaattctacaaaagtttcatagaatcaatttattttcacaagcagaaaagtttcctcgattataaaagagctaagtgtgctcctccaccgctatttccgaggaacctcatttatagaaaaaaacataggttagttaacctagactcaataagtaaaccaggacaacctcttatagactcatgagaaataatattaaaggttagaaaaattatgcacgagaaagatagtaaaagaatagatgattgctgcattcaaatgaataatagcctctagatatcttaccatattttagggcgtattcggttaggggtagattatgaggaattgaaagagataaatccacccctattcaagtctgtagtaagagatttaatcntcttcacntctctgcaaccgaaaagagcctaaggactattttgataacaagggaattgaagaaaatccatcgtaggagaggaaatcccctgctatcaaaattaaatagcaaaggcttttctcgtccataggtccctccaattctcttgtcacaaaatcggacctaaatggaatccacaaaggaataagccttgaaacatttttcccaatgattaccagccacattgggccggaggtttcgataaagaacactggacattcttaccgtttcaaaaattgtcaccatccggcatccggttcttgatttcgttgaggctaacacactcgagtggtgttccgactaacgtcgaaaattccgatcacatgtttatttggtttatgaacgtagtaactttttatatcaaaggaggaaaaaaaaagaacactacttccacctaagtcccgctagagnccagagctgacctaacatttcaatccccaggttggaaagacggggggccccaactaccagctattgaaatgtccaagcttgcatgcctgcaggataaggtagcgagctaatccatcgtacgaacgcggaataatttccagtgccaatcgcgcaacaggataagatcacattgcaaatgcacagtcatctcccggccccacacacacactctctctctctctccttccccgacaccaaagctagtataaaatataattatcacattttccctcacacggaagatgcaagtgtaaggattaggacatcaatcgaagagcaaaagataaggggataagacaaccagaacaggatccttcagtcgccaccctccgtctgttcaaatactactcagtcgccaaaaaaaaacgtgattttttgtgtatggaaacaatgtggcagggccgtcaagaacgacgtcgattcacgcaccagaacgaaaggaaccccgcactggtttttggcactcacttcggatttgttttatgtggcaactcgttgctgttctctcttctctccatgtttggcgttatttagcgctgcctacggtcagttggcaatcgacctgtgtcagagtgcaatcatcggataccctcatcgagcggatcatgccacagcaacaaaataaccaaaggcagctaaccccaccatgatcttcatttgttaatgatatcctgaaggttgttactgcgtccgccaaattcaattttaaactaaaacgtgataaataaaaaggaacggatagagtatttgttaggtcagtcgatgcacttcttgtgacttgtgaggtcaaagaaacggaagccaggaggatgaacacaacagacttggatcttatacaccggaaccatatagtaagtggctactactacatctctactggtggctaagagaggaggccagagctggaagcagatctgcggctgctaatcactactccccctcagcgctgctgtggagatcggacagcgagaaggacctcggggatctgaagctcccgaggccgccattcggcccgttcctccgccgcatcccagcaccgccgagtctaaggggtggcagtgcccgcgcgtcccggacgttctttccgcggtgcggcggcggcagctggctgcactccacgtcgtcggagtcggagtcgtcctcctcgccctcgtccccctcggcgacggcgtggtcggggcccaggagcgggggcaggtaggcggccgtggccagcgagctgcaggaggctcgcctggaccagttggccaggatgcggcgccgcttgttgaacgggttctccggcttcgccagctccttggccgccgccgccaccgtcgacgtggcctcggcgaggctggtgaacgacctggacttgccggagtagaagctcgagaggcccttcctgaccaaccaaatttaaaggagcgtttccagttaataggcacccaaaaaaccatccttttgaataaaaaaaatacgtatcccattttgcaaaagcaagcgaaatagcatgagcgatccaagacggaaacaaaaaagaaagaaagaaagcttttacgaactcacttcacgggcaaggagtcctcaagcgcgtccaagcaatccagcgcgtcatcttccttaagcttgctctcgacctcctcgtccccgtcgtcaccgccggcctccgacgacgagttctcaccgatcgacgagcccgacggcgacggcgccccgaccgaggaggtatcggtcagcacctcttcctccgccacctcctctatgaagaagccgtcgctcctcctcttcccgaccgccgccatgtccgcctccttcccatgcccgccgccgccgccgccgctgccccccttcccggatccggggaacccgtagcgcggccgcgcctccgccaccgccgtcgacatgtcgccagagaatcgaggttcgacggtccggtcgttgccagtgtgtctggagtaaattgagcaaatctcgggtggattggatatgtgtccgtccaagaacagggacaggaactcaacaacttgtatgatgagaaaatgagagagagggccagagaggggaaagagagaagaagataaacgcaggcagtaggcaggataggataagagcaaggaccacgacgcaacctgggtgtggaggtcgctgaaagaggtagcaaagctccaggatcttctgcagccaaaccacgaaatgcacgcggtgtgggctgtactgttgttgcgcgattgattccaattttccaattgcacgcgagcaaggtcagtaatgtggcaccgtatcccaatgtatcactgccatagtgccatatctcaagttatccaaccactgtattacactcacacctcaacacatccatagcaagtcaaaaaaaccaatgagaggacgtatttattgatagcaagtatcacaatgccgtcttgatattttttttcttttagcaagttctgtatagttatatacttatataatacacggttttttatgatgtagtgtaaacatgtgttactcgatggctttctctagccgatattttttcagtggctactagatctccttgtgagtagtgtttttgctggaataaatgggatggtccatattaaatgctagatagttaaaggttaatcccacattgcttgttgagaacatgtacaacggatgtcttgagccgtgtcttcaagtgtgtttaaggggacaaatgtaaaaaaaaattaagacatgtatcttaacgaagacattgtatcttggctctatgctcgagacgaggaatagctaattggtcgatttgatttattggatgctctggttgatacaatagatatagtaaaatataggttttagacacgcacactgtattatattgngttttagttatatctttaaagtaccgtatggtagtgtcagggttatacatgctctgagagatactttg

SEQ ID NO: 23919 - DNA, 1058 bp, Zea mays
gttaggtcagtcgatgcacttctgatgtcaaagaaacggaagccaggaggatgaacacaacagacttggatcttatacaccggaaccatatagtaagtggctactactacatctctactggtggaagcagatctgcggctgctaatcactactccccctcagcgctgctgtggagatcggacagcgagaaggacctcggggatctgaagctcccgaggccgccattcggcccgttcctccgccgcatcccagcaccgccgagtctaaggggtggcagtgcccgcgcgtcccgcgacgttcttgccgcggtgcggcggcggcagctggttgcactccacgtcgtcggagtcggagtcgtcctcctcgccctcgtccccctcggcgacggcgtggtcggggcccaggagcgggggcaggtaggcggccgtggccagcgagctgcaggaggctcgcctggaccagttggccaggatgcggcgccgcttgttgaacgggttctccggcttcgccagctccttggccgccgccaccgtcgacgtggcctcggcgaggctggtgaacgacctggacttgccggagtagaagctcgagaggcccttcttcacgggcaaggagtcctcgagcgcgtccaagcaatccagcgcgtcatcttccttgagcttgctctcgacctcctcgtccccgtcgtcaccgccggcctccgacgacgagttctcaccgatcgacgagcccgacggcgacggcgccccgaccgaggaggtatcggtcagcacctcttcctccgccacctcctctatgaagaagccgtcgctcctcctcttcccgaccgccgccatgtccgcctccttcccatgcccgccgccgccgccgccgctgccccccttcccggatccggggaacccgtagcgcggccgcgcctccgccaccgccgtcgacatgtcgccagagacgcgaggttcgacggtccggtcgttgccagtgtgtctggagtaaattgagcaaatctcgggtggattggatatggggccgcccggccccgccggccgccggctgccccg

SEQ ID NO: 23920 - DNA, 3933 bp, Zea mays
ttttcagcaattccaaaatgaacccaaaactgaatttttgtacttaactccaaaatcttccacacaacttgggaatctctaaataagaaatttattcacttttccaagcaaggttttaaaatctcacttaagttttttaaggttaatccagttcctcaattaattcttccacttaaccctcctttgaaagcaaagttgctctaggtcctaagttttacctttaatactttaaattccaagccaacttattacttgctcaagagactgacttctcttcccatgtcttaagcaaagttcttaatctgagccctatactctaatacacaacaccatattcattgaaactttttaacctagtgaatgaattataggtgtatcaagcagttaatgcaagtacatatgatgacatgacaaggttttagttatcgtaacaccctcaccagggatgttacaagaagcaagcacaagcaggacgcctccatgctgcgctcaacggcggccgcttccgccgccgtccagtcgtggctcagcagcgcgaggcagagcaatgcttgatggcacttgtgatcgacgtgagagcccatttgcacagggatctttcgatagtgatttttccacttcacttatggcttcagtaacaaatcagtggttataataagcgcagttgggtttatatataagaaaaaaaaaagacaaaccagcgattgccatttcaataaaatggatccagcaatgctggtcgtttgagcttgctgtggctgcgactgtttcagttaatagctacagtaggttccagttgttttctgttcacagcacaaatggcatatccttgtacttcacaggctttcttggatttctttgctttccaagaacaaataatgaagtaaatacttggttaaaaaacaaaagaattgtgtgcccgggcatacctgtacaacttatgccctgcctaaatactttgcaggctttctcagattgttttgctttccatagaacaaataatgatttttttttttggcttctttttgtttgtttgttttgaccccggaacaaataacaaaataaatatttggttaaaaaaagaacggaagaattgtgaccctgggtatacctgtactgctgtacaacttatgccccgcttaaaaatactaaactgtacacattttttttctcgacacagaagagctgtgtatctttgtattaaaaaagggtaaactgtacaatttcctacgcttctcatagaagatggactgagctgtagagtcggggcaagtcagttgcacagtcgacatgcttcatgatgtcatgatttcaagttctgcccaccaaagtgcgctgttcctcggaatcgcctgatcttgagtgatcccagtgatctcttgcatcctcttggtgacctctgccattgtcggcctctgccttcggtcctcacttaggcacaaccgaatcagctctgataatgctctggcatgctcctcggggactgaatttagcgttggatcaatcatacccatcaccgggctagcgcaggtgagatatctgcgtgcccatagaacaaggaggccatcgtcttcagaatatggacgccttccggagatggtctcaagcagtagcaaagcaaacttatacactgtgctatactcatcaggagcatcatactcatcatcttctctcttgtcaacgctgaagctgatgtctgaaacctttgcggcatcgtcctcagtcaagtatatgtatgaactgtttagattctttagggttacaggagtgttctgctggtgcatatactgcaggcagtacagtactcccatagctatccgtaggcgtgactgccaattcagatgctccgcttctttaactgcaacaacaatgttttgatgataattagaatttgtaaacctgcttatatgaattttcctgtcacaactgctaacatcatgagcccttgtgtgaagactgctaataacagataacaaggcttttgcagctttgcagtaccccacaacatacccctgaaaagaaaggcaacccacaattaaaactcaccatgcaagcgctcaaatagtgatccatttgaagcatactcgaacaccatcatccgaatgaatggtttttcgtcttcacaataacccacaaggttcaaaagattcttatggtttacctttgacaaagctccaacctagaaatgaaaagcataaccgtgctcaaaacccaatatcttacagtttggaaaagaaatggaacagaaaatccaactacataccttattcatgtaatgtgcttcatctatagcggaccaacctcctgcataagccaccgatgtagacgccacagctatttccgctccacatgggagagttcctttaaacagtgtaaatccaggtagtgtgccaattatgttgctgaaaccttcacaggctgtttcgagctcagatcgtctgaataaagttatccctgcataaacaggggttagaagaggaacacaggttctatttgtgcattgaagcaatcagtattgcagcgtacacctaaagcatatgcaaactacaggaatgcaaagcactacagcaatgtgagcattgaacaaatgtgtgattgtgcgaactagggtctttagtaacccaatttggctatttagtctaatccccaaagggaggggattgtgtgtttcctgttttctgtgtgagcactttggggcatttcaggccttcaggcgaacctgtacataaacctctttccttccttaattgagaggcagagctcgtgctaggtttttgggaaaaaaaaccattgaacaaatatgcatagcaaaatattagcacatcaagcaaccttccatggtgctggcctgcagttgcctgcttgaactgtttgcagacaaaggtacaacagtgctagtcttcttgcggcagtagtaaaagaaacatagtgctgacgaggccaccataaaaaaaacaataactgctccaatcgatgcatatagtgttgcagaacttttgctcttgttctcttggcttggtggtgcagaagggggtggaatgggttcagaaggagatggtggtgcgggagggggtggaatgggatcagaaggagatggtgctgccggagaattcaatggaaatcttattggatgccccgtaatattgaccattttaaaatctttttgtttgctcattaacagtcttctgattttgattgtaacaatccttgtggtagtggtaggtacttgattttcatgttcacatatcctagtgagttggtgtactccaactggtgaacgcccagaaagtctgttaccttcaagaaatctgcacctccaaaaacgaaatcaatgtcaggtaatgaaagttaatctgagagaaacactttccaggtgaagatctcactcacagaaattccagcgataatatgtgttgtagctctgatggaattggtccactgaaattattatatcccagatccaacatctttagatcctgcaggtctcctatttctctaggtatggtaccatagaatgagttgttgtgcaaaattctgtatggaaaaacaaaataaaatcaggatattccaacaaaattaaggcaaatacaaaactgcagatagaaatctgtacaaataagatgttttcgattcaacacttttcatcagacggagtttgaaacaccagctaatgacaggaagttctttaagcagcaaatttgcaaatcagagtaggtgcagtgaagagcaagaatagccatgattttttatttaaaaaagtcatcaacgaaaagattcgtaagtggttttttgtatggcaacagcttatttttccctttttccaaaatctattttaaggttcccatttgtcttaagttttaaccaaggttctaaatctccggctatagctgtttgaggatgatttagctattttttgaatatacaattcagggg

SEQ ID NO: 23921 - DNA, 2255 bp, Zea mays
  misc_feature (2235)..(2242): n is a, c, g, or t
ggagacgttctcactggatttgcgtcgctgctgcagctcacctgccaggccgcagaggccagtgccactgctggcaggcgctgaggcgcccgagggccctcaagtggcgcgcgagccgcacgccaacgcccgcgacgcgacgaattatctttatcccctttccctctgccgtcctcgttcccggccgtccgtgccgaaggaagtatctgctgagtgctgacccagcccatgcccatccacctcgctccctcgaccgacccacccagcccagcgcgcgctcgcatggcgatgctgctccgcaaggtgtggggctccgtgctggcgcgcgccgcagcgccgggggccgacccgcgagcccgccgcgcgcaggcgcatcgcgcggagcagtaccagtaccacggctcgctatcgctgggcgcgctcgacgccgtccccaccgacgtgctcgcccagatcctgcgcctgctgggcccgctcgacgccgcgcgctccagcgccgtctgccgcgcctggcgcgtcctcgcctccgacaacggcctctgggctttcttcctccgcctcggccccgagccctgggacctcgtcgtcttcgccgagacgcacctcgccgccggccccgcctcgcacccgtggctgtactacgatagctcgccgcagctctcgttcaaacagatttacggcctccgagcgctggtcccgggtactctcatcgtggatggtggatctggttattgcaagtatggctggagcaagtatgctgctccttccgggcgttgtgctacattcttggaattcggtaacattgaagcacctatgtatgcaaggcttcgtcacttcttctctacaatatatacgaggatgcaaataaagccttcgactcagccagttattgttgtccttccactgtgtcactctgatgataccgagtctgctagggcctcaagaaaacaatacaaagagacactgtactctgtcttgtttgacatgaatgttcctgctgtttgtgctgtcgatcaggcagttctatctttgtatgcttctaaacggacctctggtattgttgtgcacattggattcaatacgacttctgttgttcccatctttcaaggtagggtaatgtatgagataggtgttgaaactgtggggcaaggtgcccttaaactcactggatttctcaaggagttaatgcagcggagaaatatatcctgtgagtcactgtacactgttcgaaccatcaaggagaaactttgctacgtagctgctgattatgaagctgaattgcgtaaagatacacaagcgtcctgcgagatcgatggtgaagggtgtttcactctgtcggaagagagattcaagactccagaaatcctatttcagccccatatgggaggaatgtgcgaaatattcagatattgtttgatttgtgcatcgattacagtttagttacggtccgtcgctgttgatcttgcccttgcaggcgtgctatgggcttgcataaagcagtatctctatgtatggatcactgctatgtttcaggaacggttggtgatgacagctggtacaagacggtcattttagctggtggttcgtcgtgcttgcctggtttaccagagaggctggagaaagagcttcaccaacttcttccaccttatatgtcagaaggaataagagtactccccccttcatttggcactgattctgcctggtttggtgcaaagatgatcagcaacgtgagtactttcactgaggcatggtgtgcaaagaagaaacaattccgtcagaagacaggccggagtggtacattgtttgccaattcctggtaatgaaaatctcagacacaagtcacgagcaagaaacttaaagagttccccgcatcaaaaatacggacataacatccggtccatgctccactgagcctccaccagtatatagaagcatgagcattcatgcccagtatatattcacgtccatatcatgcatatatggattatgagccagtgcatcatttggtggtgttgttataggatgttttggtaagttcgttgtggttataggttgttggcaaaagcgcagttgtctcgttttaattttaagtggaacgattaattagttattgagcatgagtctttgtttatagctatatatgtctcatgaaatttggtacagttctaaatgttgtaaaacgcaataaatcattttataaatgagatatgtctttattgctgttgttctaaacannnnnnnnaaaaaaaaaaaaa

SEQ ID NO: 23922 - DNA, 2026 bp, Zea mays
tatctggatccccttgggtccctcgaggccggccgcgaaaagttcccggccgtccgtgccgaaggaagtatctgctgacccagcccatccacctcgctccctcgaccgacccacccagcccagcgcgagctcgcatggcgatgctgctccgcaaggtgtggggctccgtgctggcgcgcgccgcagcgccgggggccgacccgcgggcccgccgcgcgcaggcgcatcgcgcggagcagtaccagtaccacggctcgctatcgctgggcgcgctcgacgccgtccccaccgacgtgctcgcccagatcctgcgcctgctgggcccgctcgacgccgcgcgctccagcgccgtctgccgcgcctggcgcgtcctcgcctccgacaacggcctctgggctttcttcctccgcctcggccccgagccctgggacctcgtcgtcttcgccgagacgcacctcgccgccggccccgcctcgcacccgtggctgtactacgatagctcgccgcagctctcgttcaaacagatttacggcctccgagcgctggtcccgggtactctcatcgtggatggtggatctggttattgcaagtatggctggagcaagtatgctgctccttccgggcgttgtgctacattcttggaattcggtaacattgaagcacctatgtatgcaaggcttcgtcacttcttctctacaatatatacgaggatgcaaataaagccttcgactcagccagttattgttgtccttccactgtgtcactctgatgataccgagtctgctagggcctcaagaaaacaatacaaggagacgctgtactctgtcttgtttgacatgaatgttcctgctgtttgtgctgtcgatcaggcagttctatctttgtatgcttctaaacggacctctggtattgttgtgcacattggattcaatacgacttctgttgttcccatctttcaaggtagggtaatgtatgagataggtgttgaaactgtggggcaaggtgcccttaaactcactggattcctcaaggagttgatgcagcggagaaatatatcctgtgagtcactgtacactgttcgaaccatcaaggagaaactttgctacgtagctgctgattatgaagctgaattgcgtaaagatacacaagcgtcctgtgagatcgatggtgaagggtgtttcactctgtcggaagagagattcaagactccagaaatcctatttcagccccatatgggaggaatgcgtgctatgggcttgcataaagcagtatctctatgtatggatcactgctatgtttcaggaacggttggtgatgacagctggtacaagacggtcattttagctggtggttcgtcgtgcttgcctggtttaccagagaggctggagaaagagcttcaccaacttcttccaccttatatgtcagaaggaataagagtactccccccttcatttggcactgattctgcctggtttggtgcaaagatgatcagcaacgtgagtactttcactgaggcatggtgtgcaaagaagaaacaattccgtcagaagacaggccggagtggtacattgtttgccaattcctggtaatgaaaatctcagacacaagtcacgagcaagaaacttaaagagttccccgcatcaaaaatacggacataacatccggtccatgctccactgagcctcccccagtatatagaagcatgagcattcatgcccagtatatattcacgtccatatcatgcatatatggattatgagccagtgcatcatttggtggtgttgttataggatgttttggtaagttcgttgtggttataggttgttggcaaaagcgcagttgtctcgttttaattttaagtggaacgattaattagttattgagcatgagtctttgtttatagctatatatgtttcatgaaatttggtacagttttaaaggttgtaaaaccccaataaatccttttataaatgagatatgtcctttaaaaaaaaaaaaaaaaaaaaaaaaaaaaaaaaaaaaaaaa

SEQ ID NO: 23923 - DNA, 1039 bp, Zea mays
cagtccttggcggtctccttggcgatgtcctcaccgatcttcttcggggagagaccgagcgggccgatctgggggccagcgacgacgccgcgccgacctcgcctcccgtcacgcggacgaagacctccaccaccctgagaggggtccaatttgggcggcatggctgctgcggcggcggcggcgggtacaggtagggtttggtcggcgtagcaacactcctatgggcgattgggatcctcgaggccggccgggacaccaccaaaaaactgccctagcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcagcgccgaggggatggtgtcatttgacaatttgatcagctgcaaggtactgggcaactgcgacaagaacctgggccccgaggcctcccgcccagggaaacccgccaacgactacacccgcggctgcaacccgatcaccggctgtcgcggctgatcatatctctctggtcgatgtgcgcgcaatgtcaatgtcgcacgcgcgtgcaggtaccaggcctcagcgtgtggtgccgcgtgtgtgtatatattacacacatgcattatacattggtcgtcgatcgttactgtatgcatggcaactgatgtttcttgcctcgcatatctgaggtgtatactgatgtatgtggctcaacttttgatgattaatgtataagtatgacaaccaaaaaaaaaaaaaaaaaatttgcggcccaaaggacccatacagaccggcgagcctagtacccggaagcccatgccaggtcccccgcccctggtagatgtgcatccgatcgtgcacggttctggctcaggcagattttagccgaaaatgtgaacaaaaccagcgtaaatgataacgaattttagaaaaaaaaaaaaaaaaaatttgcggccctcgagcttccagctt

SEQ ID NO: 23924 - DNA, 3625 bp, Zea mays
gcaaagtagcgatcattttaatattagcatttccacatcaagctctctaacccgcccgtctcttaacgaatcattcgcccgcaggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaaggtgactccttgtttatttttcttcttcttcttcttctgctgctgctgctgtttgtcaagttatggattactagaaatggttgaatgcgagtatttagcacgctcatgttggatctgtgcatgctaccactatgccaacgaatattcgcctgattgcaagagttgcggtggtctggactcggagaataagctccaggaatcaatgcagccctgctgctgtagaagtagaacttgatgggtatttttctttctattctgtttctcccccctccaagacctgcaggcactgttttttttttaggtcacgacggcagaatagcatgctatcttctctctgttgcgtatgcataacaaacatctagatgaattttaatctaaagcttgtgtcgacgcaagaagctggcacggagtagatgtacctgtttgcataaacaaagacaatgctagctatatacatggggatgtcgcctgtcatgccagagggtgcaattagttggatatgtccgtcgttctgggcccatgctccgtagtaccattctcctccccagtgctgcctctcctctacttttgatgccaccgctgccggctgttctattattggcgcctccattacgatcgcctgctgctgtcactctcactgccgcaacacacttttcttctgatgagcgagaagaaaccacacactattctaaatacaaagaaaatgcacataaatatgaagactgctgatggctacaggcttaactgtgggcagtcttggagatggttatctctttctaatccaaccacaggagttcattatatgaaggctcatggtgaaattcagtagccccttcagattccataagtaaatgcatgtctttccaatccaaccacatgagtccattatataatttctagcttgccatctactagctttttaaaactaaaactagaaactaggatgtgtcagcattttattaaaacataatattttatctttttttgtctaatagtctatcatagggcccagttctaaatcagttgtggtttcttgatctgcgtcatttggaatatatgtgatgttctagtgattgggaaaaccggaaaagtacactgcatgaatgccaagttttaaggttagggtgactggccaccggacttgaaaagtaggagtcaaaagaaatggtacttcttcagcttttcagagttcggaggtactcttcgacgtcttaaaaaatgcaactcatgctatctatgatgggagttgataatatttcagttttgctgtgattgagaggattcccaatcgctcatgaagaatctctacactgcctagttttctgaaaatggaagacctctaacggtttttctgatcttgtgatgtccagggaatttggagtcgggtggtaaaggagagaaaaccccaaagaactctaccactattgctcttcagtcaccgttcccagaatacaatggccgtttcgagattggtcttggtcaatctatggtaatataagcttatccttttataccttctattctgaaattattacagtttcaaaatcatttctttgaatcccttcggtgttgatctgccaactgatttctttgcaaaaggaaataaaaaaaaatacttgaccaagtttctttccagctggccccttccaattatccttgtgctgaccagtgctatggcatgcttgcggcttatggaatgagatcgatggtatggtctgtttgttttcagaaaacagtgttctactttgttgcaccgtgtccttaagtatttgcgtgaacatagtactatttcctagcaagcttttgcaccaagatttttttcgcaccaaaatactcagatcacatgtattcttgctacaatcatgcatgtaaacacaaagatcacctgattaatatatatgctcgaactttaccttatactattattatatagcttcattgaataaaagagcaagtacaggttatgaagcatgatactgacagcatcgctgaaatttctaataaacgccagaactctaatggccttttgttttttcttccccacatgtaacgtagtctggtgggagaatgctgttgccactaaatgcgacagctgatgcacccatctatgtgaatccgaagcagtacgaaggcatcctccgccgtcgccgtgctcgcgccaaggcggagagcgagaacaggctcgccaaaggcagaaaggtgaggagactctcttcttgtacctctgggtgaccggcggcttaacttttccctactttcatggcacccatttgcgatgtgctcgatcgcaaactttactgtcaccattttgacctgtgaccagtggtcgctgtgctgttcatgccgcagccctatctccacgagtcgcgccacctccacgcgatgcgtcgggtaagaggcaccggcgggcgcttcgtcaacacgaagaaagaagggcgtggcacggggcgttgcttcgaacgggggcagcaagacggctgcagcggcaccgtcgcgcctcgccatgccccctagcttccagagtagcgtcgccagcctgtctggctccgacgtgtcaaacatgtacagcggcggcttggagcagcaccttcgggcgccgcacttcttcaccccgctgccacccatcatggaggacggcgaccacggtggtccccccacccgcatctcctcctccttcaagtgggcagccagcgacggctgctgcgagctcctcaaggcgtgaaccgacgaggaggaggggatggctactcagacgaacggccttctcgccgatggctggtcgtctgtaggcaaatcattcttggctgttccgcattggggtgcaacctcatccacatcatctacctacccagtaggccagtaccccctgttccctgaacagtgcttgggttacaggggtcctcctgtgtgtgtgatgatgtggtgtgcctcccccacatgcatttgctgtaacataatagtgtacccaaaccactgcttcggactatcattgtctgtctcggtatggattctctgttgtcacagtgtctgaataattgaggcgtcagacttcaaagttaaaaataaaaaaaaaaaaagaaatgttgaagcttgcttggaggtctgaaactttgtgctggtc

SEQ ID NO: 23925 - DNA, 1236 bp, Zea mays
acttcgctttataaaaaaagctgtccacaaggaaacacgtaggcacaccacctgaaattacggtctgccctttttcctcctggcagtccactccttcagtccatttcagcgtgcacaactttgatacgaaagacaacgctattagctacgaatgcccaattaagtttcagctcaatatatgagtagaatatcaatcaacaagttttgttttgctttgtcttacatcaatcgcaaccacacagatcaattcaagcaaactggtttgagaactcatgcatattcagttctcagttcagacttcagggacaaaccacgttaccctgataacagatacaaacttacactaaaaatagaaaaatctacaggggaatgataacagaacaaaactacttgcatcattaactggagtgctggacctaacaaagatttttcatgtcaaaactcaatgaaaggagtttccaataatttagcaccgcattaagcatacatgctaaagctaaatgctagctcagatgtagggattagcaggatcaacagcttaagcagtagcttagaagaaaatacaaatatgtatcactaatgctcaccaccatgaaattgcaaaatatgctcactgctcgcatctttcccataaattcaacacacatcaccttttgttgatcaaatcttctatccacccatcacattaattcagaaaggttagtccactaagctgagcatcaaattaagaacctccttttttatgttcccttgacggacctccgccttcgcctgtgctactcttagcttcttgatcttggattccagatcttctgccttctcatcagcaatgaactcaaatactcttttcagagtttccccgcacggatgatgggtctcaatctcctccacataaacagcaaggttggaatacaacttctggagctcaccaaaacctctgtgcacaccttgcacattagcatctccttctgttccctcatcatttatttctccttccttactcctaatcacaatgccaccattctgatttgcatttacggtttcctttggtgtcagacgatccatatatatgtccatcttccctttgtcagttttccccttctttcccttagccaattaccatcatctttgtttaattccccattgtgactttcctgcttcttactcttacttggggaggcagtggtggtagcctctctgacacctggcttgccccttcttacttgctttctgaga

SEQ ID NO: 23926 - DNA, 1682 bp, Zea mays
  misc_feature (1624)..(1624): n is a, c, g, or t
gtctagatcgccagctgccgccctttttttttttttttttttttgcgctttttctctgcaactcagatatttcatagtcgaaagtttcaaaaaatgtcaaaacttccgaaatccacagtaacaatcttttttaacgaatatggtttgaatcctgtcatgtcagacggccactcagtatagcagatgcttgtgtcacggccctggctactctgtagatctcatgctgtacaaacttccaggactccgaagtgttgctgctccgggcgctggctatggcattggctatacctggatagactgcagtatcccagtcattctggtctgaaggtccatacaccagatgcttaaaccattctagcttgaagatgccttccctgctagtgaatgcacgctcggtctgcataagacggtcattgagttgtcggattttcagtgaatccttgttcagctgcttgctcaagagtagcttttgaagttccttttgttcgttattcactttggtagctgccgctccgagagttctgattgagttgtacagaggggaacaagtgacagttgttcccttcacttcattctctaccgtttttgtgtatgcctcaagctcaattgcataggacatgtaattgaagggtaggatgtcttcatttgccaacctcaaagccatcattccccatatgctagcagctgccacatgcctacggaacgcaggatctccgaatttcgccatccatacgtagtcatcatataaggagtggtaaaccggatatcctggtccttctccaaaaattatattcatcgaaggaataccaacatgttggacgaatgctgaatagtctgatcctccatcacctagtctaagaacccggcgggcgcggcgcgatttaatccatgaatcatacacagtctgagatgaattatcagggtcttgaaccactttagttacttgctgaagtaactcatcaagttggggagttgtagaaggcaggaatcctggaccaacgactgaaacgtcaatattcagataagcaacagctctagaatacaacatctcccggttttcttcaacccattcagttgaccctgtcagtccgtattcttccgcgtcccaactacagaagataatagttcttcgaggcctccatccttgtttttgcagcattgaaaaccttttagctaactcaatcatagctgctgttccactgttgggatcagatgcaccgaacgtccaagcatcacgatggttaccaagaatgacatatctatcgggctcttcggcgccctcgataatggcgaagacattctcaatcgttgccatcgaatcattcccaagatatgtcaggttcaaaactgccggccctggcccgaggcggtaaacgggtccgtcttcacggccctgccagtcctccggcgccacggccccgcccatggctctgtgtatctccatcgcgtcctgagccgataccggcagggctgggatgagcggcatgtcatcggtattcatggcctcctccaagctgacgcgctcgcagccctcggacgatgcccacatcggcgtcgtcgggtcccccacgccccggaagaggctccccacctgcacaccgctgggcggcagccaccgcgagcnggggaaccacccctcaccgggtgcgccgccgtactgcagcgggtcagtgtacaccacc

SEQ ID NO: 23927 - DNA, 580 bp, Zea mays
ggccgcttttttttttttttttttgccacaagctaggtttttttatttttattttgaacaataatatagctcacacacctacagcatatatactgtacactgtaacaagcacgcgcgtagcatatgcatgtaatagttactttgttggatttgtataaaatatgcagggttgtatcggccgcggcagctgtaggatcagagttcacgggcaacaaggcaccgccgggtatgtcgctggtggtagattagttccggggtatcccatagctcccgcagatgtctgcatcagcttcctgcctgcacctgcgcctgcgcctgcaccgtaggccgccgccgcttcagtcccagcaacgaacgacgacggcgaggccaggaggagacaggccacgagaaagcacagcgccgccgtcccggtcccgggtcctgatccgctcgccgtcgtcgccatgtgacgtgagccgagggccgccgttgctcctgctcctgccttcgtcctgccgctgccgccgctcccggccgcgtgggcgtgttccagcgggcaacaagcttatttatacgcgttgttgagctaactaagtaa

SEQ ID NO: 23928 - DNA, 553 bp, Zea mays
ttttttttttttttttaaacaatcacaataatatcaaaataattcagtcagctcaatattaatgccttttcaaacaacctgcacaattatctcatggtatgttaacactaataagttgcaaaagaatacatttccagtgtactaaacatgacgagatcatagatctagataatgattcatctcactctttgatagaacaagtacataaaacccgttgagaagacattcttcctctaaagattggagctacttcatacataactcgacccctggaagtctacaacgatgagaagcggtcgtcggagcagatcgacgccgacgagaagtcgcgtgcccttcgcgttcgcttgcggtccaggctaggatattttccaccccccggtcgaccgggcgtgtttcccgggctagaatgactcgattaggatgttctaggtaatggtctcgtgcgaattcctgcagcccgggggatccactagttctagagcggccgccaccgcggtggagctccagcttttgttccctttagtgagggttaattgcgcgcttggcgtag

SEQ ID NO: 23929 - DNA, 3087 bp, Zea mays
  misc_feature (1148)..(1148): n is a, c, g, or t
  misc_feature (1168)..(1168): n is a, c, g, or t
  misc_feature (1187)..(1187): n is a, c, g, or t
  misc_feature (1200)..(1200): n is a, c, g, or t
  misc_feature (1242)..(1242): n is a, c, g, or t
  misc_feature (2000)..(2000): n is a, c, g, or t
  misc_feature (2869)..(2869): n is a, c, g, or t
tttttttttttttttttttttttttttttgtcttcaaagtaaatagttgtttaatgtgcagcaggctgatttctcatcggaaaattttgaatcagctcacattcacacacccctctagactctagttgcctgatcggtgcttcaccctcccatacctcttttccctaaacaagacaggagcaaagttggaaaaaaaaaactaagatgatacttccagcacagatggtaaaacaatttgtgtcaagaaatatagaagacagctcaagttgtagcttcatggaaataatattcaaagaacaataaaatgttgctactacaactttataacctctattatgctcagaaacgacattgaaggatatcaaaatcaacagcaagagctgaaaaaactattgcccggaagcaacactaaagggtgaaaaatttagctgaagagctgaacaaaactatcattgcctgtgaacaattaagcaaggatgacagatccaatagaaagagctgaaatgaactatcatcatcaccccaatctagatttacaataacatatcatagaaaaccctcagcagaatcaggcttcttgggactgttgctagagttcccgtcaatagtggacacggtgaccggaatagtgacagggcttcctgggacatgagtgtttgcaaattcacctttgggttgattatgctctcgctcactttgctctgtcattagaacgctatcatgaacattggccttggatacttcactctcgtggcagctaggattcttctcagctgtatccatgttttcttgcatgtgggctactactgctatttcaccctcgtgatttttctgctcctctatacccgttttagagttacctgctacattagtcatttgacgttcacccgcttgatgctcactctcctgacaagtcatttcaggactttcttgaacgacattctttgtagagtcatctttcatggcgcttccactcttgctcatccgcttcagagatttcaagcaaatcaactttttcggtttcaccgctctgattggctccctcctgctcagccatcatcctttcctttatcgacttgctagcatcagttgtagtggttgcaaccttgttgtaggcatcagtttacccatgctgcacctgtaagganatacctgttactcatgatgncagaactagcagtagaganagtctgttcggcngcagctaatgctgacttggtcttctctgcaacctggtacttntcatccatctccttcattttctcattcaccactaaggtcccggtgctgaacttctggcttaagcccattgtcctgtcaagggaagcgactttggcagttgcagttgatgtgagctgatgcttttcatcgaaagcctttgctttttcaactgtgtccatgccgagaacaaaccctttggctaacatagaaactgcaatatcctcagccttctgaagagcagattccatgccaccagtgttttttgactgataatgcagttggtggcattaggagtctgagcttgttaaaagaaattttgctaatgggggatttgaatgtaacatggttctacctctagatcagctaaaacaaacgctggtagcttgtaatcagtggctggtgtgatgatgacagccatatcttctatagtcgctccctgcattaaagcacggatttacgtaatagaattcataagtgtagaaaggttacctttaacacatagttaggtaaaagacaagaaaatcaaatgagatggaaaatatagtagttaaagaccaataacaagaacacatcatacacgacagtttcatggaagaaaccatgtatgcaaactgcatattcatattaagttcaggactctcaaatctagaaaaagagaagtagtagtagtaaccatctctcattcaacaaaatcagtggatataatactaaatttgcacgcccttatttcattggcaaagtgtatgaagatgatcatcgtcataaataatttgtagtanaccgtagaaaccaacgcaaaaacctataccgtaagaagcatagccctctctgctccttgattatctctaaacgtgatgtaggcagattgcgaccgctcatcacaactgcaaaagcattctaggtcaaatcatgcatgcgcttatgctaccgaaatatatcatggagatgatattggcactaaccttttcaattctacatgcacaatctcaccagaaaatgagaagaactcactaatatcttgctctgatgctttaagtgagacgttgtggatctttaccgtgcctgtgcctgccatggtcgccttaaaaaaagttggacgacaagaatcaatcggcagtttcgataaatacatgttttaaattctttaaactaccatatctagaggattactcaacaaggtcgttgatctcattgaccttacatctaaaaggtgggataaagacttaatctaaggaattcattgtgttcttttttgtgacaaataatgcgccaaaagcgcctgcttctaccagtaccggaagcgcggcaactagctagagcaaatctcaacttgtgcgttggaaagcaagtgaaagaggtatatcctttttttacattgaaatatcaaagtactatgcagattttatttcagctctattgcatgatgcactcgcactattatatagtataagtaccatcaccataaactctgaacgctctatgtttggtttcaaatttttccgtaactagattcggtttcctgatttttataggctattatttaggtagtaatttgccatagtgttggggagatggctgaacagtacaaaatgcatgtcatgaatgaaatacaatgggattatttttcagttgaattgttaaacattcnacatgtgcatattaaattggtttctatagacacatgctttattggtttgttgggatctctcaggaatacacaagctttgtcgattggttgcgcgcacgtggcccacctaactgtggaaagaccaccttgcacataccattgctaatgagactggtgtgccattctacaagatctcaaccatgccaaacgcctctcacggaagctcagaggatacgtca

SEQ ID NO: 23930 - DNA, 1452 bp, Zea mays
ctagatgtgcaataaaaatctgtacttagaaaaagcagaaggatttacaactagagatgggcttcttgatgccttttctacattttatcacgcttttgttggcccctttttttttttttttttcctggtgaacgagattggagcagcgtatagtataagttaatacttcggatacaagcaataaaaagtcggccatgctctcaatgagacatcttctacatacggacttgaaggcagcatggcagagaacattgttgtcaggaatgttcgaatgtgtctgtacattacacgaagcccgcgactcgaggcgtgctgttacgatctgggttgttacgccatctatgtttcgatcagcagccttttcatcacaacggagggtagaagtaggacgaaacagaaaaccctaggaagagaacgcctccgatcgtcgctacagttcgctgcgagatcttggacgccagcatgctccctcctaccacggcgagagatgtgcacaccgtgtgccccagtgacgctcccactgcgactccgattgcgttcttgtgtgttgccagcgcgattgtcgctatttggctccggtcgccccattcagctaagaaggttaagatgaaagcctccaaaaagattggtgtacaaaatcttgcaaagaacctacggatggttgatttcccttgacccgactcaagcttctcttctacttcttccatttccttcttctgggatccctttgggtcagatttccatgcaatatacagcaaccgtagtccaaagaacaagtacaaaactgtagcagcactattagtgtgcttccttgatatcaagttgggcactattctgccaagtccagttgacaatactgtcatcacataaagcgcagatagtgcaccagacaacacaattgacttggggtgccgcatcgccatcagcgcagcaatgatgaaggtctcatctccaatctcactgactagtatcatggagaggctggcaaagagtgcgtcgaacagccccggtccaacctcgtctagtgccaccccatgatcgccctccgccagtgcatccttcttcaggccgtgcaagaaccccccggcgcggcggcccagagagacccccgacgcgtcgtcctcggcgctggccaccacggatacgccaagcgcgagaacgacgatggcgaggaggaggggagctctagggttcggatccatcctggggctggatctcaagaaccctaggtcctgggaacgctctcagatttgggagaacgatgagacgggatggcagacgattagattgccagcctcgaattgcctgtcgttcctgtgtttcccttctgatttcagaaactgtggaagagggattgacgatgtgaagagatttggtagctggggaaacacgaaaaggtcgcacacgatggtcgttttttgtcgttatgatacatgttgccgaacttttcac

SEQ ID NO: 23931 - DNA, 1662 bp, Zea mays
gccggccgggccgggaacagctgggtcccactactcctgtccccacttgcctcccgcaccaagctgccgcagcccgcagcggccaccaatgcggagcggccgcctgcgtcccttcacctatccgaatggggcttatcgccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgcctcaaagaagaaaaaacaaaaagacgaaatagtggccggtaacagctttggtgtgatcttggagtgggagggagttgttgtggatgatgatgatccagacttggagccccgggtttggtatgttctatcactagaagaggggaagtctttccctccagatgcattgctgaagaaaatcgagggaatgagaactgaccaggctattgcagaagtcttatgttggtcagaagatccagcagaaatccaaaggttggcaacacacaaggaggttatatatcaaaaactccaaggtggatactaccagctgcgaccacatgtgcttgatttcttgaacacccttgtgggttttgacattccaatagcaattgcagctcctcgctcaaggaagagccttgaagaagggatcaaaactgttggtctgcaaggctacttcgatgctatagttgcattggaggacttctgcctagggaaacctgatggtgagatgtttgaagtcgcagcggagcaacttggtctggagccagatgtctgtgttgtgtttggtaactcaaacttgacgacggaatctgcacataacgctgggatgaggtgtgtggcagttgcaggccgacaccctgcctatgagctccaatcagcaaaccatgttgtgagatggcttgatcagctctctattgttgacttgcagaggcttgctaatggtgaagttattggtcgcaggggtagagaatctgacatggatatggaaattgtgattgaggaatgatgatgtttctgcaaaaatgacgcactaatatattgttgtgcttataatctgatacacctaagtaatgcattacattttgtaaacaggccaagcagtgcaagttccggactaaggatactccggagtttgcattaccttcctggtttgcttgtgatgaattggaattcgcctaaaactcttttagtcattagagttggaagtgaagaaactcccacccgtaacttgtgtatgtacagtatatatatgtattacctattcttccctcataaaaaaaaaaaaaa

SEQ ID NO: 23932 - DNA, 1939 bp, Zea mays
ctggaggaggaggacccttctgccgcgtgcgccggcatcgcgagccgcgaggaatcaggacgggaataaaaagatttgcagcccgtcacataacagcgtggtcaaacgggtggcaatggcatccataaacaacgcaaatctgatacatgcatgctgatcacaaacgatggttttttcactctggttatatgaaaggctgtagagatctagatttacatccggtctgcacaattgtttttttttacagtgcagctcaggtgtgttcgtcgactacctagactttggtgggactaatcaccaattcaccatatcctctcgtttttttaaaaacactgtttctctaatctgaaaacgaaaattttcagagaaattcaagggacggaacgcgtgagaggggaatgctatcttttgttcaaacgcaacatactgcctgcataaactgtgtccttgtatattttgattatggagcgtgaaaattggacaaatttcacagttcgccaatcgaacgcaaccacaaccaccagtccgtcgccttgcatcgacatcgatcgataacctacgcacggaaccagctgctaggagtgttttcctttcctattggcattggggcccccggggccgcccgacaaatcgataggctaaggaagctccatcgatcctgcgttattttgccggtaattgattgatagatggcgtcggagaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaagaccttccaggacgccggtgtgacgctcctcaagggcgacctgtacgaccaggctagcctggtgagcgcggtgaagggcgcggacgtggtcatctccgtgctcggatcgatgcagatcgccgaccagagccggctcgtcgacgccatcaaggaggccggcaacgtcaagaggttcttcccgtcggagttcggcctggacgtggaccgcacgggcatcgtggagccggccaagtccatcctaggcgccaaggtgggcatccgccgcgccaccgaggccgcgggcataccctacacctacgccgtggccggcttcttcgcgggcttcgcgctccccaacatcgggcagctcctcgcccccggcccgcccgcggacaaggcggtcgtcctcggcgacggcgacaccaaggcggtgttcgtggaggagggcgacatcgccacgtacacggtgctggcggccgacgacccgcgcgcggagaacaaggtgctgtacatcaagccgccggccaacacgctgtcgcacaacgagctgctgtcgctgtgggagaagaagaccggcaagacgttccggcgggagtacgtgccggaggaagccgtgctcaagcagatccaagagtcgccgatccctctgaacatcatcctggcgatcgggcacgcggcgttcgtgcgtggggagcagacgggcttcgagatcgacccggccaagggggtggacgccagcgaactgtacccggatgtcaagtacaccaccgtcgacgagtacctcaaccgcttcctctgagcctgaggtctcaacaaacaggacgtcacgtacggccttggcgcgcggggccatgatgtgtggagtgtggacgtcttcatcgtcagctgctagtcgctagcgacgacgtgccaacctaaacatcactagcagcataccgtagtgtacgctacggtagaaatggaaagacaatatgttttctaaataataagatagattaaggttcatggcaaaagagatttatgatgagttatatcatattgttgagctcataaaaaatatgcttaaaaaagagtaacactatcataaaaaaaaaaaaaaaacgaaaaaaaaaaaaaaaa

SEQ ID NO: 23933 - DNA, 1524 bp, Zea mays
gccggccgggctgcgatagctacacaggcggacttgggtataatcgataggctaaggaagctccatcgatcggctgcgttattttgccggtaattgattgatagatggcgtcggagaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaagagcttccaggacgccggcgtgacgctcctcaagggcgacctgtacgaccaggctagcctggtgagcgcggtgaagggcgcggacgtggtcatctccgtgctcggatcgatgcagatcgccgaccagagccggctcgtcgacgccatcaaggaggccggaaacgtcaagaggttcttcccgtcggagttcggcctggacgtggaccgcacgggcatcgtggagccggccaagtccatcctaggcgccaaggtgggcatccgccgcgccaccgaggccgcgggcataccctacacctacgccgtggccggcttcttcgcgggcttcggcctccccaaggtcgggcaggtcctcgcccccggcccgcccgcggacaaggcggtcgtcctcggcgacggcgacaccaaggcggtgttcgtggaggagggcgacatcgccacgtacacggtgctggcggccgacgacccgcgcgcggagaacaaggtgctgtacatcaagccgccggccaacacgctgtcgcacaacgagctgctgtcgctgtgggagaagaagaccggcaagacgttccggcgggagtacgtgccggaggaagccgtgctcaagcagatccaagagtcgccgatccctctgaacatcatcctggcgatcgggcacgcggcgttcgtgcgtggggagcagacgggcttcgagatcgacccggccaagggggtggacgccagcgaactgtacccggatgtcaagtacaccaccgtcgacgagtacctcaaccgctttctctgagcctgaggtctcaacaaacaggacgtcacgtacggccgcgcgcggccatgatgtgtggacgtcctgatcgtcagctgcttattgctagtcgctagcgacgacgacgtgccaacctaaacatcactagcagcataccgtagtgtacgctacggtagaaatggaaagacaatatgttttctaaataataagatatatagattaaggttcatggcaaaagagatttatgatgaattatatcatattgttgagctcataaaaaatatgtttaaaaaagagtaacactatcatagctacaatatcttttgaagccacctaaattctcacgcgaataagatgtttctgtatatcttccgaaaaaaaaaatttagattccgcccgcttcaacatctttatcaagaatttcgtcctcggtgcatttccatcctacacaaattattacaattcattgtcctaaaataacaattaattattcttctctttatcctagcag

SEQ ID NO: 23934 - DNA, 2878 bp, Zea mays
cagcgcagggccgggggagggagcgtccgccgcatgcgacgcccggagcaacaaaggcagcgcgcggaaaaggccaggagagagagagagagaaagagagagagagagagagagagagagagagagagagagagagagaggaagctagcgcagatcgtcctcgtgctttaactttcttccaaaacaaagatggagctaacaggtagctagggagcttgcaaggctggcaaatctctctggctgctttggcctccgctctcctagctccatacggatcggagacgccatggacgacgctttcctgctgcgcatatcgcatggcgaagaatgtagccataaatgctgcgccgagggccacaaccggaattgaatgcggaactcggcagctcgctcgcgcgcgcctactctcgccaccaacaagtgggagtaaaagcggaaaggaggaggatgccgaaacttaataaaagcgaggaaggagaccactagctagcttcattgatcagctcatatatgctgctacggcgcccctcacgcgtccatcagcgtttactgcgggtctgcagcagctagccttcgattcgctgcctgctcccaaattgtgcaagggagcatcaaatgtgttacggacccgagcagtgccagtgacattgcagcagtgaagctggtcgcccagcattaacttagtacgtagtagagagagagagaagatgttgagaagcaaatggggctggttatggagagacggacggatcaagaacaggtcacagtactcctagttactactctcctgccacactccggtgacgctggaaagcgcatgcgccagtgcgccgctgctagccgcttggcatgtggtcaaggcagtggcaggctaagctgctgtaggagactagaggcatgtttggtttcctacctaaggcgccacaatctgcctaaccttaggcgctcgaattgaagaactaaagttaggcagaaaagtttggcacattgtggcgtcttaggcaccaaaccaaacaacccctaggaacagacgcttctgagttctgatcgatgatgaacttgcctctgccctagctgcagccaaagcctgcctgggtggtggacggacgacggacccaggacaggagccctggccgcggagtgaaaaaataatcccggctctcgacaagtcccaagcacgaggaggggcgatgcatgcaacccaaatccccagacacgatctaaattttaaattgcaaacacaaaagcgactcgtacatctccaagatccatccaaatcggcaaatggccatgccctgccctcctccttcccaacaccaacgtcatgatcgtctcatctacgtttctctctcttttttggccaaagaagtacaataaaataatgaagatgacaagagaacaacggccgtcttctccatcgtagctaaaatccaagaactgctgctcgctactgacctaagtagctagcttacatttctagctaaaactctaaaaaaaggaaggcaaggagaggagtacccccaaaaaaaaaaggctagcaagcaatacggtgctgagaaagagaggaggagatccatgatgcaatgcgatcagtggtggtgtacctagctagcacacagtgcaggcgccggcgcgaagcgaatggccggcggtcggtcatggcttcttgccgagggtgtgcttgttgttgtgcatccacaccttgagcacgtggcgcttgacgcagacctcctcgcagaactgctgcacggcggcctcgtcgtgcttctggatgcgccaccccagccgctccgcgaacgccagcatccggtccttctgctcctgcgtgaacttggtgcggaaccgcttcttgccggaccccgagccgccggacgagccccccgacgggccgccgcccgggcccagcgacatgcccatcatgggcgccaccaccatggggccgatcagcccggacacgtcgtcgccctcttcgcgccccagcgagtgggaggtggacggcagcgcgagcgggcgctgcatgtgcccggcggcggccgccagctgctggtgcaggaagtacccggcaggggtgcggtagtagggggagaactggtggtggtgcgccgccacggcggcgccgtaggctgtgatggcggccggggacagggcggcggcgggatcgggcggcgcgacgcccccgcctcccgctggcgagttgtcggactccttgcggtggaagttgcggtggcagccgcaggccgcgcagcgcagcgcgtcgatggagccctcctcgccagcggccatgaattcgccgcagccgtccaccgcgtgcccgccgatgccgaccgcgtggttcttgaggcactcccggtacctggtggccccgccaccgcctgcgcctgcgcctgcgcctgcgcctcctcccccgaagccgcctgctggcggcgtcctgaagctcccggctccagcagaatccccgtgcttcggggtctcgccgcctcctccgcccagtcccagccccggctgcatcggcgcatcgtagctcgagctcacgggcatcggcgtcatctcctcgtcgccgtcatcgtgctcgtcgaagtccatggcggctgacctagtcggcggctcgtcggcacacgggggagcttgtttgctatactagctagctactcctactttgctttttcccttccgacttccagtaggttctttgccgaggttaacagcgagagcttactaccacacatctagctacaggagagggtttgtgttgttctagctgctgggactcgtaataggggaagagagagaaagagagcagaccgttttttgattaggatgttctaggtaatggtctcgtgcatcggcagcggcactgctgcgcggcagcagcctgcag

SEQ ID NO: 23935 - DNA, 1303 bp, Zea mays
aatactaactattcaaacttatttccttcttttttttggtgtgaatcattatcgttagcattatatttcgtaaaccaaacagcacctcgagattacatccagctatgctattacaaaactgacaaagtaacagatccatcactccaccacaaaatcacaactagagagagacaagtctgttcgcttggttttaatccgtaccagtttctactacttatacagtatttttgtctctatagattagtccgaagcgaacaactctgctttaattcaatttttcaattagttcgttgactttgtcgccccggttgcctgagtcgccaccatccctgtacggtttcctcttcatctgcagcctcctctccggacacttgagctggaagggcatgaggaacctcgatgcttctcggaagtgcgggcctacagtggcgatctcgtacacaaggtcttccaagcatatgatgccatgatctccaagagccttctcaattagatcgttgctggtaagagggaaaggttccatgtcaaagaacccgcggcccttcttgtagataagctctttcacactctttaagttcggaaacccgtatgtgacaaagggttcgaccacaagcagcctcttcagcgtcaactcggtggccctgaggaacaccccagtgaggaccttcgtcagtcgtagtttcctcaaaaccttcctgatgtgcgggtgcaagtccacggagccagggatgcgaatcgcgaagacgagcctggagccgagcgcctcgacgggcggctggctgcggaccttgatgcgggtcctcatccgcaggaagtcgcgctccttgttacggaacgcggtgacgaactcctcgggccgcctgacggcgaccttgtgcttgtcgcggatgcgctggcgcttggccgccctgcgctcccggttcctcacggcccagtccacgttctccttgcgcttctgcagcttcgactcctctacaaacgccagctgattcggggtaccctccaccgccataggcacgattatccgcggcgcttcctccccaccggcacccattttttctccttccggcggcaggcggcggccggaaaggaagagggaggcgagggtttcaaaatcgcgagcccggccgctgctgtcttgctaaggtgttaaagccactaggtgggctgggccgaagcagtgtgggtccagcaagaactgtagctaaaccgtgggaaacacgaaggcacatgatttccaattcggcccatcttcatgcggccttccaccgggagagcgctcgacctacaggccccacctgca

SEQ ID NO: 23936 - DNA, 652 bp, Zea mays
ttttttttttttttttagtgaattaaacaggccctaaatcaagcaaagtgactttcatcaatctccttcgaagatcatagaagtgtttgcatatatgtccgttcacggttgtaagtgtgcatacattataagcgtctgcactacactagcacactacatcattcataacacagctgatatattgtcgcaccaaccgaagaggcatgtggataaccaaagaagcgcctgctatttcatgacctgatcgcacaagcgcaggtaaggtttcaaagccgaaggtacacccagctaatgctattacaaaaccgacaaggtaataacagatccatcgctccaacgcaaaacgacagccggaggaggcaaggtctgcgcttctagttcagcttctcgattagttcgttgatcttgtcgccacggtcgcccgagtcgccgccatccttgtagggtttcctcttcatctgcagcctcctctccggacacttgagcctgaagggcatgaggaacctcgatgcttctcggaagtgcggcccaaccgtggcgatctcgtgcacaacgtcttccaagcatatgatgccgtgatctccaagagccttctcaattagatcgttactggtaagagggaaaggctccttgtcgaaaaacccaccgtggg

SEQ ID NO: 23937 - DNA, 1913 bp, Zea mays
tcgcattccagatctcccctgcctccgctgtataaagctcccctgtcccccccccccccccccatcaaggcccaagctcagcgaccaccaagcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaggccatcatgtcgtgccaccagtgcggcggcaacgtcggcgacgtcgtcaacatcccgatcccgcagtgggtgcgggacgtcggcaaaagcaaccccgacatcttctacaccaaccggagtgggctgacgaacatcgagtatctcacgcttggagtggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagcagaagaggctgggcatcctgagtgggatttgcctgatgatgctgggacgtacaatgacactcctgagaagacccagttcttcgcggataacggaacataccagaccgacaaggggaagttcttcctcacatggtactcaaacaaactgatcaagcacggtgataagatcttggacgaagcaaacaaggtcttcctgggatgcaaggtgcagctggcaatcaaagtctctggcatacactggtggtacaacgttccaaaccatgcagctgagctcactgccggatactacaacttagatgacagagatggctacagaaccatagcacacatgctcacaaggcatcgtgctagcatgaacttcacttgtgctgagatgagggacagtgaacagagttcagaggcgaaaagtgcacctgaggaactggttcaacaggtgctgagtgctggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggattataatccaaatgtcgatccagttgcaccattggaaagatcaaaggcagagataccaattgaagaaatcctagaagtagcacagccaaaattggagccatttcccttcgacaaggacaccgacctaccagtttaaacactccaatgatgcaaactacaggaagaatcacgagacacttaaaaaatcaagacaaatagtaagcctattgtcgagcagtagtctattaactaaataaaatgctgtgtggagcatattataatcgcatattgccctaataatattgtgttgttaaacctgaggcttgatggttatctgatgagttgtaataatagccttggtcttcctgttgtatgtatgtatttgagctaaggaataaaaattgtggctttgtgggttaaaaaaaaaggtaaataaagccttcgcgtctagaactataagcggcc

SEQ ID NO: 23938 - DNA, 2578 bp, Zea mays
cccccctcgagtttttgaagataaagatatctactacttccaactaaaatatagcattaagacaacattaggtttttttatgagcaaaactggctacagtaatttttcgtaccaatacaactatgaactgataacactacactcacatacatgaaaaagccagtatggacgacgcataaatgaacagaaaccattggtgcacttatattagttgtattcaccaataaccttcacaagagcactttccatcctcaaacttgtgcaaacaatttgaatccttgattagtatctgccgctcgtatttttctgaaactagcttggcaaagatgtgacaatggctacacatccttaaggtctttattatccgtatgcttctgaaaggaggggaatttgaaattgcaaaagcaattgctagcttctcacaatgtattcctgataattcttctttctcttcttcagcgttagtctcattagagatgttcagcaatgacattcggatctgaatcataatcagcttcaattcagcaactgtactctctaatgctaaattatcaccggttgagaacaaatagacattgttcttgatttcaaccgaacaactatcaacatcttccaactctcttcctccgttgtataccgtcatgagtggcacatcaacagactttccagttagaccccagtaattaaaaaccagtctttggattctagggtcactcggatcaagcgatgacaactctcttgctgccaggtttgcgagccttgcatttccatgaatagttgcagcagtaagcaatgcctcccagactgctaaattgggtatgagtggcatattaccaataaactcgtacgcttcttgtagactccctgagcggccaaggagatcaactatagctgtgtaatgatctaaatctggaataatgttgtaatcgtgggtcatattgtgaaatattcgtttcgcctcagatacctttccctggaggccataggccttgattacggcagtcaaagttgtatgatctggcagcacgccttcttgtttcatctcacaaaagcgatccagtgcttcacttggagaaccatgcagcaagtgtgcaagaattatacaattccaagaaataatgttccttgatgagtgcctatcaaaaacagcacaagcaccagcaaggtcaccagattttgaataggcattgatgagtgcatttgctattttgccatccatttctaaattgttgtgataaatgcaggcgtggatctcccgtactttccaaaatccagctaggttcgcaaaagctggaatgatacttaatattgtaatgaagtctggtctcaccaagagtgattgcatctgccagaatattctcagggctctatcagaatgaccattatgcaccgaaccagcaatgagtgcattccatgaagccgtgtccctttttactccacagctttccatcatctgaaatagctcaaaagctctctcatcatccccatttcttatgtatcccgagatcattatattccacgtgatcacattgcgccgaacaccaaggctctccatctcacagaaaagctcatatgctttgccgcaatagcccgcgtgtgcataccctgcaaccatcgagttccaggagaagatatccttctcgggtatctcatcaaatactctcttagctgcaatgatttctccacatttcgcatacatgtcgaccaaggagttccccgagagcacattgttcacactcccaaccttaactgcgtggcaatggagctccatgccctgactcagcaaccgcaaactagcacaagctgagatggcactcgcaattgtcatgccgtttggttcgactccagcaaggcgcatgcgcgcgaaacaccgaagtgcttcgccacccctatcaccgtggacaaaaccagacacaaggctagtccaggtgacgacgtccggagcaacaccggactcctccatctgctccagcatctccatggccacatcaagttccccagacctcgcgtagctcgaaaccagcgtgttccatgtgacaagcccaggctctgtaccttggcgcctcatatcgtcgagcagcctccgtgcctcttcccactcgttggagcggcagcacccgaagatcatcgagttccacgtgcacaggtcccgctgccccatcatgtcgaacgccgcgcgcgcacggcccaactctccgcacttgacgtacatggccagcactgagttccccacgggcacgtccctcgctccctccgccatgaaacctctccggatcgccatggaatgcatcgccgtcccgagctccaggtcctctgtgtacgcacaggcctgtagaatccgggtgatcaggaacctgtccgggatgaccccttccctgaccatggccaccgcgagcgtgacgacctcctcgtacaggcccctgatggcgtaggcaccgatcatggccgaccaggcgagcaggtccctgcacgccattccttcgaacaccttgcgagcgtcccctaggcgcccagcgcaggagtgcaccgtgatgagcttcgtctcggaaacaatcaggcgcccgcgcgtccgattaca

SEQ ID NO: 23939 - DNA, 1034 bp, Zea mays
ggcattaattattatatatattatataatataataatagctcctgtatgatctcctttcatgtaaatcaacaaaatttggctggtggatacacagaatggtacaagggacctatcctttggatagttggcaagggagcaagcaccaagaaagcttgcacactgctgaaagaattgcctgtacacacaacaaaaagaaccaaagaaagtgtagagctatatcctactcgaatgaacaaaagatcactgtgtaaccccctaccctaagctctactcactgtactcatttgaacttctggatgagttacatcatggaaatcttgcgacttctccatttctcttgcaatctgaatgtcactggggacgaaatactcactgaaggcctttgcggcaaaatgaggaatcatcccaacaacagttaccgcaagcagcagtgcccagaacagcccagttcccatcactttgtagattgcccaaaaaccaggcatggttggtatggaatctatgatcatgacacaaatccatgtcgcagcaatgctaccccatattgccgcatgcgtaatccagttccatctgatgacatccattgccaggtgaatgttgacaagaataacaacagatagtgtccataggtctccaaggctggaaccatcaattatactcttcctgtatgcaaggtaggggatgaagaaacatgcaaggctctgccagacggagtctatcatgatgaatatgaatagcctcaggttgtagttctcatcacgctgccctgggccatagagttggggatacttcagcaatgtccgccggctgagatccttgtcgagaatggcgacaacaatagtagggacagcagtatatatcacagagtatagcacgctgctccactcagttatcgctgttgttagggtgaaaccagtgtaaagtacataccagaatagcacaaagacaaaagtagcatttctgtagaagttatacaggatcatgtaggccatcctctggtagttccggggggggggggggcctacgtagctga

SEQ ID NO: 23940 - DNA, 2265 bp, Zea mays
  misc_feature (2256)..(2256): n is a, c, g, or t
accctccatatcgtggtttggtacaagaggacgtatttggggtttgagcacaagctcacttgctcaggagtcacataatacaaatagtactaacatcgagtcagtttggaggttggtttggacagaatgagcacagaaagttggtgtccactgtccagttggatgggttccatcaccaacttaaaaagaacaaactgacgaccagtttggctacgacctggtatttgcacattgataatagcagaaacatccaggtcccagcaaattttacattattataatagaaggatatttcacagatcacatctagccatcttgtctaatctggacgaacacctccaaaaacaccgcagccgccagcccgtgtacgtagactgatggcagtcagcaggaatgcagaatggagatcaaaatgcaacaagtctgtttagctggattcaggctaattcacaaaagatggagagactcaaaccgcttccaaccactgtacaggaggaaaaaggaggatcctcacccaaaaacttctgcaacatccaaatatttctctatattttatcatgccgacagctttctccttttttttttcttttcgaaggcacagtttggcccaatagcttggattgccagtgcttttgttctagctgcaacgagccttggttgcagtttgctaatttaaaactggataaagatcatatgcttcagtaactcctcgtttggcagagaggatcatagtcatatgcttcaccagccttaacaaaccgaccctttaccctctttcgcacatctgctctagccttacgagaagcgtacctgattttcttgtcgaactttcttctcattttcttctccttgtatcgtgtgagtgcactgtctctactacctccagcaattgagccctcggggccaggaggctgccaaggaggctcacccataagaagcaatgatgataccacacaatcttggttgtctcccgcactactctcaccagtcaaaccagcaaaggaaagagacagactagacctagcctgcctcaaaggggtacaaacactggaatcacctttcactccagggttcgacatcccagagtcggcagataccgcattgctatttgcaggttgcttcagcttggactcagtggaattcccagcaggtgcttccttcatttcaaagtaaatgtctattccagcatcatcaaagagttgttctgtttgaatatgagaggtaccaaagagttcttcataattttcgaaagcaaggtcagcgtcatccacacaaaaatcttcatatatgctgtccttactgaacatatctttatctggcgtatagggaaccttatctggtgtggaatccacagatccagctgtttctgtttgaccagtagccagtggaagtaggttcactccagctcctgaagaggaacctaccaaaagcttgtcacaagtaccaatatcacttacaagtgttgcactagctatatctaacaaaatactgtcccctgcagcattatcttgattactgacaccactgtcgctgatgctcatcatgcttattccttgctcacagtttggctcaggtgctacattaggaatatctgaaacgaaggaccatattctagaaagttctgcagacgatggacatcctgaatagcaatttatagtctgccttttgtgtccggcagatgaggatcctgcaatgtggccattccaatcacaattttggcaaagcgaggcattttctgctagacagcggaccatagcaggctgtgaagcacaccggtcacataaaagtgtccttgtatgacgccgagaaagagcattagctgaatgcacattacggtcacatgataaacacaaggatgctgcatctgatcggcagtaaaccatagacctctgctccccacagaaatcacagagagcgcccatgatctttcctatcagcaaacttcaaaccagcttcaggagatgttatgcagccaacaaactcttcttcagagtgtttcccaatgaatagtttacaaggaaccggaggcaaagcgaccgcggcggctcctcagatccgccggagcggtcgccggctcggcgcctcctgagcgcccctggggagctcgggtcggcaacagaaacccaggagcttctagaaagggatcagaaccctttttttagagagaggaagggaggaacaagagagagatgcaaagagcagagaagagagggaaaggctgagaaggggaagaaagaggaagtctccttttggacnccggccggc

SEQ ID NO: 23941 - DNA, 834 bp, Zea mays
agttacatgatcaggcatctgcattagtagttccgatcaacttcgattccaggatcatgtttcatttccatcctagggctttcatctgggacacttgcaggagcctccaaggcactaaaatcagatgtctctactgtttgtttcacatcatcagccaccaactttgggaaagataggtctgagtccaaaggaacaatgtcttcatcacactgagcatgttcagtcacttgttcggtcacagtttcacccatcaactcactattttctttatgctctggcaggtgcaccacagtgatcggtggaattaaggctgttcacctctccatccatccccatgtaacatcagattctgaaggatcacattttatgcgaatggattttgaagttggtgtgttgtccatgagcttgagagcaaatccattgcgaagcaatttctcacctgaagaatgaacaatagtctcctgaatctttcctggtgaatgttgtgcttgatgagccctgatcaacccttgaattttaataatcgcaagcgagcattgtaaagatgggggggggggggggggggctagatgtccacggataacagcttgcagtttcaccagatccttctgattcagcagctcttcccttgcaatgcaagtgtcactcctaggctgaagattagttgctgcagactccccaggcccggccgccgggtctccactgcttccttcaacaagtgaggtgttttcctcctccttcagcacagttgatgagacggaaatactttcatctgcctcttcaattagttcctcaactgcccttcgggtgtctcccggcggcccgagggtaccc

SEQ ID NO: 23942 - DNA, 2136 bp, Zea mays
tgggtacccgggcttccccctcgagttttttttgggcaattttttttgagaggcgttgtagcatccacaccaacagaaacttcaatgtcgccaaatacaacagaccaatccacacactcctgatgccactgttgcattacaagtcaaagggggcacacacaaaccactatcagtcacataacacaaccaatgagaagcgacaaatgtacacgtatcaagcggcaaaagctgcccgtcttccaaaccatactcagtttcccaacgacgaatcaacggattagacggcgaaatatgctgctgtgctcggcctactcatcatcagtcagatatgccacctcttgtctgcgccaccagacgcgctgtgaggagaagggccactgcttttcacgccttgcggagcttgcgatgacgacgaccgctgcatgcgaggcgacgagtcgtgcttgccgttggtcatgggcaacgagtgcctcttcctcgcggcgttgctgtcctgcacgtctgggctcatcttcggggacgacgccttggctcttgcggactctgtgaactgcatgtagctaggcaacgggttgctgttgctgttgcttacacgaggttcttgatcgccctggtcggatttagcagctttgcttgaggagctctctctcttggcatgccttgattccttcgaaaacttgtcggtgctgctccgtccaactgagtcgctgcctggactagccagcgccctcttgctcgcgtgggacttgggcttcttgctcctgctccttttggtgttaacagagacctcacttgacggtgtcccatgagactccggaatggtggtcgttcggctcattggagtcccttcaggtgtggcataagatgtgaccgatttttccaattgtccatgcaaatctgccacttccggttcagtatgtggctccgtttcaagggcaggaacatgcccattctcttctacttccttctgcggctgggcttctgcttcaggagcattttttaccccaggatggacgacaatactggagtctttatcagctttgccagtgacatagtttctgttttccagagctccaatctccaacacgatctccccaccatcaccttctgatctgtctggtgagtccagtgtagatgaaattgatatttcagtcccacattctgatgcagcaattctcattttagtatcatgaccaactgagctttcttgtatgcctgtgccatcttgctttggcgtgtaatcttcttgcgaactagcagtgtgcatccttgacttgctcaccccatccagatgcggtgggctgctggacctgctgactgtcgaatttgtactcagctcttcaaatttcaattgggcagcagcaaaggctggattgcatggctttcttgccacaaaccttttaccttccatctccagtgtctgctcagaattgtatgcgtcaccactgtcctcattggacggttcaaattttccagggagtggacagggattccttgatgcatcatcagcttgggcatattgttgatccaaggacataaaaggctcgtccacatcattttcagccttttggtcagttacatgctcagcatctgcattagtagtttcaatcaactccgattcaggatcatgtttcatttccatcctagggctttcatctgggacacttgcaggagcctccaaggcactaaaatcagatgtctctactgtttgtttcacatcatcagccaccaactttgggaaagataggtctgagtccaaaggaacaatgtcttcatcacactgagcatgttcagtcacttgttcggtcacagtttcacccatcaactcactattttctttatgctctggcaggtgcaccacagtgatcggtggaattaaggctgtccacctctccatccatccccatgtaacatcagattctgaaggatcacattttatgcgaatggattttgaagttggtgtgttgtccatgagcttgagagcaaatccattgcgaagcaatttctcacctgaagaatgaacaatagtctcctgaatctttcctggtgaatgttgtgcttgatgagccctgatcaacccttgggggggggggggggggggggaccggggtaaagatggggggggggggggggggg

SEQ ID NO: 23943 - DNA, 3391 bp, Zea mays
  misc_feature (70)..(70): n is a, c, g, or t
accgtttcgtgttcgggtcaccgcttcgcgttgtttgcttcgtcgcatgtgattatcggccactgcactntggactaatatacgtatacaataaatttaggcaaaggtttgggctcaacgttgtggggggaatgttgcactattttctactctctctctctctctctctctctctgttctaaattataaaacgttttattttttttctagatatattatttttatgtatgcagacatagtgtatatataagtgaacaataaaaattatgtatcaaataaagacaaaccataaatagagggagcaatacataatacataacttgatggtagggaccagaaaaaatggcttatatagggtgacatgacaggccctctacgaactccggtgcgagaaaagtttgaagatatttatgataaagtctctaccatctattggtgggggcggcagatatccatttctacaattttgcagtttgaggatatagtttcgaatattattaaatacaaaatgaaaaatgccccgaacagcctcaattgggccaggcccattcgtgaactaaagccgttccgtttgtgtttttttgggccaggcctcaccatcgtccagagaacaccggccgatacgaagcaaacccctttcaaaaagaaatgagaggcgtagtagcatccacaccaacagaaacttcaatgtcgccaaatacaacagaccaatccacacactcctgatgccactgttgcattacaagtcaaagggggcacacacaaaccactatcagtcacataacacaaccaatgagaagcgacaaatgtacacgtatcaagcggcaaaagctgcccgtcttccaaaccatactcagtttcccaacgacgaatcaacggattagacggcgaaatatgctgctgtgctcggcctactcatcatcagtcagatatgccacctctcgtctgcgccgagaaggttcaatgtctttgacaagatgaacgcataacaatggagtaacaagagaaatgaggcacttaccaccagacgcgctgtgaggagaagggccactgcttttcacgccttgcggagcttgcgatgacgacgaccgctgcatgcgaggcgacgagtcgtgcttgccgttggtcatgggcaacgagtgcctcttcctcgcggcgttgctgtcctgcacgtctgggctcatcttcggggacgacgccttggctcttgcggactctgtgaactgcatgtagctaggcaacgggttgctgttgctgttgcttacacgaggttcttgatcgccctggtcggatttagcagctttgcttgaggagctctctctcttggcatgccttgattccttcgaaaagttctcggtgctgctccgtccaactgagtcgctgcctggactagccagcgccctcttgctcgcgtgggacttgggcttcttgctcctgctccttttggtgttaacagagacctcacttgacggtgtcccatgagactccggaatggtggtcgttcggctcattggagtcccttcaggtgtggcataagatgtgaccgatttttccaattgtccatgcaaatctgccacttccggttcagtatgtggctccttttgtggctgggcttccgtttcaagggcaggaacatgcccattctcttctacttccttctgcggctgggcttctgcttcaggagcatcttttaccccgggatggacaatactggagtctttatcagctttgccagtgacatagtttctgttttccagagctccaatctccaacacttatctccccaccatcaccttctgatctgtctggtgagtccagtgtggatgaaattgatatttcagtcccacattctgatgcagcaattctcattttagtatcatgaccaactgagctttcttgtatgcctgtgccatcttgctttggcgtgtaatcttcttgcgaactaggagtgtgcatccttggcttgctcaccccatccagatgcggtgggctgctggacctgctgaccgtcgaatttgtactcagctcttcaaatttcaattgggcagcagcaaacgctggattgcatggctttcttgccacaaaccttttaccttccatctccagtgtgtgctcagaattgtatgtgtcgccactgtcctcattggacggttcaaattttccagggagtggacagggatcccttgatgcatcatcagcttggctatattgttgatccaaggacataaaaggctcgtccacatcattttcagccttttggtcagttacatgctcagcatctgcattagtagtttcgatcaactccgattcaggatcatgtttcatttccatcctagggctttcatctgggacacttgcaggagcctccaaggcactaaaatcagatgtctctactgtttgtttcacatcatcagccaccaactttgggaaagataggtctgagtccaaaggaacaatgtcttcatcacactgagcatgttcagtcacttgttcggtcacagtttcacccatcaactcactattttctttatgctctggcacgtgcaccacagtgattggtggaattaaggttgtccacctctccatccattcccatgtaacatcagattctgaaggatcacattttatgcaaatggattttgacgtcgacatgttgtccatgagctgacagaagatatgcaatgtgaatatgaggaaatccaaactacagagagaaatatggatatttttggacttttagagtgtgggattctcatgtctcagtcttaccttgagagcaaatccattgcgaagcaatttctcacctgaagaatgaacaatagtctcctgcattggggaaaacaacaagtgaacactcagaactaagtagcagaacttggttgcaactctcaagaatgtttagggaaccatgtcaacccttttagggcctgttcgttttatacccaatccatgtggattggagtggattgggtgagattaaatctcaaacaagttaaaatccttcctaattctgttcaatctcatccaatccacataggatgggaataaccgaagaaggccttacatgtttgatgcagaagatgattgcttatgcaagggattgaatttcacaacaggtcaacagccaaaaagatagcagataagccacagatgtagccagttcaatggaaaccaaaactccagagactcatcatagattaacagcttccaggatgctagctaacagagctaggaaaaactgcacataacatctcagatcttactaatgttgctaagccctactcagctgactcggcaaaacaacctcatcacaacgatataattcatatcaataaatatataattcatatcaataaatcgcacatgatatggtggggccaggtaaaatgcc

SEQ ID NO: 23944 - DNA, 7371 bp, Zea mays
tcggacccttgtttttaatcggagccaaccacccagttttaataaggattttgtataataaaagggcttgatcaaatttaatgtaaaaaagtcaaacgaattcagggagatatgcacagcctaaccacgagatatgctgagaaaacaagctcgactcaaaaaggttcagaaatccgcatcagaaatgcaggcagaggaaaagctgcaggattcggtgctgtaacactacccaatctcaactgtttttgaacttcttcttttgaatgaagatctgtaaatatagatacttgcaaacgtattgagagcaggcattaagttggtgaagtaagtgtacagtcattaagcgagcaggcaaaatgtcgaacacatcatattattctttcatacgcataataactcgaccagcacggagatcggaacttacacccacagagccaccaccgccactggtgatcgcactcgcatctgagaagcagtggccatgcgcacggccgttgtgccagctcctgcccccatcaccgtccttgaaagccctggtctttctcctcgacagcttggacaactgcgggaaagcaagagagaggcagactctcagagcagagcaggacaatgcacagcgaacacaatatgacacggcaggcgcgcggcgcctcacacaccacctcgaccgacgcgctgcaccggtgatccgagcagctccggcgcttggcggccgcgtcccacccaacgtccccttcctcctccaggtcctcctcgaaggcgctggcgagattcctggccgacgccgcggaccgcgcgtcgacgtcggcgtcgaagtcggcgtggcggtggtggcgccggttattccaggacggctcccacgtcatcctcctgctgctcgatcacggcgacgcgattcgacgccgaccctccggccgatcaggcgcgcgctccgcttcgcccacctcctccgacggcggccacggcgcggcgcggcgcttgcggatcctggcggcggtggagactcccctggccagcccaccgcccagcggcggactcactcagcatgcggtcctggctgcattcaggtacattacatcacatggtaaggacggcgccctcgtgccatgacagagaagaaaaaaaaaaggcaggaacaaaactcggactcggatcatcaactggtgaaagcgcgcgcgcggggtgggggtggggaagggaagaaaaaggagggggagagtcgaacgaaagggcagtgcagtgagtcagagtcagatcagatgggaggcggcttttgttttgtcggtgtggtgactggtgactatagacttggcgccggaagggaataagaagcacgcgccaacggatctcaccgccccctccctctctttctccctgcctatgaattgaatagggtaaaagagacagtactggtagtctactacagcaaaggcagcaaatacgattaggattggggggtactctgtctgtgcagagaagacgtacccccctgcaaaagatcacgcacaggcacagtacaggagtaccaacgaagctaataagatacagacgagatgacaacaggaaggaccacagcaggatcaaactgtcaaaaagaaagaaagaccattcctagaaatagaaataccagtgacaaaatcgaatctcagtaggacaagaacacacaaaaaaaaataggaaatcgacctcctggttccagttacagtggtatcaagctcaactcaaggcttgtgcggcaacgaagacgagaagcagcgagcggatcggagcgagagcaaggacggacggagggaggagagcagacagggtatgtgggggtccggccggggttgtattgtatgttttgtatgcgatggatggatgcggcgggatggccttggcggcatcatgcagatcgggagcagcaggcaaggcatgagctgtcttggctagctgccgcgtgcctcctatgattggggattcgatgcccctgcttgtctctgatgagcgagcgagcgagcctctgaggtggcttgggttcgcaagaacaaacaaacaagatggatgagaggagaggagtacacagtactactccattatcatggggggttgggttggggagggggcatgcattgcatgagccagagccactgcatgcatgcatgctgctgactgagagctagctgtttgattctggggttttttttttggctgactggtgcattgaattggacgagctagtaggtacatatatactgcatgtactgtacttatcattaggaaactagggtattagggcacacagctcgttgagactaaacctccatctgactgagtctgttgtttgtcgtctcactaggcactaccataaaacgatctggaaaaaaatggtcaggcgacagtcataccatgggtgacgaagtgccatacccatacggttaccgtcgatcggagggctagtgctccgacgtgcagtgcagtgccagtcaacctccagtcgtcggccatggaacggacggccagactaataaagactcgctcgctacaggagggaaccgatcgaacgggaaaacaatgctgcagcacatgggggcggacgaagaggagctctcttgttcttcctcatgcatgctcacgcagtcacgctttttgagtagggtaggtaggttggtaggcaggtaggtggaagaggatagatgtccacgtccatgtgctcccggatctcgaggccggtgatttggggggaagcaaagacccaagagcgagagcagacgacatgcatccatgtactgagcggcgagcacgagtcgtcgcccggaccaggccggtgtggatctcgcgcggcgcccgcgcacgtcgccgcccgcccccgcccgggaccattgcgcctccccgtctgctgatctgcgggattccacttcgtctctgctactgttgctgggatcgtggaggcatgacgataaatgcagatccgggtggtagacgaggaggagacccaccagatggagatgaccatgaagattgtggccaagcactaggtggtgccgtggtggtgatggaccgtggacggtggtggccattggccaacactcggggtcttgcgttatcagtaattcataattgggctgggctttgactcactcgagtagagcctgttgtttttgctgggtcctttctagcacgatcgtttgtggcccggcccagtcatggaatagtaggcccacacgccacaccgactccagcgcagccgcccacccagacccagcccacgagtgtaatactactgaacctcaacgattttactaagaggcaaagtacaagtatatattatcaggaaaagtagtgactcagtcgttccactaatgatgcaactctgcttcgaccaaatctccccacttggggggacagaacgttgttcgaaatccgagatagtatgacatcctgcagccctgcttgctgtctaaggcaagcttcaaataacgatactactattagtataatttccaatccccatgcaaccaaacaagccctaaaacactctgcagtgaactataactgcactctgatttccaaactcgacaatggtaggggggccatgtcgatccattggatccccttgataagttgatatcactttatttgaacatgagaccccttaaaaacatcccaattatggtaaagacatcacaactatggttttccatgtattcgggccaaccaggtctcaaacgcagggcctctcatttcttttatgccaaattgattacatgtataaacagtgtcctaaaagcataaataatattttaggacgtgcgaaaatccacggatacttcaacacactgcttgcagcatgcgccatataaattaaacttagctatgaaaaagtaacgcgcggtaacagagaaatgatttaccatcaaaggctaaatggcagagttccttgcacaaggtgcccagaagtcacaagtcaagtaaagaaacaatgaagtcagagctgccactagtgtcaagaatgactgaatgagctagctggtaaactttcttttttttcctatatttgcaagtacaagatgaaaaaaaaaaccttttttctgtttagcataacatatttgtccaccatcatcaaaagactacggctgcacaaaacatgactaatgtggcagccccttcaaaagaaagaaagaaagaaagaaatgtgtcaaccccaattgatcgaaccaaataattcccttggacactctttaccctacctagtagcaaattgccttatgactaatgtgaactagtcagcacagattgcaattcacgacaggacaacaaatgtacagcattcctcagttcacactatgcagtagtaagcatatcaaaaggttcacatcttgtattacagtactgtagtgactactatgggaacaagcatccaatcaacagatgcgctgtgtacaaaagttcatcaatatcaacccatcaaaacaaaatcgtacctgcaacatggatccggccaaccacgaactatgctcttctcctagagtgattggcagacactggtgatccctcaaataaatcggatagctggctctccaaatcttccggtgtgtactttatatactttcctggatttcttcccccgtccacttgattgccatatctgcccagaaaagcacgataagctggaatcacgttttcagatattgatatcttcagttcttcccggagctgaggatctggaactttccagagtgtctggttcctgtaaatttcctcaaaggccatgttgaagtttttgaacctttccttgatggacatcctcgaacttgaatgcccactgccgctgccactgccactgccactcccactcccactgccatgtccatcttccttgaaataagacaaaggcttcgtccacgaaacccttaggtagctctttgaatactgtcgaatcttgccactccgcctctttatccagtgatcacccaaacccttccccagctctgaatcctttaccttctgaacaatatagagcaaattgttcatggcaaatatgcactccagggcagcatcgtcatagagcttagatttttcctccaaattggcctccaggtaagatatcagcttcagaagacgccttccaaaaggggtcattctctccaagtgttcctgatcctgatcatcagaacttctgaaagtatcatgatcactgctgtcatcggacaagagtgcatcaagtgtctcactgtaaacaaccagcaacctcaaatagttcatgacatagcgtgtcattgggtggatctctccagctgtcatcgccctccttgaggtctcctgctgtaacatcttcccaaactcaaacaggttacccctcacggcatccccaagcctatcaagaatggcttgcacgtcactgatcacgccatccccagaacatcctatgcacaagtccttcatttcagggatcacctctgcaagtgcctcatacatgtcaaggatccgagggaccttctctggcgagcgggggcacaccgccacggcacccccaaagctaagaatctgcataatgcatcctttggtggactcaaggaagcacgcatccataagttcatcagacgcatcgagcacctggtcacagaggcgacgctcaccagccagcagcacgcgcacgaccgtcttgaccccgtgcacccacttcttcatcttgtcgttgagcagcttccactcgatgcgttgcacatcgtcgatgctgaggcgctcgacgccaagcacggagaggtactcgtcgagcaggtcgcggcggatgccacagtaggcgtcggcgagctcgcgggcgtatcccgcgcgcgccatccggtgggcgatggcgcgcaggtcttcgacggcctcggggcgcacgggatcgaacacctggtcctcaaaggggttagatccgagggaggcgccgcgcgcggtctccgggccggcgggggtggcgtcgaggctgtgcggcgtggcggcgtcgaagtcggggcaggcgtcgaggtcgtccatggactcgagcgagaggcggcggagcgagaagaagaggcccgtggggtcgatggggacggcgtggcggaccatgaggtggcgcagctcctcctcgaggcgcaccatggcgagctggacggcgacgccggcccgcgcgccgccggggccgccgcgcgcgaggtggtcgatggcgacgtccacggccgcgaggtactgcgcgatgtcgtcctcgggggcctcgaagacgagcgcgtccggggtggcgtcccagagctggatgagctggtcggcggcgtcgaaggaggcggcggcggcggagatctcggaggcggaggcggcggtaaggtcgggggaggggaagaggtggtcgttggtgatggaggagaggcggttgtcgaagccggagagtatgcggatcatgtcgtcagcggcgttcttggaggtggcgagggacttgacgatgtgctgcgctgcggccaggaccttgtcgccgccggcggagggcgactccagctcctgctggggcggtggcgggggcaccgacgacgacatcaccgtcggtccgctcagtctcgaggtcgggtggggatttttggagcccgaggcggaggtgacttgggagttacgccgttgccgctgccggccggctgccgctgcctttgtttgaccgctgcgttgggtccctgcggagtctggggagtgtgtgcgcggtcggcgctgcgtcaccgggaggtcaagtgtgtgtcagtgccatttgtgtgactccatctattcctcggcagtcggcactgccaaccacactgctatcaccagaatagtacttgtaaaagaagacgctgtactctgggccggccgtgccactccgacagacggtgctccgttatttttaaacgaattccctcgatagcataaatcatttataccgtcgctattctaaaataatttatgctttctccgtccaaaaaaagtacgtaatattaaaggattcaaattttattataaaataatcattattttcatttctcaatgcataattttcttcagtcaacacatttttttgttctaatgtagctatatctctattttctgtctccctaaattttcgcgactaaacctaaaacatcaactgtttttagaccaaataagcatagcttttcttgacaccattcgaattgttcatttcccttatatttgaaatttgcctttccttgcattccactcccaccaaaaatgctgttatgttgttttaaaataactatgttgcatcaattattgtagaaaaattcctgagtcttgccgacaaatagagtgttggaggaaactgagggtgtttggttttgaggactaaagtttagtatgtgtcacattaaacatttagatgttaaatataag

SEQ ID NO: 23945 - DNA, 1234 bp, Zea mays
tttttttttttttttttttttttttagttgcaagagaagataatgaattgcatttgcaatgtttcgttgtagcaataatgttcaatcacggcggtgccgttcgaccctatctatcgtctatggattacagattgcccagcaagcttggaacccatctctcggtagtggtagtggtagctcatgtatagattgcatatatatgatcctatgtatatatgctcacagcccatgagcctcagccggccgtgttatatatatgaccctatcagtcgacgccttcgagcaccgctaggatggcctggaagaggttgatgatgtcgaggtagagctcgatggcggcggcgacgtactcgtcgtaggagtagaccctgatgaggttgtcggtgtcgtagatgatgaagccggagaagacgagcgcggcgatgcagccgtacaccatggtccccgtcctgcccagcgggaagatgatccgcaggagggagaagagcatgaggatgaggcaggcggacaccaggaacggccccaggaactcgaactcgtagcccctcttcgccgcccagaaggtgtagaaggtgagccccagcaccaccaccatcgtgatcaccaccgcctccagtatcactggcccgttcgccgtcaggcagctcagccccacggcgaagctgatgcagacggtgaagagcgccaggagcgcgaggttcaccgggtgccgcttccggtaaatgatcatcgggatcatcacgaggatgggggcgacgatgacgccgatgatggcgaacatggcgcccatggtgcgggagaggaagaagtccccgatggcgcgcaccaggttcaccgtcgcggcgacggccaccgtcagcagcagctgcaggcacacgatcacgtacaccttgcggatgaaggcccaccgcagctgcgggttctccgtcatgtacgggtacttgccgccgcccgctgcccccggcgggtagcacgcctccacgtcgtggcacttgccgtgcccgtgcttgcccatggctggccgcctgacgatcggttggcctgtctcccgcgcgcgcgccccgagggagagagagagacggcgagcagccggtggcaagtcggttctcgcgcctcgctcgtcggttattgataggtgggctgcgctgcgcgctgcgctggggagggatccccgccaggagtagcgtcgcgaccctttttttggatggtggagaaaagatggcgccccggccgg

SEQ ID NO: 23946 - DNA, 910 bp, Zea mays
  misc_feature (898)..(898): n is a, c, g, or t
agcattgtagtctgtcacctttgcctcacattcaatttcggttttattgttcccctctgctttttgccgatccaccaaggggtagtggtagtttcatgatttagagttgctttcttatcttcaatatcaataactgacaacttcaactttttagatccacgctgttcttccttgctgcaatctatatgttttccagaatttttcaccttcggcctttttccctttgagctctcaggtatttctgcaaccccatcgttccacttcctcttagagcttgtaccattgttttctatgctatggctagcagtgacattttcttcaagctggtgatcatcatgtgcctcttcttcttggtgtttacggccatccctttgatcctggatggcaaggattttgtcatcaactggaagcggcatcttctctattatatcatgatctcgaatacagtgcacatcattgtgccctacctgcttcctgcaggatttttgtttaacccttataatatcgttatccctgaagatgcaggttgactcgaatggtggcaaggtaaacccgtccatcgagagcacaacgccgcgcgggcaggtgcggcggaggcggaaacgggctgcgacatgagcggcaaggtcggcgacggtgccgagctccgggctaaggagaagccagcagcgccgaaggccttcatccctctgtacacgctggaggaggcgactgttttcgaaaagcagacgaagcctcaccggggcgggcgccgcaggcggcggcctcgccattggtgggtgccggctaggttggggggaaagggttctgggtttctttcccaacttttttcattttatccgtgcccccagccgaattccgagcttacgtacgcgtgcatgcgacgtcatagctcttntatagtgtcacc

SEQ ID NO: 23947 - DNA, 1781 bp, Zea mays
  misc_feature (1777)..(1777): n is a, c, g, or t
ttcaagcaaatgatatcgttctattgaccctcccgtaataaatcaagcaattccaaagctgaagatctgagtgatgtacaataaagatcaattttagtgaattttcatcaacattaaataagctgacattgcatagtaacgagtcttgactggtctaaaaagttccctttgcatcagtcaccactttggaattttcaaaataggcagggcagtaattgcagttacatatataagaccaactacatcgacttgcttgaccttctccaaaggatcggatcaactttggattacataggtatcactgaagttattaaatacttaggcatcacttggagttctttcgattgggtggtttactctggctgttcttccctcgtagaattgccatcgtcgggccaagggcgctgctcctgagggctctgtaagaccaagctgacgtactagcattttgtttccatgttgcccagccattttgcagaagatcaaccttatcactgggctcaccatttttttcccagaccgtactttctgactttcctagtgcgcgttcttcgcctttagtgttgtttgacaccaagggtgatttctggctctcaatattgccttcgtttttgtgcaaggtaactggccttccggccggtgctgatccaacttcgttgcatgtttcgatacccttcagtagccttacatcaacaagtgaagagtactcgatctccaaggagccatcttccttgtacggtgacaaatccacaagcatatctgactcgtccttgttttctttttcctcggtggtgattggatactcttgaacgggtacgagaatgatacgcaatgatacgggatcatataccagaacttttcccacacggtacgaagagagctccggacacaacatggaagacagctcaaccaatcggtaggcaatcagatctccctcctttggaagtcgtgttagggggtacaagctctcaaaattgaaaggttcgctagacttttcttcattagcaatattttgcacactggacatctcaatgttactgccttcattgttccttcgattattgacagcacaaaagccattttcagtaaccttaatgtccatgacatgattgttaacttctgtgctgcatccagctattcctgcatgatagccgatatcagcatttttcttgtttgagctattcattccccacttctggcccttctttttgctcattgttgcactccattggaacgtgccctgtaactcctttgctggcgatttgtcgggttctccacctgctggttcaaagcgaatgtgaccaggccgaaccacaactgggacaatctcatccgatgtatcagattcttcctcatctgctttgatgcttgaaaaatgaacatgtgatccattttgattgcttgatgggacaggcaagccatcttgattgcttgatgatggaaaatcaggagctattagtgaatcttcatgcacattcttatctgtttgtaattttcctctctgtctcatcagccttttaattttcttgcgacgagcacttctactctccaacttttttgtatcactttgagcattgtagtctgccacatttgcctcacatttcaattcggttttattgttcccctctgctttttgctgatccaccaaggtagtggtagtttcatgatttagagttgctttcttatcttcaatatcaataactgacaacttcaactttttagatccacgctgttcttccttgctgcggacgcgtggcgtccccccgggttttccggncctg

SEQ ID NO: 23948 - DNA, 5199 bp, Zea mays
gatcgaccaaaaaaaaagtccatgaccgccggccgcgccgctgcctttcctgccgccggccgggtctactcgtcccatcttgtagctgcagcggcaccccctcaaaatcgtccaaccaatcccaccagctgctcatctcgaatccagcccgaaacctcgcgccacgcgtgccgtgggcccagttcgtgcgcgttcagctgctgccccgcgcccagggatcgggaaggcaagctctttggtggttcctaagggcgaatctcgtggcgattcgctcagatttggatttagggtttaggaggcggtgctggtgatcggtttgtgccgccgggagagatgtcggcggctgtggcgtgcgcggagagggcgaccaacgacatgctgatcggcccggattgggcggtcaacatcgagctctgcgacatcatcaacatggatcccggacaagcaaaggatacactcaaactcctaaagaaacgtcttgcaagcaagaattcgaaagtgcaaattctaacactttatgtgctagagactctaagcaaaaattgtggggatattgttcatcaacagattgttgagcgcgacatattgagtgaaatggttaagatagtaaagaaaaagccagacttgagtgtccgagagaagatattgagtttgattgacacatggcaagtggcttttggaggtccatctggaaaatatcgacagtatcatgcggcttaccaagaactcagggctgctggtgttgattttccgcctcgtgaggaaaattcagtcccgttgtttacaccacctcaaactcaaccgttaaggcatccacatctatatacacctccaggtcaaagctatgaagatgctgctatacaagcttctcttcagtctgcccctcctgcacctgccctcagtctgagtgagattcaaagcgctcgagggattgtggatgtgttagacgaaatgttaaatgctctggaccaccggcatcctgagggtgtaagggaggaggtcattgttgaccttgttggccagtgccgatcctatcaatctcgtgtcatggatcttgttaacagtactggcgacgagagccttttatttcaggctctaggactaaatgatgagttacagcgtgttgttcagcgtcatgatgacatagcaaaggggatccctcctggtactggagcacctttacctgcttctggaaatgtcaaccaagggactgccccacctaggcccactgcggtttcattttctccacttctaaatgtacatgaggacgatgaaccagaagacgagttctctgtgctttcccgcaggtctgcgagggatggtgcagtagcacagaacaatgtgccctctgctccaagaaatgagaggccatacccaagcccacttcttcctccaccaccagcatctaagaggcctgtttataccgaggcaagcagtgttgactatcttagtggtgactcctacaagtcagagaaggtttcagatgatttcatcaacccaactgctccagctaacatatccacatcatcccattcaaaggcagaagcacatccaccgccgagttatggtggcaggccagacagagtatctgacgacttcataaacccaactgcacctagcttctcggcgccttctcgtcctacaaatgaggagccagcacgtccatccgtgaagcggcaagagagcctacctgacgacgacttcataaacccaactgctcttcctggtttctcgtcgtcttcagctactaaggagtctggcgaggaccttccaaaggctccatgggaagcacaagctgccgcgggttccctaccgccgcctccggcgaggtacggccagagacagcagtacttcgagcagaacgtgtattctggcgggagcaacgaaggcggctacaatggactgacgacacagaccgaaggtctctcgctgaacccgcggagcagcgagaacgagaggagcgcggcacggccggcagcgtcccgccctgccaaacctgaggactcgctcttcaaggacctggtcgacttcgcaaagaccaagccttcgtccccgtcgaaaccggccaacagccgcaggacccgctagaacgactcgtgcgatgcatggatggacattgggtcgttcggatattcatttcacaggttagcggcttttagatggtaccatgaaataaggccgtctggagactggttttcattgcatatttgcattgcatgggaaattgttttggttgcgtttagagtggcagatgtcagaaacgttgcttgctcataatcctgggtgtgtgatgtctagttagctgctcctaaatttctgtgtcgttggcttccgattctcattttctttttctttcacttagctgtgtatatatatgttacccgattcgacagcaaatattcatagttgagtttgtgacttgaggaatgaggtgttcctattttcggtattggataaattaggtgcctatttttcacaaagctgtgtagaatgcaatcctctctgcagttagatttccaacaggctggacaagttgtggattaagcaggaaacctgtacttttagttccatggtctgcggccggataggatatagagtagactgctaatgcccattttcatcagcgtggaagaacagcgagttaggtagctaggcgcttttggtcagttggcagctggcaggcacttcccttgtgagctactgagctccgtgtggaattccatgcgcttgcagaagaatcccttctcttctctgacgaatagtcaagatccaggcgccgttgtgcacgtaccaccagtccagcctcggcggctagcaagcgacatgtgtacagactgtactgacgccagtatttgagacgtgattcatacagttgagatatacattgtccgtccattagcgtaatacgtggctcgcatttgcatcatacgagaatgctcccaccagccaggctatgtccatgcaggatgcctatttttggttgccggttttgctcaactaggtttaactgagctagtgcatgtcgcccaggctttggttgattgatcggtctcgtcttgcacgccgccgcccagcctctcgagtagacgccacccgaccaattcgatcccaccaatccgaaaaaacccgactaatacaatgggtggatacgggctatgatttttgacctgcaataattcacgggctaagtatagatcataattttttactcaaaacacgatcaacacgaaaaaacccctccaacccaaagaaattccgccccaaagccaaaaaacctaacccaacccgaaaaacctaacccgacacgtcaaacagggaggcacgtgccaaccagacctgacctgacactagtcacaggccaaccagacatgatccacgatccaaccttaacccgccccgacccgacccgatgtttgaacaaatctactctaaacaaataagaaccttttctgcatctccgtggccaggctcgcaggcatcatcacgtaaaccaggttgtgatgctgctctggccaaccaatcacgaagaagtcttggggagcctggatgcggtaaaaccagccaaccaatcaacccctagagctgaaagttggggcgggccgcctgggcccatcgtggttctggctaattattttcgagccagcacgacaagaaataattttcggctgagttatgctgtgtccagatactaaaatctagacccgactcagttctaaaacacggtgggcctacgatcgtgccgtgtcggctcaaacatgacacagtccaaaagcttatatatatctaaaaaatacatcttcaaagcattcataactttgctctagattaaacaaataatattagaaagagaaatcaatgttttctataatttttatgaagagatataacttattggagcatggctatttaaacgttagttttctaattcgtgtaacagttcaagacccggtccatcgtatcggcctgatccatttttcttcgtttcggaccgtgctctagactcttattttttgtaactttttttttcacgtagggaatacacccaaggtcgcaagtcatgcaacaaatgcctgccaccgtctcgatcttttgcttgtcctgggaccgccgcgcgagtttcgccctctcacggccgtagcccaagtgcacacacatggtagcggcagcagcccacacaaacgcacgcacaggcacagcgataggccgatagcacacgcacaacaaatgcattggtggggtcacgttcagtcggtggcgccccgtcaccgatgcacgctatccgcgtgtctggctcgtgctgcagtagtacaacagccacgtcacgcccatcttcctgctggttgacattacagaaccgctcgaaaaccggtccgatttcccgttatcgatccggaccgttaacggtttttcagtggttttttaaagttcgtttaaaattcaaaattagaaaaaatgtaagaatggaaatagcgttttctcgctgagaaaccgatgaaaaccagttaatttgaattcgaaactgacaaaaaccgatttctcaatcaagaaacggtttctcgtcgagacacgcggtttctcgcaaagattcaaacaaaactcgttttttattttaaacttgcaaaccgatcggttccccccaaaacagttgtttttgagcgggaaaccgttagcgctaaccagtggttttcagtccttaaggtttgtttgggtgttctagtatttacctcaatagacatgaataaggtgtaagttaaactaacgtacaccccaatacacatcaatccatatgtattgaaataaatactagagtaatcaaacaaaacctaattgatatggttaaccctggacactagccaaggtatggtggtcacgcacagcgcactgatgttgagacacatcacccgaattttttgtattttatcctttttttctaaagaaattcacgtttgcccctccggaggaagtaatctcgtttttggatcatttgcttggcgccatattcgtctcggtgctacagcccatggcgccgagcaaagggacgcgttggcgcctgtggccacgctaattagtgacgtgacctagcttgtcgccacatatcttagcatcaagctcggcgccacagatcacatagctaagctaggcagccttaataaacccccatgaaagggaattaggcttacacctagttcctaaataatt

SEQ ID NO: 23949 - DNA, 3947 bp, Zea mays
cctcgaggccggccgttttacacctatgttgtaactaacataccgcattctgtgcagcgatgagagccttttatttcaggcactaggactaaatgatgagttacagcgtgttgttcagcgtcatgatgacatagcgaaggggatcctccctcctggtaccggagcacctgtacctgtacctgcttctgcgaatgtcaaccaagggactaccccacctaggcccacggcggtttcattttctccactcctgaatgtacacgaggacgatgaaccggaagacgagttcgtcgtgcttttccgtaggcctgcaagggatggcacagtagcacggaacaatctgccttatgcacgaagagatggaaggccgtaccgaagcccacttcttcctccaccaccagcatctaagaggcctgtttacaccgaggcaagcagtatcgactatcttagtggcggctcctacaagtcgtcagaaaaggttccagatgatttcatcaacccaactgctccagctaatgtaactacatcaccccattcgaagccagaagcatatccgccaccgagttacagtagcaggccagacagtgtgtccgacgacttcataaacccaaccgcgcctagcttttctgcgccttctcgccctacagacgaggagccaacccgttcgcctgtgaagcggcaggagagtatacccgacgatgacttcataaacccaactgctcttcctggtttttcgtcgtcttcagctactaaggagttcagcgaagatcttccaagggctccatgggaggaagcacaggctgccgcagcaggttccctgccaccgcctccggcgaggcatggtcagagacagcagtacttcgagcaaaacgtgtattctggtgggagcaacggaggtggatatgatgaactgttgacacggactgaaaacctctccctgaaccctgagaagaatgcttcacggccgacagcatcctgccaggctaaacccgaggactcactcttcaaggacctggtcgacttcgcgaagaccaagccttcgtctccgtcgaaatcggccaacagccgcaggacccgctaaacggttatccgtttcgcaggttagcagctttagattgcataccccatgaaataagggcgttggaaaattatttggttccgtttagaagcagatgtcagaaacaatacttggtcattgtcctgggcgtgtgtgtggtgtcagttagctgctcctaaatatgtgtcattggcttccatttgtttgtttgtttttttcaatagctgagtatgtatatattacccgattcggcagcaacattcatagttgagtttgcaacttgagtgttgcctattttcagtgtggataaattaggaggctatggtcaaaccttcatttttttttggtactgggcgagcttttcttttcttttttttttttaaaaaaaagctgtgtagaatggtctatgcagacagaattatgcactacaattgcttggtggcttgaggctagtcttaagtggagagtttgttgacacacttattaaaggcatgcttgtttgggattataatctgatcaaattatatataatctaacagatttttaactaatatttagttaaaacaagttagactatatgatttgggtatattataactccaaacagataacccttaatactggtatattagcttttctgttggtaacaatgacaaaagatttcattcagatgaaatagtatggaactatatctctatctctcttcatagttaaaaaatagttatgtacgtagcttttgcgtttggatgggtggattggtctgtaatctatcgatcgtagcgtaaaattgatccgacccagtagaactgcgttgtctctcccctaccagcgttatccgtttccttcacggtcgcagcagcaaaagtttgagcaccaaaagctctgctcggacaccgcagctatccatctccacgcgtcaatggcaaagtggtcgagtgaagcactcccagccagctcgagccgaaccaaacagattgcaacaaacagcaccaaaggctgcctccagtatttattctactcattccttgttactgtgcaaaatcagcctaaggctatcccagcagcactgtgcacacggggtgcggatttggtccgtttgagaaagatgaggcgttgcgcaaaagctagcgttaccagtagattgtgcattcgttcagcagcgatggtcgcacatgaatatctaggacgactgactctacagtgagaatatggccatttgcgtgaccgtccagagcttgcaagaatgtatgatgactcggttagacgcgttttttacacgaacgcccgcatgcacaatttaatggacacctaaatagtaagtacgttccttatttattttgtgcatctgcggtcgtatccacgtcctattagggctgatttggtgatccgggatcccgtgagtattggaagggattgagggagaaattagttcattttcccctgaattccctccaatcctcttaagatccccttatcactaaatcaacccttagagatgacctaagcgaaagcaactgataaggaattccacatgacgacgcccatttttcaccagtgtggaaaaactgagtttgatgtctgccattggtcagtcggcagacagttatttcccttgtccgcagagcagggatctcgtgtggaatttcatgctctgtgcagaaggagaatgccttctctctggctaatcatagataatttctttgctacgtgtacctgccaaaaagtcctcacagtcatgttaatcaaacttcatccaattttatgtaaacaaaataatctaattttatagatttaaggtattatttggtttatatattcgtaacgtaaatgataaccgataacattaaaatatgtttgtttaagtccaccgtaatcagataccacactagaaaataataccgtcatattcaaacttgttaacgctagtaatcgagtgtgaataattaccgttatcatttacgttgcttttacgaaccaaacaacacctaaattgtctgcatctcttttcaaaccttcttctcttgctcatcgaagattgaagggccaaaaacgttaggatatgcacattattgaagcgaggccgtcaaccccatcaatgctatactatacccctacctacctcgtcactcctcttcttcccctacctcccctagtcaccttgcatccgcacactgctcctcttcctattcttctcacccctatgaaagaattgtgacatctaagggagtgatgaattagatagattaaaaactactcccatccgctccaaaatatagttatttctagctttatttttcccgtgcacattcaaatgaataataatgaatgtaggcgtaatgttacacccggttttaagggcaaaaccgaatgcctagcatatgtatgccaagatccattttccacacatatgttgatgtcacaagtgtaatatatcaaaagacaatgcaataaatgcgtaaagagaatataataactttattacatcatccatacataagtgtcttaaatagtatcatcatcaaagtacaacggataaaacatgagcgatcttccacaggaagatgactggcgcatcattagacttagtatgcgtcaacatcttcggcaaagtcttcttcatcaccctatgatcaaaatattagcaaggggtgagctcacttatggttggggctcatcaagtgggaggagtaatgcaaggttaacaaggtaggctatggttaagcgataagcattttagttggtcaatattttattaacaacgcatgacttactagttgtaagtgtatcccaaaattcccaattaaacataagtacatgattatatctcaaaaacacttaagtgaaaccacttaagcaaaccatttataaatcatcggatcacgatttattttca

SEQ ID NO: 23950 - DNA, 2179 bp, Zea mays
ggccgcttttttttttttttttttgccgagaagacctcatatattctgttttagaaaaatctgctggcagatatttagagatcatgtactgtgtatactccaatacaatcttcaggtgtacaatatattgacagcatacatttgtcgccaggaaggttctggcgattacaaatgttcatggacaaatcagtaaatcgccggtgagatacattcagccactgtaagcagcaaacctatcaagaggagaatctcctctctatctacaattctagacccaaaaagccatggacaatcggagaaaattgatttctgagggtagagagcaccaatttccactacaactatcaaagctgtggtatgatatgtgcacctcatatatcgtagtcaagttctgtgctgtttagggccactgcccgcttcacaagctgcccttgctcatcatagacgtccaggttctcacatggtttcgggaacacaggcctgatgacacgcccctcgaggtaggagcactggaagatgtgcttcttcttgtagctgatgcctaccgacatgtcctggaagctgatgtccttgatggggatgacgtcgctgccatgagctcggacaggcacccgaacaccctgcccatggattcccttgaatgatatgcttgtgatgtctgggaaggcagtccggtcgtatccatcatcagcgtgctcgttgtagtcaacctttatcacaatcccagcacggacattgtcgaaagttatgttgcggtatgagatgttacggatgtagccgcctcttcctgtggcagtctttatcctcacacctctccttgattcccagatgcgcacattctccacagtaacatttgcaactccgccagacatctcactgcctattgaaattccagcactcacaagagaacgggcggttacattgcggattaaaatgtcagaagatggacgaccgtatgcaataccatactgatcccaaccactctttatagctattgcatcatcgccaaccgatatgtagcaattctcaataagcacatcctgacaagaatctggatctatgccatctgtgtttggagcaccagaaacaggagacatgatagtaacattcgaaacagtcacatttgtgcaatcataaggatgcaagtgccagaaaggtgagttcctcagtgttatgttcgcaacaataatgtccttggaccacatcagctgcacaagaggaggccttgtgttattcagaattcttctgcgatgcttcatccaccaaacttcaccctggccatttatgctcccattatgtcctgtaatgactacatctctcaaattctgtccatgaatgaggctcccaaatcgtggtcctttgcgctcccgcccatacccatatgacggtaatgctggcatcaatggccagtacttctcatccgtaatgccaaggatttccgcgccctcggcaagaaacagcgtcatgtggctggtgaggttgaagggtgccgtgagccagcgcccgggtggcacattgagctgcccgccgcctcgctccgcgagcgccgcgatggcctcgacagcacgctcgaacgccgcggtgttgaccgcccggccgtccccgacggcgccgaagtccgtgatgttgtacgccgtggggcggagccgcggcgcggggcgcggcccccgcggccgcccccgcggccgcccgcgcgaccctccgccgccggcgctgccgaaggacatggaggcgctctgccataggaacacgagcgcgaacccgacgacccacgcagcggcgagcagcgccttgttggccgcgacgaaagcgaccgcgccacggcgctggtagagcctccccccgcccgtgtccaccatcgcgccgtgcggtccctgcgtgcccccctgtagcaggcggcggcacggcggggctccgctcctccgagatctcgcgacctaggtcggaaacggcaaggcgcggccttggctcagtcggtggcgcagggaacgagggtctcgtgctcccgggggaaggcgggccgtgggggagggggtcggtgtgggagggcaagaatttccgccatcggaggttggtgaggaggttttataggatgcggcagaagccgtttgggtgagcccgacccggccgggtggtgggatggctgccgcattgggcgtgtgctcctggctcctcccga

SEQ ID NO: 23951 - DNA, 754 bp, Zea mays
gctagaaaatcagctataagacgcgcgggcggccagccggacacggacgccaacgcctcatccacctgtgctgtgacctcatatttgtcctccgttccttcgtctcatgatctctgcgcctctgcggctgtcggcgccgagggctgccgtcgggggatcgttcctgctcggcgcgtccaagtccaagcccagcaggatccgctgcgccgcgggggtggggaggggcgccgccgccgccacgctgtacgaggtgctgggcctgcgcgccggcgcgacgggccgggagatcaaggccgcgtaccggcgcctggcgcgggagcggcacccggacgtggcgaccgcgcccggggccgctgccgagttcgtccgcctgcacgacgcctatgccacgctctccgacccggacagccgcgcgcgctacgaccgcagcgccgtagccgcggtggccgtggcgcagcgcccctggaggagcggcgtcggcgtctatggccggcccctccgcacatgggagacggaccagtgctgatagcagttgttgtttatatagactagttagacggacctcctgcggtcctgccgctagccatacggccatggcggctcaccttggttttttttttctgtaccggtggccatccatgtaccctgatttcgttctcctcctacttgcacttgtacgcgtgcgatcttgagaagccattgcgaacaaatcgaccagcttataggtgattaatgatcaaaaaaaaaaaaaaaa

SEQ ID NO: 23952 - DNA, 865 bp, Zea mays
aacgcctcaaccacctgtggtggctgcttctctccccgctcccctcctgcccctttccttcgtcctcagatctgccgattccccgtccctgcgcctccgtctcatgatctctgcgcctctgcgggtgccggcgccgaaggctgccgccgggggttcgttcctgctcggcgcgtcctccgtcgagtccaatcccaatcccaagctcaagcccagcagggtccgctgcgccgccgccgccgccgccacgctgtacgaggtcctgggcctgcgcgccggcgcgacgggccgggagatcaaggccgcgtaccggcgcctggcgcgggagcggcacccggacgtggcgcacgcgcccggggccgccgccgagttcgcccgcctgcacgacgcctacgccacgctctccgacccggacagccgcgcgcgctacgacggcggcggcgccgcgcccgcggcggcggtggcgaggcgcccctggagcggcgccgtccgcggccggccccgacgccgcacatgggagacggaccagtgctggtagtagagagtagagaggcacagccaagagccccacgcgcttcttgtctgtctgtagaatagttagacctcctgccgccagccatgcggccatggcggctcaccttggactttttttttggtttcggtggccatccatgtagcgtgatttttcgttttccttcctccacttgcccttgtacctgtgtgctgtggtcttgacttcttgagatgtaaatactagtacttgatgagatggttggaggagtaaaaaaaaaaaaaaaaaaaaaaaaaaaaaacaacaaaaaaaaaaacaaaaaaacgcgacctacacaacccccttggcggccccctg

SEQ ID NO: 23953 - DNA, 851 bp, Zea mays
agctagttctagatcgcgagcggcgtggcttctctccccgctcccctcctgcccctttccttcgtcctcagatccgccgattccccgtccctgcgcctccgtctcatgatctctgcgcctctgcgggtgcggctgccggcgccgaaggctgccgccggggggtcgttcctgctcggcgcgtcctccgtcgagtccaatcccaatcccaagcccaagcccagcaggatccgctgcgccgccgccacgctgtacgaggtcctgggcctgcgcgccggcgcgacgggccgggagatcaaggccgcgtaccggcgcctggcgcgggagcggcacccggacgtggcgcccgcgcccggggccgccgccgagttcgcccgcctgcacgacgcctacgccacgctctccgacccggacagccgcgcgcgctacgacggcggcggcgccgcgcccgcggcggcggtggcgaggcgcccctggagcggcgccgtctacggccggccccgacgccgcacatgggagacggaccagtgctggtagtagagagtagagaggcacagccaagagccccacgcgcttcttgtctgtctgtagaatagttagacctcctgccgccagccatgcggccatggcggctcaccttggactttttttttggtttcggtggccatccatgtagcgtgatttttcgttttccttcctccacttgcccttgtacctgtgtgctgtggtcttgacttcttgagatgtaaatactagtacttgatgagatggttggaggagtagccgccctgcctctgttaattctaaataatccaagctgttctctccatccaaaagctcctacgcacgccgtg

SEQ ID NO: 23954 - DNA, 2235 bp, Zea mays
ttttttttttttttttgcaaatgacaatgccgtttattctcattggcaccatatatgtttacattgcagggcaaaggtaagggaacttgacaaactttgtggtgagactatgtaccaaaaccaaggagttaacctgggagacaagcaaattctgttagctgcattggagtgtgagtgtgactgccaatgaaccgagtcttcatcataacgaaaatgcaagatctcctgacatagcctctgatcgtgtgtatgtgatgcagtctgaaatctgaaaattttgtaacaaatgctacagatacatgtaagatttccatttcacaatcctgcctcatcgtaagaaaagaattggcaaaaaaagtaataaccaccctttattcaaagatcttttcgcctgtcgaaaagatcaaaaaaatgacggaactgaaaatacaaagatatgctggaacgaagaagactgttttccaggtttccgagtccgttagatccttgttagaagcctttgccgcctccagaatattgcccgtgaggccgacaccgacgattccggccagtgtccccgccgtgtttgagactcccatcactatccctgcaaacttcggagcaacatccatatggttcacggcaaaccctgctcttcctagagcaagaaaaccgagggatatcgctgaacacattacagtgcctgacggtgtgctgaacaaaggaagggccatgagtgcaaacgctgagacgatgaacccgatggtgttcagaagcttccttgtcttggtaacagatagaatcctccttgtaatcaagtgatcagcaaccacaccgccgatattggagaaaatgaacatgttgaaatagggaagcatctttgaggaacccatatcctggaggctaagcttaaggcctagctcaaaataggtagggagccagttcataagaacatacagggcatagtggaacgtgaagttgttcacaactattgcccaaacaggtaggctgaatattatccttcgccacgggatctttaccgtgcgaggtgccacaacccctcctgcttgtgccttaatcatgtctcgagatggcacttttggcattgatacctttggaagatcagtacggggtgggtcactggaaaatttcagccatattacagaccatgctgctcccaacactgcttcaacaaaaaaaactgactggggtcccatgtgcttcaccagactagggaagaaaagcatgccacaggctgcaccaagatacatccctgaggtagtaagagatactgagcgagagcgctcctgcggcggcacccattgtgccaggacagtgtgaatggcaggaaatatgaaaccttgtgctacaccaacgaataggcgagaaaggaccagaatggttactctgttgggatcaagtggaattaaaccacatatcattgaccacaatacaaatgacagtagcaggacacgtctacctcctattctctgtgctgcccatccaccaggaatctgtgataaaacataaccataatagaacatagagagtatcatgcccttgttggcttgattcacaccgatggcatcagctgcaacagtataggtaattgagaaacccacacgctcaatgtagcaaacatttgtgcagatgaatgtcaacaatactattatataacgtttcgggaacctcattctcaccattgatgatctgagatgaagcaccgtatttttactagtcttagtcaggccagaacttgctgacctcccatgaatattcaccaggatttaccataagcctgattctcttccatccatctcaaggatactacaatctgaagcgtacagattactgatcactggttcttcacatgtctttatcagttaactgatctcatacacaaattaacagagaatcttggtacactgcactgaactgaaaagcctgtcgagctgtgtgccggccgagccggagacgttcccggggacacccgggctgctgagggcggacgccgcgccggagctggtcgcgaggacgctgccccagggggtgctcgaccgagcgcggtctcctctccgggttgcggcgaagaacggaggggggagatcggccgcaggcaagacgagttcaggcggcgggcgaggcgcgagctcggccgcggggagaggaggtggctgctgccctctgcgaatggatcgggagtaggaggaactgactgaggagagagaagcccggccggcctcgaggtacccaatg

SEQ ID NO: 23955 - DNA, 2563 bp, Zea mays
atcatttgatgattagcgtatgtgttttgcaaagtgcttagattagttaggccactgattctcatcctatacaatatctcaaattatgaaattagttactaatttagcacttaatgttttctcgtttcaaagtctggcattagtttcaatttctcgtttgttacatatgaagcacaaaaacatgcgacaaaggttactctgctctgggtttttgccaaatggaagtcttgataagcatatcaatggtatgtttgctagatataattgcagaagttgcaggcagattaaaaggtgtcgttaataagctagtgaatttgcctcaactcagcaagggcaatgcaaataagagaatggcaatgccgtttattctcattgcagggcaaagatatgggaacctagtaaactttacctgcactcactcgagaccgtgccaatgatttttttttttttaatgaaaaatgtgagatttcctgacatagctttagatcatgtgtatgatacagtatgaaattttgtaaaaatgctacgggtacatgtgagattcccgttctgctatcctgcctcactgtaaatgagaaacaaaaaatataatcatcctctactcgaatatcttttcgccagtcgaaaagattaaaaaaatgacagagctgaagatacaaaggtatgccggaacaaagaagactgttttccaggtttccgagtccgttagatccttgttagaagccttcgccgcctccaggatattaccagtgaggccgacaccaacaatcccagccagtgtccccgccgtgttagagacgcccatcactatccctgcaaacttcggagcaacatccatgtggtttacggcaaaccctgctcttcccagggcaagaaaaccgagggatatcgccgaacacgttacagtgcctgagggtgtgctgaataaaggaagggccatgagtgcaaatgctgagatgatgaatccgatggtgttcagaagcttcctcgtcttggtaacagacagaatcctccttgtaatcaagtgatcggcgatcacaccaccgatgttggagaaaatgaacatgttgaaataagggagcatctttgaggaacccatgtcctggaggctaagcttgaggccaagctcaaaataggtagggagccagttcataagaacatacagggcatagtggaaggtgaagttgtttacaacgattgcccaaacaggtagactgaatattatccttcgccacgggatctttactgtgcgaggtgcaacaacccctcctgcttgtgccttaatcatgtcccgagatgccactttcggcatcgatacctttggaagatcggtacgaggtgggtcgctggaaaatttcaaccatatgacagaccatgctactcccagcactgcttcgacaaagaaaactgactggggtcccgtgtgcttcaccagacttgggaagaaaagcatgccaccagctgcaccaagatacatccccgaggtagtgagagataccgagcgagagcgctcctgcggtggcacccactgcgccagaacagtgtgaatggcagggaatatgaaaccttgtgctacaccgacaaataggcgagaaaggaccagaatggttactctgttggggtcgagtgggattaaaccacatatcatagaccacaatacaaatgacagtagcagaacacgtctgcctcctattctctgtgctgcccatccaccaggaatctgtgataaaacataaccataatagaacatagagagtatcatgcccttgttggcctgattcacaccaatggcatcggctgcaacagtgtaagcaatcgagaaacccacgcgctcaatgtagcaaacatttgtgcagatgaatgtcagcaatactatgagataacgtttcgggaacctcattctcaccattgatgatctgagatgaagcaactttttttaccagacttagtcaggccagaacttgctgacctcccatgaatattcaccaggatttaccataagactgattctcttccgtccatcttagaggatactacaatctggagtgtaaaaattactgatcattggttctttacatatccttatcagttaactgatctcatacacaaattaacagagacaatcttgatatgctgcgctgaactgaaaagacctgccactgcactgtctgggttagatcttgctcggattccaagtactagccttttgcatgtaagatgctagaaatcaaatgctcagagctcgaattagcttggccccaagctcgaatccaggggcagacccaggtccaacaatctctggtgggtgctcgtcgccggcgcagtcccgaagatagacacttgggcacctgggtagggcggcggcgcagcgcagtcgtcgccactagagacagagaccggggcacgggagaatcacgagagagagagagcgcccccgggcgacccgatgcgatggccctttgctaggactcccagtcccagcccacttccacccgctccagctccagagctcccacttgctccgcctccctcggtccctcccgcaccttgctcgaagcggcac

SEQ ID NO: 23956 - DNA, 1114 bp, Zea mays
  misc_feature (1075)..(1079): n is a, c, g, or t
  misc_feature (1084)..(1088): n is a, c, g, or t
ttttttttttttttttgcaaccaattcttcttgtggtatttggataaacattactgtacatctgcacaaaagggtaattaatagtagccatattatacactgctcttgtatatgccttgctatacactttaaagataaagtgatagcaaaataataagcaatcgaccagtctttgcgactgttcttaagtttctctcaagtcttattgtgccttctccatctggaactgtatgagattctccttccacaaactgttctccaagtacctttcatagaatgttacctcaccttccaatttcgctgctagcgccaccatgcttcgtgttccatatcgtgcctgttcctttgcagtgtcaatgaatattgagcttagcttgtactcccactcagggtcgtcgccggtgtcaggcaccatagatctatcaggtctggcagtatccatcatcaactcttctaccatttgttttaaagaggcttctgcatcatcgtgtattgccaaatatcttttgaaaccctgtcctaagcgcattgcctttggccaaggggaattaattgcagcattcgaaagcacatgaagcccaggagcaactgtttgaatcacaggatcgcctccgggtctattagagatgtaaaccatggttcctgagttcacatcagccaatataaggttaaagccattgtactgatctgcttcctttgcaatttctgtggcatactccaatggacaaaggctgccctgtagaaacctgaccgggagctgtcctctggtcttggccccgatcagagagctgggttcccgcacgttggtcaggaaggcgagcttaccatccctcgtgcaccccatccacgttcccccgccgagctcgtccctgcctccaaggatttccttggcttcctcccccgccgcccaccactgcgccggctgcgtcggcctggagtgatactcgtcgcgattgaacagcagaagcaggcggtgcgtcgggtggcagtgccacgcccatgccgcgatgcacatagccgaccagcggtgatggaggtggaaacgtcctcccgcccgccttcgggttcccctttnnnnnaaaannnnncccggccggcctcgagggtcccaatg

SEQ ID NO: 23957 - DNA, 2413 bp, Zea mays
ggccctaggggccttttttttttttttttttcagaagcatcccactttaacggaacagcgagcgacacggtatacattgtatgtattctttcaccagtacatgttcttcagtgttacatacaacaactatacacacgtgtgatgtaaaggttacagattccacaatttacacggtatggacagagaaacgcagccccaaaaaaatgttctcaaaagagttcagcgcagcagaaagggtaataccctgcttctcctgccgactctgagacgactaccagctccctctgaactttcctccgttcatagaagactgggcatgcaagggaaatacacttgactccactttcaacaatccagtctgcaccgccacaatggccacatatagcagcaagatgttggatttctcgctccaactttgaagttctgccagcgactactgtggcaacaacagcttcgcttttcaagcaattgttgcagaaggactctgatccttgaatcatatcaccacaaattgagcagtggcttgacatgtagtatgtatctattctgcctcctttggctgaggttttattattcaatcctaatcggatgaaactgccatcacgagagaatgaaccatgagcagcagcaaattggcgtttcgcaagagttgatcgtatggggcgaggcatctcattaaaccacttgttcaggtcagcaccaagaagtccaaaaacacgctgcaatgcaggaataatctgcttggttatgtaatattgttcatttaatctataaggggagccaacttctagcagaccataaggatcaataaccatgtcggcaagacgagctcctggttccccatggattacaacatatggcactctctctgcataccgaggctctgcccttgggtcagacaacatagcttttgttgcaacaattgctgcagggggcagcgtggaagcccttgcactataagtgcctaaacggacctccttcgcaaaaacgacatctagaatagagacttttcctgataatatgtgtgtccactgacgctccaaatatgtcctgaccttcaatggtagaagaatgtcaactcaacaagaaacaataataaaaaacaaggaaaatggtccttgcaagaggagactaagtaataccccttactttggtcaaatcctgttcttcaaacattattctgatagaccgttccaaaatctttgcaactgctgggcatgtgtccctccgaactgtttctatccccttcgcatcaaagacaggctcattctgttcaggactctcgtagctatagccaacatatctcttctttgtaagaaggaagcatggctggtacactttctcaaactttaatgtgactggatcaggattcattgcagttattgatgaggcgatctccttccctatcctgaatgcttcttccctagaacgcccttttaggagaacaaacatactacaacagaaacagatgtataagtatagaatgactacaatacaatccaaagaaaaaaaaacaagaaacacaataatacctgtcagtatcaccatacacaaccctagctttccacaaaggatgctggttgacaaatgatattgctgtttcgagtgttctacggccacactgaacaatgctgtctgcaagctctgcacaaggcattcgaccactgaatccagcagctgtgtaaccatacgtgacattagctatcagcttcaaagcaagctgccgtgcattgaatatctgcaaacaaactaattatttacaatatatccaccaattggtaagaacaatttttttaactgaaaaacaaatgttgcaaaagggaagtaagaggactgcctaagcacagagctaacgaaatggctatggtaccatatagcataatcaacaagagattcaggcatttcacatgatgttcaaaagttggtatagaagtgataccctgtgaagaacttgctgtgatggactcaactttttcattgcttgtttcaccataattcttgttgacaatatctcctctagaaggcgaggaagtacaccttttcttatctgcagaataccattgacattgttctgaaaaggtcagtacttactaagggaacataatgtgcagcaatatagtggatgtgccaggaatcactaaacatgtagtggtaaataatattctcaagaatatagatagtaattcatctggatggtaatcaaggggaatcacgaaagtcaatctaccaaccgcagaggcaagcaggtaaaatgtaatataggaacaactttctatgggaggtatatagctcagttagttggtacatcacaactttccactagcaatgtgaagaacatcagatattgctcaaaaatttagaaaatcacctcaggttgaacatacaggaccccatttggagtaagcagcagggg

SEQ ID NO: 23958 - DNA, 1462 bp, Zea mays
attgggtacctcgaggccggccgggaaaccaaacccactcgcaacaacggataacgctctcttccttcggctcctcccctctcgctcctatcctctcccctccaatggcgaccgccatttcctctctagtaactcctccgaccctccaccgccgctgcctgggccctgcctgcgtctccgtctccgtgtgcacccctatccgcatctccttccggcccgccgccgcgcctcaggtgtcgcgccggggctcggcgctgcgggtgtccgcctcctcggcggtgctcgaggcgccagaggcggtggcggcgcggaagctctacgtggggaatatccccaggaccgttacaaacgacgagctccgcgacatgttcgctgcgcacggcaccgtcgagcgggccgaggttatgtacgacaagtatacgaatcgcagccggcggtttgggtttgtcacgatgagcacagcggaagaggccaatgctgcagttgaggctctcaatgggactgaggttggtgatagaaaaattaaagtgaacgtcacagagagcttcttaccgaacattgaccgatcagcaccagaaccagaggctctgtttgtagatagtcagtacaaggtttatgttggtaatcttgcgaagactgtaacaaccgaagttcttaaaaacttcttctccgaaaaggggaatatcctcagtgcaacagtctcccacattccggggacctccaagtcaaaggggtatggctttgtcacattctcttctgaggaagaagttgaagctgctgttgctactttcaataacgcggtaagcttctcttgcaaattttatgcatttctgccatttctttccaacctcataaaatagtagtcaccatttggctattgccaaacaaaagaaaaacgttgtgctacaatcttctatgttatcatttaggtgtcaaatagatggaaatatggaattaacatattgactgttaattgtacagatgagttagaattacatcatctcaactacgtcaactggtgccatattgttctgacatatcattcccacagaaacttatttgctgatattaataacattgcccgttcttcaaccgtacttcagcacacatcaagaccataatctcctatatttgctattcaaaagatttctgaagccttgaaagttggcatgcttttgatatcaaactttggaacataacctgtcgctaatgttttatattgttctacaattaaatgtggtgtcaggaattggaaggacaactcattcgtgtgaatagagcttagattagcagaaatttgcaggggcaccggaggagggggaatatcttggcgaatacatgtagtaggagggatgttttgaggctagattttgataacaaagtgatcaagaccttcaatgtgatttcgatatgtcatacaatttttgtaccataacagtatatttttcttaacggcacttct

SEQ ID NO: 23959 - DNA, 1074 bp, Zea mays
ctcgaggccggccgggacgcacccacccccgccggccgggaacgctctcttccttcggctcctcccctctcgctcctatcctctcccctccaatggcgaccgccatttcctctctagtaactcctccgaccctccaccgccgctgcctgggccctgcctgcgtctccgtctccgtgtgcacccctatccgcatctccttccggcccgccgccgcgcctcaggtgtcgcgccggggctcggcgctgcgggtgtccgcctcctcggcggtgctcgaggcgccagaggcggtggcggcgcggaagctctacgtggggaatatccccaggaccgttacaaacgacgagctccgcgacatgttcgctgcgcacggcaccgtcgagcgggccgaggttatgtacgacaagtatacgaatcgcagccggcggtttgggtttgtcacgatgagcacagcggaagaggccaatgctgcagttgaggctctcaatgggactgaggttggtgatagaaaaattaaagtgaacgtcacagagagcttcttaccgaacattgaccgatcagcaccagaaccagaggctctgtttgtagatagtcagtacaaggtttatgttggtaatcttgcgaagactgtaacaaccgaagttcttaaaaacttcttctccgaaaaggggaatatcctcagtgcaacagtctcccacattccggggacctccaagtcaaaggggtatggctttgtcacattctcttctgaggaagaagttgaagctgctgttgctactttcaataacgcggaattggaaggacaactcattcgtgtgaatagagcttagattagcagaaatttgcaggggcaccggaggagggggaatatcttggcgaatacatgtagtaggagggatgttttgaggctagattttgataacaaagtgatcaagaccttcaatgtgatttcgatatgtcatacaatttttgtaccataacagtatatttttcttaacggcacttctaaatgataacataaaggcagtatggtttcagttaaaaaaaaaaaagaaaaaaaaaaaaaaaaaagcggcc

SEQ ID NO: 23960 - DNA, 1858 bp, Zea mays
ctccaagtctttaaggcatgaaccactgctgccaactccaggtcatgtgtggggtattttttctcatggatcttcagctgtcgagacgagtatgctacaactcttccttcttgcatcagcacacatcccaatccggtgtacgaagcgtcgcaatacactgagaatggcttgtgaacatcaggcaggactaacacaggagctgtagtcaatctattcttcagttcttcaaatgcttcctgacacttttgggtccacttaaactcaactttcttcgctagtaacgctgtcattggtctagcaatctttgagaagccttcaatgaaacgcctataatatccagccattccaatgaagctcttgatcccacgaacatccttcggtgctttccagttcaggatatctgctactttctttggatccactgctaacccatcttggtttatgatgtgacccagaaataagacttcatgaatccagaactcgcatttgcccagcttggcatacaactgatgctctcgaagtctttgcaataccatcttcaaatgctctacatgatcttcctcactttgagagtatatgagaatgtcatcgatgaacactaccacaaacttgtccagataatccatgaacacactgttcatcaggtacataaagaaggctggcgcatttgtcaaaccaaaggacataactgtgaactcatataacccgtacttggtgatgaatgctgtcttcggtatgtccgagggtcggattctgagttgatggtaacctgatctcagatctatcttcgagaatacgctggcacctctgagctggtcgaacaaatcttctatccttggcagggggtacttgttcttgacagtgacttcattcaaggctctgtagtctatgcacatccttttggtaccatctttcttctctacaaacaacactggagcggcccaaggcgaggtacttggcctgatgtaacccttctctaacatctcatctatctgcttcttgagttccaccaattctggtccagacactcgataggctctctttgaaatgggggcggtaccagggataagctctatggcaaattcgactttcctctcgggtggcatgcccgttagctcctcgggaaacacatccggaaagtccgacacaaccttgatagcctcgagcgggttgggctccttactatcaactgaaatctggtgacagactccctcttctgacttaggcatccttagctcggccactacctcttctcctgacggggacttcaatgttatggtcctcttgtcacaactaacatttgcttcatacttcattaaccagttcatccctagaatgacatctatcccaggggtgcctattactattaagtcactggggaatcctatcccccttatttccaccattatgtttgaacatattttatctgtttgcaccttgccaccaaccgaattaatcctcatgggtggcatcattgcctctactgagatgttatgcaattctacccatgttgcagtgacaaatgaatgagttgcaccagtatcaaatagcactttcgcgggatgagattcgactgagaacatacctactgccacatctggtgcatcctggatcgcttcggcctccaagtggttcacctttccgcggttgtacgcttggttacgattgcctgctgccggctgcagtacaccttgccttgcgggagcattggggttggtctgctgctgcgccatcttctttgggcactgcatcgcccagtggccttgttctccacagtggaagcatcctctgcctcctcctggtgctggggctgcttggttgctctgattcactgctggggcaggaaggcgaggtgcct

SEQ ID NO: 23961 - DNA, 2326 bp, Zea mays
gttcataaagaatgctggcgcattggtcaaaccaaaagacatcactgtgaactcatataaaccatacttggtaatgaatgccgtcttcggaatgtccgaaggtcggatcctgagctgatgataacctgacctcagatcgatcttggagaacacactggctcctctcaactggtcgaacagatcttctattctgggcaagggatacttgttcttgatcgtgacttcattcaaagctcgataatcgatacacatcctcttggtgccatctttcttttccacaaataggacaggggcggcccaaggcgaggtgcttggccggatgtaacctttctctgacagctcatcaatctgcttcttaagctcatccaactccggtccagatattctgtaagctctcttggagatgggggcggttccaggaagaagctctatagcaaactcaactttccgctctggtggcatacccggtaaatcctttggaaacacatctgggaattcagacacaaccttgatactctcaattgggtctgcttcactgctatcaacagccatctgataacaacttcctttctttggctcaggcgggactaactcggtcaccacttcctctcctagtggggacaccaacttgattgtccttttatcacaactgataactgcctgatacttatctagccaattcatccctaggatgacatctattccctgagtacccattactataaggttggcgggaaacgctatcccccttatttccacacttacattcaaacaaatgctatcagctcgaattctaccaccggctgagtcaatttgaatgggggttgacatggtagtagttggaagattatgtgcttctacccatgatgcagtaatgaaagaatgtgttgctccagtatcaaataacacttctgcaatatgggaatcgactgggaacatacctactgtcatgccgggggtctcctgaactgcttcagcttccaagtggttcaatcttccatgattatagcgctgctgagagcgattgcctgctccaggctgagacacattctgctttgctggggcattggggcctgactgctgctgggctgccttcttcggacattgcatcacccagtggccttgctctccacagtggaaacatgccctgtttccaacctgagctggtgctgcctgactgttctgctgatttgctggggcaggaagacgaggtgcttgctgattctgcttctgaaactgacctcctgactgattgctctgacggttctggtactgatgctgaggatactgcctttggaactgctgatactgctgacgctgctgatgctgctgaggtggacgctggttctgcctgaactgctgaggttgattgcctgagaaacggggacggctgctgcttccaggctggggtccactgatcttgcgcttacgatcttccatctccttgcgcttcctttctgtcatgattgctctgtcaatcaggtgctggaatgtcgggaaggtgtgattcatcagctgatactgcagagggtcaaccaagcctctcaggaaacggtactgtcgcttggcgtcggtgttgacatcttcaggagcatagcgagacaattgcagaaacctgtcccgatactcactgacagacgatgacccttgcttaagggccaggaactcctccttcttcactgtcatcagacctgcaggcacatggtactgacgaaagctacctctgaattcttcccaggtgatggtgtcggggttggcatgggtggcgaggtaagactcccaccatgactgggctgctcctctcaacagacggggaccatacagaactttctccctgtcatcgcactgagcggtatgcaactcccgctccacagggcgcagccaatcttcagcatccatagggtcagaagaatgagcaaacgttgggggatgacctctcatgaattcagcacgcttgtctctgggcatctgaggcatctgaggctgaggtggagcctgctgctgctgctgctgaatggcggccagagtctgaccgatggcttgaactgcctgagtctgcatcagaaacatctgctcaatcgacatcgggggcgggggcggcagctgctgctgctggggcgcctcatcttgctgaccggctcgctcctgctgagcacgccttcctcctctgcgcctgttctctgacatctgcagaacgcaaccacacatcagaactgatctggcaaatcttgcagcataagaaaagagaatagaattcctcaacagcactgaacagatgagcatcttcactgatctccaacacaggccacacagctctcagaaaaag

SEQ ID NO: 23962 - DNA, 2307 bp, Zea mays
atcctcaaatgacttgcatgctcttcttcgctttgagaataaatcagaatgtcatcaatgaatactaccacaaacttatcgagataatccatgaatacactgttcatcagattcatgaaaaaggctggtgcattggtcaaaccaaaagacatcaccgtgaactcatacaacccatacttggaaatgaatgccgtcttcggaatgtccgaaggtcggatcctgagctgatgataacctgacctcagatcaatcttggagaacacactggctcctctcaactggtcgaacatatcttctattctgggcaaagggtacttgttcttgatcgtgacttcattcaaagctcggtagtcgatgcacatcctcttggtgccatctttcttctccacgaacacaggacaggggcggcccaaggcgaggtgcttggccggatgtaacctttctctggcagctcatcaatctgcttcttaagctcaaccaactctggtccagatattctgtaagctctcttaaagataggggcggcgcccggaagaagctctatggcaaactcaactttccgctctggtggcatacccggtaagtcctttggaaacacatccgggaactcggacacaaccttgatcctctcaattgggtctgctccactgctatctacagctatccgataacagcttcctttctttggctcaggcgggactaactcggtcaccacttcctctcctagtggggacaccaacttgattgtccttttatcacaactgataactgcctgatacttatctagccaattcatccctaggatgacatctattccctgagtacccattactatgaggttggcgggaaacgctatcccccttatttccacacttacattcaaacaaatgctatcagctcgaattctaccaccggctgagtcaatttgaatgggggttgacatggtagtaattggaagattatgtgcttctacccatgatgcagtaatgaaagaatgtgttgctccagtatcaaataacacttctgcaatatgggagtcgactgggaacatacctactatcatgccgggggtctcctgaactgcttcagcctccaagtggttcagtcttccatgattatagcgcggctgagagcggttgcctgctccaggctgaggcacattctgctttgctggggcattggggcctgactgctgctgggctgccttcttcggacattgcatcacccagtggccttgctctccacagtggaaacatgctctgtttccaacctgagctggtgctgcctgactgttctgctggtttgctggggcaggaagacgaggtgcctgctgattctgcctctgaaactgacctcctgactgattgctctgacggttctggtactggtgctgaggatactgcctttgaaactgctgatgctgctgaggtggacgctggttctgcctgaactgctgaggttgattgcttgagaaacgaggacgattgctgcttccaggctggggtccactgatcttgcgcttacgatcttccatctccttacgcttcctctctgtcatgattgctctgtcaatcaggtgctggaatgtcgggaaggtgtgattcatcagttggtactgcagagggtcaaccaagcctctcaggaaacggtactgtcgcttggcgtcggtgtcgacatcctcaggagcatagcgagacaattgcagaaacctgtctcggtactcactgacagacgatggcccttgcttgagagccaggaactcctctttcttcactgtcatcagacctgcaggaacatggtactgacgaaaactacttctgaactcttcccaagtgatagtgtcagggtgggcatgggtggcgaggtaagactcccaccatgactgggctgctcctctcaacagacggggaccatacaagactttctccctgtcatcgcactgagcggtgtgcaactcccgctccacagtgcgcagccaatcttcagcatccatggggtcagaagaatgagcgaacgttggtggatgacctctcatgaattcagcacgcttgtctctgggcatctgaggcatctgaggctgaggtggggcctgctgttgttgctgctgctgctgctgaatggcggccaaagtctgaccgatggcttgaactgcctgagtctgcatcagaaacatctgctcgatcgacatcgggggcgggggcggcaggtgctgctgctggggcacctcatcctgcggagcggctcgctcctgttgagcacgccttcctcctctgcgcctgttctctgacatctgcagaatgcaaccac

SEQ ID NO: 23963 - DNA, 3061 bp, Zea mays
ctgccggatctcgttgatcttcttatcatccttctgacctttcctgatgtcttgctctagagtgggctctagctcaattgtcactccttgggtgttgttcagaaatccgagactcaacttgtcgaattcgttcgctagctcatatggcatcacgtgagcggccaacatgttgacttgactcttcctgctaagagcatctgcaactatgtttgctttgcctaggtgataatggatctccaactcatagtctttgatcaattctagccatcttcgctgcctcatgtttaactctgattgagtgaatatgtacttgaggctcttgtggtccatgtagatatcacacttctgcccataaagataatgtctccaggtcttcaatgcatgaaccaccgctgccagctccaaatcatgagtaggatagttcttctcatgaactttcaattatcgagacgagtatgccactactttcccttcctgcattaacacacatcccagtccagtgtacgaagcgtcgcaatacactgagaatgacttgtgaacatcaggcaggactaacacaggagttgtagtcaatctatttttcagttcttcaaatgcttcctgacacttttgagtccatttaaactcaaccttctttgctagtaactctgtcattggcctagcaatctttgagaagccttcaatgaaacgcctatagtatccagccattccaatgaaactcttgatcccacgaacatccttcggtgctttccagttcaggatatctgctactttctttggatccactgctaacccatcttgatttatgatgtgacccagaaataagacttcatgaatccagaactcgcatgtactcagcttggcatacaactgatgctcttgtagcctgtgcaataccatcttcaaatgttccgcatgttcttcctcactttgagaatatatgagaatatcatcgatgaacactaccacaaacttatcaaggtaatccatgaacacactgttcatcagattcatgaagaacgctggcgcattggtcaaaccaaaagacatcactgtgaactcatacaacccatacttggaaatgaatgccgtcttcggaatgtccgaaggtcggatcctgagctgatgataacctgacctcagatcaatcttggagaacacactggctcctctcaactggtcgaacagatcttctattctgggcaagggatacttgttcttgatcgtgacctcattcaaagctcgataatcgatacacatcctcttggtgccatctttcttctccacaaataggacaggggcggcccaaggcgaggtgcttggccggatgtaacctttctctgacagctcatcaatctgcttcttaagctcaaccaactctggtccagatattctgtaagctctcttaaagataggggcggttccaggaagaagctctatggcaaactcaactttccgctctggtggcatacccggtaagtcctttggaaacacatctgggaactcggacacaaccttgatactctcaattgggtctgcttcactgctatcaacagctatctgataacaacttcctttctttggctcaggcgggactaactcggtcaccacttcctctcctagtggggacaccaacttgattgtccttttatcacaactgataactgcctgatacttatctagccaattcatccctaggatgacatctattccctgagtacccattactataaggttggcgggaaacgctatcccccttatttccacacttatattcaaacaaatgctatcggctcgaattctaccaccggctgagtcaatttgaatgggggttgacatggtagtaattggaagattatgtgcttctacccatgatgcagtaatgaaagaatgcgttgctccagtatcaaataacacttctgcaatatgggagtcgactgggaacatacctactatcatgccgggggtctcctgaactgcttcagcctccaagtggttcagtcttccatgattatagcgcggctgagagcgattgcctgctccaggctgaggcacattctgctttgctggggcattggggcctgactgctgctgggctgccttcttcggacattgcatcacccagtggccttgctctccacagtggaaacatgctctgtttccaacctgagctggtgctgcctgactgttctgctggtttgctggggcaggaagacgaggtgcctgctgattctgcctctgaaactgacctcctgactgattgctctgacggttctggtactgatgctgaggatactgcctttggaactgctgatgctgctgaggtggacgctggttctgcctgaactgctgaggttgattgcctgagaaacgaggacgatgctgctgcttccaggctggggtccactgatcttgcgcttacgatcctccatctccttacgcttcctctctgtcatgattgctctgtcaatcaggtgctggaatgtcgggaaggtgtgattcatcagttggtactgcagagggtcaaccaagcctctcaggaaacggtactgtcgcttggcgtcggtgttgacatcttcaggagcatagcgagacaactgcagaaacctgtcccggtactcactgacagacaatggcccttgcttgagggccaggaactcctccttcttcactgtcatcagacctgcaggaacatggtactgacgaaagctacctctgaactcttcccaggtgatggcgtcggggtgggcatgggtggcgaggtaagactcccaccatgactgggctgctcctctcaacagacggggaccatacaggactttctccctgtcatcgcactgagcggtatgcaactcccgctccacagtgcgcagccagtcttcagcatccatggggtcagaagagtgagcaaacgttggtggatgacctctcatgaattcagcacgcttgtctctgggcatctgaggcatctgaggctgaggtggggcctgctgctggctgctgctgaatggcggccaaagtctgaccgatggcttgaactgcctgagtctgcatcagaaac

SEQ ID NO: 23964 - DNA, 832 bp, Zea mays
  misc_feature (825)..(829): n is a, c, g, or t
atacgcttttttttggtttttttttaagcaaaagaacgcaccctgtattgagagataaaaagcaagaacaagagcttcacatgaatttggacgtctacagactacatccatgacccaactgccagatgtccctccacatccatcctggaatctatccaactgccaaatttccctccacaaccatcctggaatctatcagatatcagatagaatttagaaaaatcaagagtttgcttgctcttgctcccagggcgtctggatgagagttcttccatccaggataagatgaatacagcctaacacagtttgcaatatgatcagaacagctccggatcaggtgatacactgataccccgttcaatccttgccgaagtcagcactgtagtgcgcactggactcgagcttcttggcatcattcagcttgcgcacagccttcatgaagtcctcgtgaatgacatagtcacgctccgctcggatagcagccatgccggcttctgtgcacaagttgcgcatatcggctccattgaagccctcagctagtttgactacagcttcatagtcaatctccccatgctttgcgatgccagctgcatgaatcttgaggacctccatcctcccttgttcattcggcagtgggatctcgatcttcctgtccaaccgaccaggtcgaaggagtgcaggatccaaaacatcaggccggttggttgccatgatcattttcaccttcccaagctcatcgaatccatctaactgatttagaagctccatcaatgtcctctgaatctcacgatctgcacttggccctggccccaaattctgccgccnnnnnacc

SEQ ID NO: 23965 - DNA, 800 bp, Zea mays
ggccgctgttttttttttttttttagagcaaaaaatacctcttgatactcatgttcttacagaaaatgtatgttgaataattaagaacatgtcataatatggaattgatgcaattacaggaaaagaaaaataatattaccagagttacattgaaggatatggacagaaaagcataaaaagtagctagtttactgtgaaatggtaaattttacagtatggttgacttcctcatttgtcaataggaggttcttcaagccacttggcacgaaaacctgtcccttggcaatcagcacaacttgtgaagccctttccagagcatatcacacattttgaatttcttgagggtacttcacacaatatgttgtcaccaaggataaagaagcctgttcctgcacaccacttgcactcaacgtggccagcagattgacaggaagagcaagaaactggtcttggttgctgggagattagccaggcgcgctctatacgcttggtgaagtcggatgagctcccgggtgagtcgacggtggaggccatgggagcgaggagccggcgccttggagtccgccgagaagagccagtgaaaggcttccggaggcttccaggaggggtggggcgacgggggcatggggtgaaggctgccccgtgggccccgcagatggtcgccgccggcgtctgcatcgcacggagggacacctccggcgcttcgcttcgggtaggagagaggcgcggcggcaggaggcagggtatcgtgggcctcctgttcccactgggtccactggttccccggaccgcgctcccgg

SEQ ID NO: 23966 - DNA, 1993 bp, Zea mays
aacctctaaacaaaggaatgacgatctttttcgtgcttttttgttcccgtttggctaccaaggaacgagctgctaacgctcatgttcaaagaagaaactggaattccagctggcatgttctaactctagatttgttcagccctatgttgtgacagcacaccctgacacccaggcaagagactgtgaaggggcacaaagattaaaagtttatgacaactaatgcgatggtatatctgatacaaaggcttaaaggtagtagtcatgcaataggtcacttaaaactccactagaattgctggcgacaagtagtcacaaattttgcataggatagagggaaaggggagcagtcaagtgaaccaggagcatcctcgtttcacgttggtccatttacatctagcgtcgtccccggggcttcgaccttcctttggatgcaccaccaaagctggaacctgaagctgtagctccacctccaaacggtgtagaaaatagagatgtcccacccaaattagatgtagcgctagtcccaaatccaggagctggcgtcgatgctaacgtaggagtggaaggtgtcccaaatggtgtggtcaactgagccgatcctggcgcaccaaaaaggttgcccgatggagctggagttgttggagttgcaaacagactagacgaggatggagcggaagccggagtgctaaaggttgagaaggcgcttgaggaagtcgcagcggacggaaaggaaggttgctgcggttggcttgtagctggtgcagcgatctgtgccgtgggctgcgcgggggtaggcagatgcagtgttggatggacccttctggcagctgcttcttgtttagctgcttctcgtctgtttgcctccagaaatggatcgctcccgttgccggtgcggcgttgttcattgagatattcagttttcattgattcgacatgttgatgaagattttccaccttagaagcaacatagatgaagtaatcatgcacatttgacataacttttggaagagattctagagaatctgatgatcttttatttgtctccatttgaacaagctgctctagctccccgatccacttgcaacactccgcaagatagcactcaaacttgttgacagtgcgctgcataaaaatggaaggacgctttgggactccactgtagaaatctaccactggctgattgggtggagcaccagcagaaggatttgaagaaccgccatttgcaactccagcacttggacgggtgaatcttggcctcaacatcagatatgacctaataccaaattctgtgttccacatcatttcattgacaacattcatcaactcttgaatggaagccttctctctctccattacagtggtggtccctccaagttcctgagcaatgcgactcgcatcaagctcaaaattggcatttgagattgaggagtcataaaggcgactgcactggtccaacctctcacactcgtctttgtagtcccgtatcttgtcctcgatctggagtaaggccttctgcgactcggcgtgcagctcctcccacttggtgctgtatcccgcagatttcatatctgtcgtgtacagcatcagcttctgcggctgcggctgcggctgcggctgcggaggttgcgccgccggcgccacctgctgctgtggctgcggctgctgctggaagctgaactggaacggcgaaggcgatagggatggcgcctgcgaggtggccggagccggtgtttgaaagggattcggcgtcgccggcgtctggaaagggttcgacgcagccggcgaggcgaaggagaatgccattgccgcgtgcggagacgaaggggtcggctccggcgatggcggaaagtagtggagatgtgccggccggcgcacggcgggctcggcaagctctttaaaccctagaaaaccgggaggactggagtggtagggcgatctgctattttaccggattcgaaattccaggctcgtttggttgctttagttttcccgc

SEQ ID NO: 23967 - DNA, 6798 bp, Zea mays
  misc_feature (2585)..(2585): n is a, c, g, or t
  misc_feature (6126)..(6126): n is a, c, g, or t
gaatgtgcttgagtaagcttttccttggatgttttttgtttgaaagattaattgagaggaggggttgccattgccaaaatatcaattcatttagactgtgtctagcaattcacacatatggtcacccaaaacgatgttttatattgtatattgcactgtttgcaaagtcgagtttgaatataattacgagatggataagctgtcgaagatagccttatgcatcagtacataaacaagtccaaggtacatagtcaggaaacaaaaaaaaaatgatttttgcttaatactactttaaaacaaatttaaagcaacccaaacttatttatccttgtccgggcgctattattctcaccctctctcctcggtaaaacaagatgagtagcacttgaaagacccagacaccaaagtacaaagccctaataaataaaagggtactccagcaccggttcattgggaaagggagcccatgcacctcggaatttggaggcggccacatctgaagccagttttttagtgcatccaatgggggtttaaaggagttcaaggttgcagacacgaggtgggaattggtgcaggcctccacatgcgcgcagctagcagctctgtgagttccaatccccctcccgccagcctcgctgtctgctactgtgtgtgcctttggaccacttttagggttagggtttcaccccttgatgacaaacgccatccctttctctctttcccggagagactcttgtgtgtggagtcttctgacttctcctcattgttggcaagtcgcaggtagccacgcactgaaaccaaccaaccatccatgggaagaagggcgtgcgtcgttcagaaatgagcgtgtgtgatgaaaaggagtggccgccgcaggagccaggaccgtgagtgcgtgaccctaatttgaagcacgcagaaagcatgagtgagaagaatgcatggcaactgtgcagggaactggccgccatagttctcaggcggttctttacaaagtccggccagccagccaggaactgctgcaaatagcaccagatgaggctccaggccctgcaaacttgccagcactgttatcctttttatagaacactggtaagtgtcgcttgttagtacgtgtggaaatgttgctctcggctctcggtttcaaactgctcagagacattcatgtctgcatcgtcgtcgcacaatgtgcattattaggcagttcatcttcttaattagtgtgataaattccctcaatctggcgacgtcgcgacgacacatatatatgggcattcgctgagtgcagtagatgacattattatcagaaaatttaatcccctaccatgattccttcagaaattgtgcttaacaactgtcaccaggaacaatgcttggattaatgaccatagtaagcacacacatgcatgctatatataacgacatgaatatcgaagggtagatttaattgcttgtaatcgatgcaaagatacatttaccaatcaacaaacaggcggcggtgcataagctccagtgaaacacatgcaccctttatttattgatctccaattttctggtaacactaagctcttgattaacatgtgttacagctgatgctgctactgtgacatacaggaacttaacgatggttcttgagagcattttatgtctattgtttaaattcaaaacagcatcaattagcatgactctcatatataagaattattggagaacatcacaccttataggacaacacacgagcgaggtctggaaggaaggaatactgactacacctagctagatcaggccaaaagatgctacacaagtacacataatttatacaccgacaattagaagtaagtaagtaataataacctgaaactagaaattgtaatgataattaataaaaaaccattttattttaaacagttttatttattgataaactgcataatgaatatcacgaaaggtatacttatgaaataagtatatataaacacatatgataccagcaatagtacaagtagaaccctctgtgaatagacattatatcaagtttattgttctgaaacaattagctacgtcgtcaatcactagcagttaaacacttacagacagaatactcgactggcagctgcgtcagcagctgttcgtactgcaacagctataaccgtagagataaaatactgtagagaagccataataaccgcagctagattaaagctgcagcaagcaaccgtgagacaaaatactgtagtctcgcgggagtattgttcagaaaataccagggatcgttctcttcatgtcttgcattgggacagaaaaaacactgacttgcgtgccaatgaacaagaacggacaccccttttcaaatcacaggaaaaccaagccagcagagtgtgtaaaatagggatgacgtggaactgtagatgacactgtttgatactatttgtatagaagaaatcccggccggcctcgggggtcccggatctagatagcctggcatatgcaggttcgcatactttcgcagaccgaatgctgtggtgaacatgtggaaaagacatgctgatgtggatcacaaaatcataaacactaacaccatgatnttttttttttttttttcaagggaaaggacagatgcaagtgcctaaaacagcctcgttcttctcttatcggggacatccatgagggaaaaaaaagcatcggaaacctgatgatgattcagtccaagtggtggccatacataatgctccaaataaaagcacagggaggatcggagtgctatgctagtacacatcgaatcactagctctagttgcatgcaaagttccaaagcaaacagggagttcgaaagacgtttcgctgttgcacgacacgaaccgaacgaaagttgcgtcgttgtgattccacagattcccacacgcaccagaaaagctagcatgcatctcgtttagtccaagtccacaacagtgcacaccatcttcttccacagatcacggaaagacggcagaaacctgcagagacgatgcatggatgtatggatcccatcccatcctgtcctgtaagatctacacacaacaaaagcaaatagactttgtatctccttgatgtattgcccttggttattaataataaaaatgcttcctttataaaaaacaaaaacaagcaaagcaaatgaagtttgatctccttttcttttcttcagaacgaaactatgggatctctttttttttggaagagaacaatatatgtgtagattcaacgagcagatcaaggatttagagctagtttatatatcaaaagcgcaaggaaagtacaaaaaaaggctttggatctccattatatatacacacagaacgtaactgctatataacaattaaccagcagagaagaacagtaagcacgcacatgataagggactaaataaaataggcccgtcgttttggcagctgctatgtatggtatgcatcagatgccaaccaaacatgtaagttaagcagctcaagcaaagacagaccatgaagctagtaaaaccatgatatatgacgaagctggtgcatggatcgataaaggtaaacaaggagggaggagggagcacccttcagtccaagcaaagacggtgcgagatcgaagcttttacctcccgcttcattcactcatctgcaaagctggtttccatggccgtttgcttggcatgtgggtgaatgagtcggcagctaattcgaccctagcaccgcccctgagtggactgaaggacgctctcttccacccagccatcgtcgtcgcaactaactaaccatgacggcggcggcggcgacaaattaaacccaacaacaaatcaaaagaaaagaagaacaagcatgcatgcatgatgcacaaccgcgcttgctactgctgcttgatcgatccgtctgagcacctcatggcgtgcagtgttcagtttctccctggatctcgcgaagaagaaggcagatgggttttcgatggttgcaaggaaggagcgagcgagaaaggaaagtagacgacggcaacgcacacacaaggccattaaatagggccaaagttgtgacatcacagcaggcagcgtattcctagttaaataatgatcgtaatgtacgtactggtggtagcactacggtatacttctatacggagtatataagaagtgggcgaagggccaaaacctctcgcgcgtgtcgtttcctggcggcgctccctagctttgctcgtaagcaagagatgaggaggcgacacagggccagacaaaggggcccaaaggccaaaccctaacaggatacggctcaaaataatgcactgatagctagtgtggtaggcctgcattcttttggtgtcaaagtctagcgacattattgctgccggtttactgtgttatgtgttgctttggatcgatggttaactgattacagcagcggctccgtgctgggttcgtggccgaaatgtagatgtgcaaggcgaagcagcactaatttcagccctactacattattatatatacggtactattagattgtttgttttagtattgactaaggggccaagatcggatcccgtgtgtagtgatgggaaaatgacaatccatctatccatgggagagcgaaaggatcgatgtgacatctagagtgaaggtgaatgtatataggctcaacgacaacggaaagctataatttatttaaacaaagtttgcatataaattgtacagaccgatttatttcgttggttatctgagattagaaaaaagatatatatctccaaatttagagtttgtaggattcgaagatacaaggatacgcaattagatgggatgaatgactgcggaacctcaaaaataattataatacttcctcctaattgcaaaaccaaactagttcacatatctcaaaattgtacaaaactctattctgttagtaaaaataagattgttcaaaatccgtaactccaatcaatctgaagtgtcatcagattaaactagataagattatgcaactaacacaactagaattatgtagatcgaactttcggacatatatatagagatagtaacgaaacaagatagctgtgacagaatatgatcaaaattaatcaaaccctaattttgagattaaccaaaaaccataaaagattaaccaatcaaacttcaccagtcgctaacttgatgctctagcaataatctagatgaaagaaatcaagagtattacttaaaattaacaaatcaatctagaattaaaaaaactattcatgcaaataatgagcaaagaaagtggaaccagattactacactaatcttgtataaacattaactttattaccaaaattgtgtctataaattactctccaaagcaccacgaagatttcttcacgagatcccaaaaacactagactaaaacttagttttggatctaatctctgtcacaaaatctgctaagaacaagatgaagtcactatttatatataggcatatgggctgccagactccaggtcaccaagccgcacgcctgggacgatatctagctattacatgcacgtcttcaacttttgtaaccttcgtatgacatccttgagcaataaaacctcaattccttactgaacttagttctaaatactgagtttctcttggacctagctttagttcgttaccgaccacgttctatctcaagcaacaccagcacatgaacaacacacgttattgtgtacgagcacaaatccatgacttaactcaaaattaaactatccaacaccacccctatgagtgtgttatatcaatatcgaaaccatacattagcacacatgtacaataccctatataatgttaatcactttgcaaagtcattttcaatctaaattaatgtttcattacacgtgatttcacaatctctcccttgatagaaatattggcaagaccacacatacattgaatattggtattcactttttttgattaaaacacaaaatctttagtgccatgaatatacccaaaaatctatttgatagcttatagatgtgaagcacatggagaagcttgaaaccgagcacataaacacacaacaaattggacatctagtctcgaagtagtgagataaaataacaaaccaatcatactcttatactccttttgattaactgactcacnatcctcatcaggatcaagtgttgctgtagttcccatgggtgtcatcatagtattgcaattttctattccaaagcgatttagaagatccttcgtatacttactttacccttatttgtttgtttgatttgcaatcctaaaaataggtcaattctcctatcatactcatttttaagttccttactcataatttctaaaaactaagacaccaaatcatgagataaacaaccactgaaaataccatccacataaatttgaatgaataagtgatcattgccttgcttgaatacaaagagagttttgtcaattttcccatagaaaaaccatttttagtaaaaaagatttctaatctatagcaccattctctaggagcttgttttaagccaaatagagctttggacaatttataaacatgatctggatgtttagaaatttcaaaaccagatggttgcttaacatagactttcttataaaatgtcaattataaaattacttgagataacaatttcataaagtctaaaacccttagaagtagctaagtccaaccaattctagactttctatttgcataataccttaagcaaccaacctaactttgtttctaacaaccacaccatcctcactttgtttgtttttaagaacccatctagttccaactataaaatgattaggatg

SEQ ID NO: 23968 - DNA, 1575 bp, Zea mays
taaatcataaacactagctaacaccatgataaatcacaaatatcatgggaataggggcaaaagaattggaaacctgatgattcggtccaagtagtggtggtcataatatgctccaaataaaagaaaggtggaggagcatctcacagacgacacagctgctatgctagcacacgtcgaatcaatagctagttgcatgcaaagttccaaagcaaataaacagggagatcgaaagacgtttcgctgttgcacgacacgacgaatcgatcgaacgaaagtgtgtttttatgatcccacagattctcgtttatatatagtcctagctactagctagtctagaacgtacagtgcacaccatcttcttccacagatcacagaaagacagcagaaacctgcatggatcggatccggtcctgtcctgtaagatctacacacatgcaaagcaaatcaatttcttccttttcttttcttcagaaactgggataactttttggaagagatcgaacagtatatagattcagggagcagatcaaggattatatatatagctagtatgtgtacatatcaaaagggcaagaaaagtacaaaaaagcatcggatctccattatatatatacaacagctatataacaaccacagaagaacagtaagcacgcacatggtaaaattaaaatagcctggcccctgctatggatgtatgcatcagatgcctaatatatatgcaagataataattaataagcagctcaagcaaagacagatcaagagttcgagacagcaggttggaaaataaaatacagatcatatgaagtaaaaccttgacttgagatacgaatgatgaagctgcatgggtaaagtaaacaaggaaaggatcggagggagcacccttcagtccaagcaaagacggtgcgagatcgaagcttttacctcccgcttcattcactcatctgcgaagctcgtttccatggccgtttgcttggcatgtgggtgaatgagtcggcagctaatccgaccctagcaccgcccctgagtggactgaaggacgctctcttccatccggccagcgaccatcgatcacaaccatgacgcccggcggcaaatatattgacaagaaatgaaatcaaaagagagaggaagaacaaacatgatgcgcagctgcgctagctagtgcttgatctgtctgaccacctcatggcgcgcagtgtttagttttctccctggatcttgcgaagaaggcgatggattttcgatgcttgcaaggaggagctgaccgagaaagggtttatataatatggcggccccggcgccctggacaaggccattaaatagggtcaagtaagcattataagatgtgtaacttaacagtgtgagaagaaacaagaggggagaggagacacagggccagtcaaaggggcccaaaggccaaaccctaacaggataccgcccaaaaacaatgcactgatagcgtggtagaggcctccattctttggtgtcaagtctagctagtggcatgattactaccggcttactattatgtgctttggatcggatggttaactgatatattacagcaggtttg

SEQ ID NO: 23969 - DNA, 6780 bp, Zea mays
  misc_feature (5709)..(5709): n is a, c, g, or t
  misc_feature (6410)..(6410): n is a, c, g, or t
accctaaatctcattacaatatcattggctgatttagtattgaactcaattcaatttcatgccctccaatattgatatccaaacggagcattatgattttttgaattgaatcttgagttggtactgcttgtattctttactctagatgatgaccacccaccatagaatgacttagcaaatctttattaattgttaagttattcgcgatttttgttaaaccattacagaatgagtgatgatcacccgagagccggatgcaggggcgcaagcgcgttaactgaattccaccgaatccaaccatcagagcactcgatatctacatctgcggctgttgcctgctgggtggtggccctggcctgccccagcccccaggacccggccggccgcagtaggtggcaacgaaacaagaaaaatgaaaatggcggtggatttcatctgaagcaaggctttcactccggcacaggtgcaccgtgcacaggcacagcacggtcgggcgcctgcgccgtccgagctcgaagtcacccgctgtttcggcggttcggtccttggagttgcacctacctttttctttcctcacgctcatggcgtgcacgcatgacgcatggccgcggcgatttcactctcgagagctagccgaacacatggcttcggcgatggacctcttggcctgggaccggccgctgcagaaagaaaatgatgaagctgacgtgcggtggtacgaccaccgaccacgcaccggcacggtggacgtttgacctcgtctgttgctgcaccggtggccactgcccggcgatctttgagcctagctagctagtttgaatacgaagagatacggtgcgtacgtacagcgttgttggcgaaaggctctcagggacaatagccttggtgtgtgcaggcaacatgttaggttagttacaagagatgaattaagtttgttggcggaagagatcaatccaatgtatgcagcagctttggcttagcttgacttgggatgacaataatgacattaattagcctacgaggagaaattttcatttctaaacaccatctgctcgtgaatttaacattttaaccgcatcgctgcaaattaaatctgcaacgctgctagcagctagctccctagtacaaccaacaaccctatgaccctcagggctcagccaacccaagcgataaccatcttactcttcagtactctctctagctcctctcctcgatgtatataaaggcacgcaaacatctcacagttgtccacataaataacacacaaagttgtccgatcaaagcttgcgcgtttacaatgtctggacgatcaaggcacttcacaatgtccacccttctcgctacgagcttcttctttgtactcctatgcagctcgctacaaggtacggtgatatatagttccttcaattccccgtttcatatcagctaattgctcactcaccgtcgacgtcgtatatatgatgcatgcatttgcacgcgtgaacaaatcaaacatatatagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcggggcgtcgggtgggacctgggcgccgccggggcggcgtaccggtgggtggaggacgtggtggcgttccagccggagctggggccctggcaggccgcgctgcagggcggcctgctcgaggccggggtcgcgccggacaacggcttcacgttcgaccacttcgacgggaccaaggtcggcgggtccatcttcgacgccgacggccggcggcacacggccgcggacctgctgaggtacgcgcgcgccgaggggctcgacgtgctgctacgggccagagtggccaagatcctgttcttcaatgtcagaggtcaggacgtacgtactcgagtaaaatgcttttaccgcttgccgacgcatgctggccaccgcagtctgcctgcgttgcgtgtcgtaccagccgaactgactggcggttacttcgcttcggcgccagggaggagatcagggaggcggacagcggcacgcggcgtggtgttccacgactccgaggggcggatgcacaaggcgttcctcagcgcgggccgccggaacgagatcatcctctcggcaggcgccatgggcagcccgcagctactgatgctcagcggcgtcggcccagccgaccacctccgctcgttcggcatccccctcgtgcgcgaccaccccgcggtcggacaggggatgtccgacaaccccatgaacgccatctacgtgccgtcgccttccccggtcgaggtctcgctcatacaggtcgtcggcatcacccaggtcgggagctacatcgagggcgccagcggctccaactggggcgtccgccactctgcctccgggtccgggccagacggtgtccaccggccgcgcaacttcggtatgttctctccacaggtaaggttcttgccacgtgcggtggggtgatgctctgcgaacctcaagcccctacacgcagacgcagttgcggttttgttagtaactactgctgttcttgcagacggggcccctggccacggtgcccccgaagcagcgcacgccggaggccatcgcgcatgcagcggagtcgatgaggcagcttgacgactccgccttccgcggtggcttcatcctggagaaggtcctcggcccgctgtccacgggccacctcgagctgcgcaaccgcgaccccgacgacaacccgctggtgacgttcaactacttctcgcaccccgaggacctccgccgctgcgtggccggcttgtcggtcatcgagcgcgtcatccactcccaggccttcaagaacttcacctaccccgacttctccatggagacgctgctcaacatgtcgacggggttccccgtcaacctgctgccccggcacgacaacgactccacgtcgcttgagatgttctgcaaggacaccgtcatgaccatctggcactaccacggtggctgccaggtcggcagggtcgtcgacgctgagtaccgagtgctcggcatcgacgcgctgcgcgtcattgacggctccactttcaacgcctcgccaggaaccaacccgcaggcaaccgtcatgatgctcggcaggtaatccctccctgcttacacctgtgatgttttatcagcgcactttgagcacttctccaggacaggccctagtggtactgattcctgtctccaaagttgcccttttaggtcgaatcctaccaatcttccaatggatgattgtgtctctaacttggcaggtatatgggagtcagaatcacaaacgaaaggttggcagcggtaccgttagagggaacaaaacccggatgatcctataatccaagacagtaggcgaggcgtattaagaatctctattgaactacgtaatgctggattcaatattgttggtgtgattctgatattgataggttgcacatattgtcggagttgtatcatgttgtttgttactatgtggactattatgagtgaaatctgcatctaagcttcagatcatgtattcttaaccagaacagaaacattagtgaggcagcacagctaattttactgtgtggtcaaatagacaaatgctgtactagacaattgttttctcttaagaaaatggaaatcgccagcagtaagtgtggcagcatcactaactttactgtgtagtcaaagtactgaaccatcggtttgtcttagtaaagtgaaaatcaccagcagctacagttctgtggctagtgccaattgccaaagaagggtctcgatctcgaacgagaaagggaatccgatagtggggtgagaacttcagagagacaaaaccatgagggcaaaagggaaagggagatgttggatgccaagaggatatccatggtttaaaacccttcgaaaaaaatcaagaagtacacatcttatcaaggatatgttcactatataaatattgcagtgccgcagccccacagtgagcagaaaacagtgaggtcaagataagagaggaaagaactcattgtttacatgatcaggaaatggaatgcctaagctgtccagtttcagggcttctctttcttggcagggaagcatgagatgccatagctctctgctctcttcaaccctctgccaaaggagagttgccctgtaacaggactcagcttatggttcacgattgtaaagacagattcaagcttacactgcaggtcggcgtggtaccggcctatggtggtgcaaggtttgaatgcttcgtatttttactggctttattgcatgtttgttcaagcagccaaaggaaattagttgatttcctttttcatgccttcctttgtggtttgctatttcctgaatgtctaggcactggatgcttttggttttctgtttttttttaaaaaaaagtttactgctactttgctaagaagaatttgactgtatggatgaagaatggccaccaccagctcagtcctattgtcatctattttggctatcctctgggtttttattggtataaaattggtctgctcaatcatgtacatggttcactttttcagtaatatcatgattcagtgtcaagatttaacatggttacctaatagttgccaatcaatcatcatggtcactaatttagcaactggggcatgtcaattacctgaacttgtgctgaagaagaatatgccaatttgaataagtctcattttcatctgagaccaattaaagtcggttcaatgtagctttgtcattccacaagtatcataaccaacaacgcccacctccatttctgtagagtttggggcagcagtctccagtccgaatgcatcgccataaacatcatcagatgtagttcagatattccagtcccggcagagcaagcagcgctcccaacaggttttggcacgcaggccccaagttaacaaagggtttaggcacacagacggcagaccccaagtatagccatatcagactgctacaccatggtcatggttcatactaaaaaaaaggaaacccagagaaagcacctctgagaactgtaatactgccggcacagacgctaaggttgtccactgtttcgtcagattagcatgaatataaccacaggatcttactaacttaacaaacatgaacacactaagggctcatttttggtaggaatcgttcttggtaagaacttgctacataaattacccaagcattcctggtaggaatggttccaggacatggtttgctagaaacccgaacgatgcctgattgagtgattaattaactcatagtgactgacctgctggttggtgcctctgtcagtggtgtagatgaccagcgattaccttctgacgcgcgccaggatcagtggtcgtcggtatgggtatccgacggcggctgatggccttcagcttgaggacgtgaccgagatccctagttattggccatgtttggcacagctgctacttgttnaaaaagcagcttatctgataagctggtgaaaagcagcttctgcttgttggctgcttttagtgtattctgagaaacagctgaactgataagctgttgcagaagctagctgtttggcagaacttctgcttaaatttgtgaagaagctgaaaataagctgtgccaaacagggccattgggtcagctacacgctacttattattgagttttttttgttttgctattataaacctcattacatgcaccttcgatgtaatagcattcataatttaggcttcaatataacagcaggctctaccacgtcataccgtcgaaataccgtccaaatagaattatgggctttttcggccacgtgtcagaaaagggctcggacagtgcgacgcagtagaggctgatatatcgaagtccaaattatgaatgctattacatcaaagacgcttataatgaggtttatagtagctataaactccttattatctgttgaagaaactccatctgacgggtgcgagtgctagaattgtatgagaaaagaaacggatcgtgtcagatggaaacggatggcccgagcaaagtggccaagttggcgatgcgcggtgtagagatagcgagtttatatatataaaaggaaatctccattaatttcgtgccatgaccgtgcgtctcatgataaatacatagatctattttttgcccccgtttttcanctatagataggatataagaaaccactaaaaatcaatacgataagaaccataccacgcagcacaacactcctatgtaatatcacatcactaactaaatgaggacgaactataaaaaagctaattttttcagctcatatatttttttatcttggtagctaatatgaagtgtaatattttttttataagtttaatatttaatataaaaaatatatgttctttttaatattaaatttattttttacggatgtcaaatatgattatctctattctctactatacttaaagcaccagtttcaacggtcgtcgtgcgtcatatttttacggaaacatccttcattttttcctactattaacccgccgtcctctccgc

SEQ ID NO: 23970 - DNA, 1955 bp, Zea mays
gagtttaacaccatatccttatgcaatgcacgggtaattacattcagggcatgttcggttatttccatcccatatggattggatgtgaatgagattgattaggagagattttaacttgtttgggatttaaaatcatccaatcccctccaattcacgtgaggccttgttcggttattcctatctcatgtggattggatgagattggaaaaaattatgaaagattttaacttgtttgaaattcaaacccactcaatctcacataatccacgtgtattgagagtaaaacgaacaagccctgaattgaattaaaacgaacagaccctcaattagatcccacactttcatttcacacatgtgatgtacaagaggataaaatggcccgtcggtctctacatagaaaattaaaatgtgattgcatagtgtatatataccaacagcagatacatttataccacagcagatacattaccaatgcaataaccggacgacgataccacatttggctcgctaattacttaatctgagtcgacccatatccctctactaaacatatgttttgccccaaatattagggagcactaacacgcgatgcaaaattcatggagaaaacaaacgaaatccgatgcacaggcgcagccaccgccgcacgtcctcctaccgtgcggttgtgagaggtccagctactccggtggacacttgtgtattgtcgtgccaaacgcgactggcattcgtctccgagccgccttcgttctcatttgtgtaccttcacccacgcggccttgctcggcacgcctttcgctatgacgtacaacaggtagtatcccggcggcgcgagctcaggctttcccggagcgtcgaccgttatcgtgtacctctgcccgttggccgcgaacgcggtgacggacagcaccagcagccgctggttcatggagtagccgtgcgtcgtgaacggtggcgcgtacatggtcacctttaggtcgggctcggccacggcctgcacgggcgtcgagaactggaacgtgaacttggccccgtacgccatgccgtccccggggacggtggccacgtcgatcgcggggcggttggccgcgcgctccggggcgaggtacggcggggtgaagcgctcgacgcgcacctcggtctggaagtcgacgccgctgaagttgtaggccgagttggtgttgctgccggccacgagcacggtggcgtcgggcagcaccgcgctggtggcgtggtacatgcgcgggatggtggtcggcgccagcgcccggaaccgcgagccccgcgcctggcgcggagagtacaggagcgggctcagcacgggctgccgcccgaagccccagccggagcagcccttggccgcgccgttcagaatgagcaggtcgccggtgggcaggatcagcaggtcgcccatggtgcgggccacgggcatctggtccagcgcccaccgagcgtcgggcttcaaggggttgatgcgcgcgcagtccttgagggcgggcgggaacgtgttggactcgccgagcgtgaaggcgttcttgggggagccgccgcagacgatgacctcgggactgaggacgtcgccgcggcggaggtcgaggggcaggagcgccgacatgccggaggcagggtagttccgacccccgcctgggaggacggggaactcgcggacgacctggccgttcctggggtcgaacaggatggagcggtcgttggcgaagatgaacagagtcccgtcgggaaggaggtggacgaacgggtacaggttgttctccacgtcgtcggtggtgtcacggagtatctggaggggaatggcttgggcattcgccggcccgtccgccggaacgaattcgtagctgaacgcacgccggccaccgagcacgatggagcggccgtccggaagcagctgctgcgtcccgtacctgcgcatgcatgcgtggaagacatgccactgtgta

SEQ ID NO: 23971 - DNA, 2328 bp, Zea mays
caaacagaccctcaattagaacccacactttcatttcacacatgtgatgtacaagaggataaaatggcccgtcggtctctacatagaaaattaaaatgtgatttcataatgtataccaacagcagatacatttataccacagcagatacattaccaataaccggacgacgataccacatttggctcgctaattacttaatctgagtcgacccatatccctctactaaacatatgttttgccccaaatattagggagcactaacacgcgatgcaaaattcatggagaaaacaaacgaaatccgatgcacaggcgcagccaccgccgcacgtcctcctaccgtgcggttgcgagaggtccagctactccggtggacacttgtgtattgtcgtgccaaacgcgactggcattcgtctccgagccgccttcgttctcatttgtgtaccttcacccacgcggccttgctcggcacgcctttcgctatgacgtacaacaggtagtatcccggcggcgcgagctcaggctttcccggagcgtcgaccgttatcgtgtacctctgcccgttggccgcgaacgcggtgacggacagcaccagcaggcgctggttcatggagtagccgtgcgtcgtgaacggtggtgcgtacatggtcaccttcaggtcgggctcggccacggcctgcacgggcgtcgagaactggaacgtgaacttggccccgtacgccatgccgtccccggggacggtggccacgtcgatagcggggcggttggccgcgcgctccggggcgaggtacggcggggtgaagcgctcgacgcgcacctcggtctggaagtcgacgccgctgaagttgtaggccgagttggtgttgctgccggccacgagcacggtggcgtcgggcagcacagcgctggtggcgtggtacatgcgcgggatggtggtcggcgccagcgcccggaaccgcgagccccgcgcctggcgcggagagtacaggagcgggctcagcacgggctgccgcccgaagccccagccggagcagcccttggccgcgccgttcagaatgagcaggtcgccggtgggcaggatcagcaggtcgcccatggtgcgggccacgggcatctggtccagcgcccaccgagcgtcgggcttcaaggggttgatgcgcgcgcagtccttgagggcgggcgggaacgtgttggactcgccgagcgtgaaggcgttcttgggggagccgccgcagacgatgacctcgggactgaggacgtcgccgcggcggaggtcgaggggcaggagcgccgacatgccggaggcagggtagttccgacccccgcctgggaggacggggaactcgcggacgacctggccgttcctggggtcgaacaggatggagcggtcgttggcgaagatgaacagagtcccgtcgggaaggaggtggacgaacgggtacaggttgttctccacgtcgtcggtggtgtcacggagtatctggaggggaatggcttgggcattcgactgcccttccgccggaacgaattcgtagctgaacgcacgccggccaccgagcacgatggagcggccgtccgggagcagctgctgcgtcccgtaccatcttccttcggccaggctccccgggaactccctccagtcgcagttgccgcatgggctcaggtacctcacaaccttctccccttcgaagtagccgccggtctgcaccaggttgccctcggcgtcgagcgcgcccgacgagcaccacacgtccgtcaagaccttgagggccctgacaccgcctgtcgcgtaatcaaactcgacggcgtgcgcggcgcagtccttggcgccgacctgcttgctgcggagatcgaggcggcagttccccttgggcagccgcagcagcgacggccccgtggtgaccgtgtcgaacatgatggccttgtcgctccgcatgatcaccaggtgcatcgcggacacgcccgcgttctcgctgatgatggaccaagcgccggggaaccccgcggcgctgtccacggggagcaccaccgtgtcctgcgccaccgcggtgggcgcggaccggggcggcaccttcatgaggccgctcttggtcaccggcgccgttatgaggttctgctggtcgctggcccggggcatcacatcctcctcctggttcgcgttgtggaagtagtcgtgctcattccgcggtttgaagatgttgaggaattcggtggcgctgtgcgcctcgcccacggcggcgagggcgaggagcgcgacggagagcgcggcggcgcggaggagaggacccattgtcggagagaacctcgcggacgcgtgggcccccggccgg

SEQ ID NO: 23972 - DNA, 1165 bp, Zea mays
aaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcggggcgtcgggtgggacctgggcgccgccggggcggcgtaccggtgggtggaggacgtggtggcgttccagccggagctggggccctggcaggccgcgctgcagggcggcctgctcgaggccggggtcgcgccggacaacggcttcacgttcgaccacttcgacgggaccaaggtcggcgggtccatcttcgacgccgacggccggcggcacacggccgcggacctgctgaggtacgcgcgcgccgaggggctcgacgtgctgctacgggccagagtggccaagatcctgttcttcaatgtcagagggaggagatcagggaggcggacagcggcacgcggcgtggtgttccacgactccgaggggcggatgcacaaggcgttcctcagcgcgggccgccggaacgagatcatcctctcggcaggcgccatgggcagcccgcagctactgatgctcagcggcgtcggcccagccgaccacctccgctcgttcggcatccccctcgtgcgcgaccaccccgcggtcggacaggggatgtccgacaaccccatgaacgccatctacgtgccgtcgccttccccggtcgaggtctcgctcatacaggtcgtcggcatcacccaggtcgggagctacatcgagggcgccagcggctccaactggggcgtccgccactctgcctccgg

SEQ ID NO: 23973 - DNA, 854 bp, Zea mays
  misc_feature (750)..(750): n is a, c, g, or t
  misc_feature (758)..(758): n is a, c, g, or t
  misc_feature (780)..(780): n is a, c, g, or t
  misc_feature (822)..(822): n is a, c, g, or t
  misc_feature (829)..(831): n is a, c, g, or t
cgggccacctcgagctgcgcaaccgcgaccccgacgacaacccgctggtgacgttcaactacttctcgcaccccgaggacctccgccgctgcgtggccggcttgtcggtcatcgagcgcgtcatccactcccaggccttcaagaacttcacgtaccccgacttctccatggagacgctgctcaacatgtcgacggggttccccgtcaacctgctgccccggcacgacaacgactccacgtcgcttgagatgttctgcaaggacaccgtcatgaccatctggcactaccacggtggctgccaggtcggcagggtcgtcgacgctgaataccgagtgctcggcatcgacgcgctgcgcgtcattgacggctccactttcaacgcctcgccaggaaccaacccgcaggcaaccgtcatgatgctcggcaggtatatgggagtcagaatcacaaacgaaaggttggcagctgaaggattagagggaacaaaaccgtgatgatcctataatccaagacagtaggcgaggcgtattaagaatctctattgaactatgtaatgctggattcaatattgttggtgtgattctgatattgataggttgcacatattgtcggagttgtatcatgttgtttgttgttactatgtggactattatgagtgaaatctgcaaaaaaaaaaaaaaaaaaaaactcgtaccccggccagaaacattagtgaggcagcatcactaattttactgtgtggtcaaatanacaaatgntgtactggacaattgttttctnttaagaaaatggaaatcgccagcagtaagtgtggcagcatcnctaaaannnaaaaaagaaaataaaaaaaaaaa

SEQ ID NO: 23974 - DNA, 739 bp, Zea mays
ttttttttttttttttaaaatagaagattcatggttcatcacatctgctatagggatatgaaatcaacattataagtcaacgcctgaaaaataattataataacaactggaaataatcagcaccaaagcatcatgcactttcaaatgaatcatttgcctttcagctgatacaatctcatcagcattctgtgatctaccaaaagttcctacaccagaatcacaaggaccaactcgagtggaatacgagaccaggtctgcacctcctgccatccacgttgaacacgatgccaggctgcacggcagcagccttccccagatgcaagttcagaaatccctccacctgaaacagttgcggtttttcctcagtgcctttacgcaagctcacgccccatccaaggtcaccttccggcgtatctgacagtgtgagggcccatctcagcaaacgtgagcttgacttcttgttcaactcgatccaggccccgattctggagtcctcatcaatttccagctcaagaccaacgcaacctccagcagttggtttcctcttccgaggaactacactgggtccatgcaaagcagcagacatggtcaactttatgtcatcagggaactggtacgagatttgcccaaactctgtacagactctgctggcttcaccgctgtttactggcctcgcggcaactgaaatcagctgcccaatagaaacagcgaagttcttcgatctcatattagccgccgc

SEQ ID NO: 23975 - DNA, 2664 bp, Zea mays
ttgaacctggggaatctgtgaccgatgatcgtatattgggtgcccgcatgacaaaggccagccttgttcctccagttactaggaagtatgaagttatcgaggagtaccttattgtagcagatttggaggaagtacagcgaaaaatgagagttgctttacctgatgactattctgagaagttccgctcgcggaagaatggcaccgaaaacttggaacttccagaggttaaggattatcaaccccgaaaagtagcaggagatgaaattcttgagcaagaagtatatggcatagatccatacacacacaatctactgagtgacattatgcctgctgatcttgagttgtcacctaccgacaagcatatctttattgaggagttgcttctgaatacattgaataagcaagttaggcatttcactggttcgggaaatacccctatgacttacaaccttaggcctgtcattgaagagatccaaaggtctgcagaggataatggtgatagacgaacttcaaagatgtgcttggggatgctaaagaccatgagaaatcgctctgaacagaacttcgttgcttatagaaagggtctcggtgttgtttgcaacaaaaaaggtggatttggtgtcgatgactttgttgtagagttctttggggaggtttacccttcttggagatggtatgaaaagcaagatggtattaaacatatacaaaacaacagtgaagatcaagctcctgagttttacaacattatgttagaaaggccaaagggagacggagatggatatgacttggtttttgttgatgcgatgcacaaggccaactacgctagtagaatctgccactcctgcaacccaaactgcgaagcaaaagtgacagcagtgaatggtaaataccagattggagtttacacacttcgaccaattgcagaaggcgaggaaatcacttttgattacaattctgtaactgagagcaaagaagagcatgaagcatcagtctgcctctgtggaagtcaagtatgccgtggcagctatttgaatttttctggtgaaggagcctttgagaaggtattaatggaattccatggtgtgctcgataggcatagcctgctgctacaggcttgtgaaacagactctgtctctcaacaagacttaattgacttgggtagagctggtcttggtacctgtttgcttgctggtttgcctggatggcttgttgcttacacagctcacctggtgcggtttatataccttgagagacagaaactccctgatgagatcttaaggcacaatgtggatgagaagcgccagttccttatagaaataaacatggattctgagaagaatgatgctgaggttcaggcagagggagtattaaattcaagattacagcaaatagtgcatacacttgacaaggtgagatatgttatgagatgcatatttggagacccaaagaatgctcctcctcctcttgtaaggttgtctgggaaaagtctggtatctgccatctggaaaggggacagttcaatagttgctgaactcattcagtcgatggaacctcatgttgaagaagaggtacttagtgatctgaaggccaaaatccgtgctcatgatccgtcagagtctgaagatattgagggaggcatccggaattctctcttgtggctgcgtgatgaattgcgaactctttcatgcacttacaagtgccgtcatgatgctgctgcagatttgattcatttgtatgcttatacaaagtgcttcttccgagtccgggattataagacagtaaaatctccaccagttcatatcagtccgcttgacttaggccccaaatatgctgataaactgggaccaggctttcaggagtactgcaagacatacccagaaaattattgcttagcccagcttatctattggtatagccagaattcagaacctgaatctagattaacaagagctagaaaaggttgcatgtcgttgccagatgtctcatccttctatgtgaagtctgcaaagccatcacaagagcgagcttatggaaacagaactgtgagattcatgttatcgcgcatggaaaaacaggcacaaagaccatggccaaaggataggatatgggtgttcaagagtgatccgagattctttggtagtccaatgatggacaccgtgttgaataattccccgcttgacaaggagatggtgcactggctcaagactagaccaaatgttttcctaggctagtaaaaaaggtttgtaggcagataaggtggtatttggttctttctcctttttggagattttagtctacatgattctttttccgactcacaccttggctacctgatcatggggagtttagcttttagatagcagggtagtctcaccacccccatctgtacattcctctctccctactttccttgtagagatgtatctggttaataactgatagattcgtcattgatttgatgtagtgaattttccccataggaacgctccctcttctgtttcatgtaaatgcagaacaatttcaatcttgaattcagtaatgtgttacaggcatgttgcatttcagaagatcaaaaagaaaagaaaatcaataaattgttttaggggcttataggtttcattcataggaaataatctgtgcatgagttttgatgattgaacctgt

SEQ ID NO: 23976 - DNA, 1204 bp, Zea mays
aaagaatgctcctcctcctatggtaaggttgtctgggaaaagtttggtctctgccatctggaaaggggacagttcgatagttgctgaacttcttcagtcgatggaacctcatgttgaagaagaggtacttagtgatctgaaggccataatctgtgctcatgacccatcagattcttgaagatattgagggaggcatccgtaattctctcttgtggctgcgtgatgaattacgaactcctccatgcacttacaagtgccgtcatgatgctgctgcagatttgatccatttgtatgcttatacaaagtgctttttcccggtccgggattacaagacagtaaaatctccaccagttcatatcagtccgcttgacttaggccccaaatatgccgataaactgggaccaggctttcaggagtactgcaagacatacccagaaaattactgcttagcccagcttatctattggtatagccagaattcagaacctgaatctagattgacaagagctagaaaaggttgcatgtcattgcccgatgtctcgtccttctatgtgaagtctctaaaaccattgcaagagcgagtttatgggaacagaactgtgagattcatgttatcacgcatggaaaaacaggcacagagaccatggccaaaggataggatatgggtgttcaagagtgatccgagatactttggcagtccaatgatggatgccgtgttgaataattccccccttgacaaggagatggtgcattggctcaagacgagaccaaacgttttcctaggctagaaaaaaaatgattgtaggcagataagatggtatttggttgtttctcccttttggagattttagtctgcaggatttttttttccaggctcacaccttggctacctgatcacagggagtttagcttatagatagcagggtaacagtcaccaccccccatctgtacattccccagtccctacataccttgcggagatgtatctggttagtaaatgatagatttgtcattgatttaatgtagtgaattttcccataggaatgcccccccctcttttgtttcatgtaaatgcagaacaatttcaatcttgaattcagtaatgtgttacaggcattttgcatttctatggttcagttgggttgtttcagtcaataaaatggttttaagggctcaaaaaacaaaaagctatggggagaatgag

SEQ ID NO: 23977 - DNA, 934 bp, Zea mays
agtttggattaacaacacaacacatgaccatacatattttattcttacacttttttcccgttgcaatgcatgggtatttgactactaagagatataagagatttcacgtgctcactgcccctgggcagagacacaaatgcaagccgatttcttcgctgtgatggctcaagtgaccaaagccgattttcaatgcagttgcttctgaatgcattgaataagcaagttaggcatttcactggtttgggaaatacccctatgacttacaaccttaggcctgtcattgaagaaattcaaaggtccgcggaggatagtggtgacaaacgaaatttgaagatgtgcttggggatgctaaagtccatgagaaatcgctgtgatcagaactttgttgcttatagaaagggtcttggtgttgtttgcaacaaaaaaggtggattcggtgtagatgactttgttgttgaattctttggggaggtttacccttcttggagatggtacgaaaagcaagatggtattaaacatatacaaaacaacattgaagatcaagctcctgagttttacaacattatgttagaaaggccaaagggagaccgagatggatatgacttggtttttgttgatgctatgcggccaactacgcgagtagaatctgtcactcctgcaaccctaactgcgaagcaaagtaagatccttttaaggttcaggttccaaccttgtgaatgttaactgtttcattgcttctgtggttatgtaatatcattctttgattattggtcagaatttatgtgtatgatgtgcatgacgtatttttttggagggagtaaccccctctgtgtactatgtattaatgaaatgacacccaactcttccgcgttgttcaaaaaaaaaaaaaaaaaaaaaaaaaaaaaaaaaaaaaactcgaggaggggccccggcc

SEQ ID NO: 23978 - DNA, 847 bp, Zea mays
cgtaaagtaacaattgcatatagcaaatatatggcttctccaaaccatagcaccaccaaggggcttagctcctggctcctgcactatccttcattactgcctaaaaaaatgaaaacaccgacatatttcagatgataacattcctggtccatgccgcacacaaatccgcttttttttttttttttcaagtccaaacaaagtcctttattgacctgagtaacatttggcccagaatttcagaacagcaacgtccagccattttgcattgataaacacttaaagattacagctcagccattgcacaaatgctaagtccaatgttttcaacatcgcaatcacaacagcttgactccagcttctctgactgaatctataacggccttcactttcccatggtacttttgttctctcttcatgtggatggacactgcaggtattcccttgaggagcaggcgctcgccgagcaactttccaatcttcgcagctgctgcgacgtcacgggtcgactccatgtttggtctcaacagcttctcctgcgagcttgcagaacatgcaacagttgctgttggggtgtggacgacctgagcagatacatacttgtttgagaaatgcatcctcaataggtagggcttgaggaaacgggtgactctagctgcccttgctggtggagggatcaccatgactcctggtctctccgctgtggctagcagaccaccgggccgcgaggctggccggggacgcggcaggcggcggcggcggcggcggcgcgacgagggtggagtgacgaatcggagtggagcagggtttcaaaaggaccgccggcgcccggggggccccatctgcatat

SEQ ID NO: 23979 - DNA, 758 bp, Zea mays
  misc_feature (2)..(2): n is a, c, g, or t
gnccgcaaatttttttttttttttttgttcagatgtataacattcctggtccatgccgcacaccaatacactttggtttctttgcttcaagtccaaacaaagtcctttattgacctgagtaacaattggcccagaatttcagaacagcaacgtccagccattttgcattgataaacacttaaaaattacagctcagccattgcacaaatgctaagtccaatgttttcaacatcgcaatcacaacagtttgactccagcttctctgactgaatctataacggccttcactttcccatggtacttttgttctctcttcatgtggatggacactgcaggtattcccttgaggagcaggcgctcgccgagcaactttccaatctttgcagctgctgcgacgtcgcgggtcgactccatgtttggtctcaacagcttctcctgcgagcttgcagaacatgcaacagttgctgttggggtgtggacgacctgagcagatacatacttgtttgagaaatgcatcctcaataggtagggcttgaggaaacgggtgactctagctgcccttgctggtggagggatcaccatggctcctggtctctccgctgtggctagccgctagcagaccacggggctgcgaggctggccggggacgcggcaggcggcggcgcgacgagggtggagtggcgggtcgggtgacgagtcggagttggagcagggtttgcaaaaggaaatcgttgggctgagccgtagtatcatcacat

SEQ ID NO: 23980 - DNA, 2196 bp, Zea mays
ctgacaacatactagggtaatcacaatagttaacacacaagtaccaacgatacagaaaactagatttgtggccttagcatgaccattggtccattagctcgacaaaagcatcattaagtaaagtaacaattgcatataacaaaatatgacatctccaaacatagcagcaacagggggctatgctcctgcactatctttcattactgcctaaaaaatgaaaactgcctaaaaaatttttttttttttttttcagatgtataacattcctggtccatgccgcacaccaatacacaaaggaaacaatgcatcaagtccaaacaaagtcctttattgacctgagtaacatttggcccagaatttcagaacagcaacgtccagccattttgcattgataaacacttaaaaattacagctcagccattgcacaaatgctaagtccaatgttttcaacatcgcaatcacaacagcttgactccagcttctctgactgaatctataacggccttcactttcccatggtacttttgttctctcttcatgtggatggacactgcaggtattcccttgaggagcaggcgctcgccgagcaactttccaatctttgcagctgctgcgacgtcgcgggtcgactccatgtttggtctcaacagcttctcctgcgagcttgcagaacatgcaacagttgctgttggggtgtggacgacctgagcagatacatacttgtttgagaaatgcatcctcaacaggtagggcttgaggaaacgggtgactctagctgcccttgctggtggagggatcaccatggctcctggtctctccgctgcaagtgaacaggagcaacaaaggcttattggctagagaagcacagcatgactgcttttcctataataaccctgtgggaacaaatacagagtagagaagtacaacagtgtacaaaccagtctcgaagcagtaaattcgtaacacatcatcacggattctaaaaacaaggatccaaacagtatgtcagtgtgtaggaccaacacaaaaggtgtggagttatttgtttttcaaccctgctgacagggtgaaaatgcatgagaaagttataagctttataggacaaaaaagaaacaattatagcatccaactaaggcacaaatggatatttgatctgaggtagaactaggaaagtctcctgcttaaaatagctagctgactattccacttcaaccggatagataaaaccatctatgaaagaaaacaatatcttttatctgttatatgcaacaacattttctgttatgcaattatttggacaaattgccagggcagtgacctggtaatcaatttaggaggcacagggaagcttatctgatgaatcagccatgtaggaaaataaatcacatgatctaaaacttaatcggccttggactcagcagaacggcgccagccacagcaacaaaatgcacactaaagatcatcactcaccctaaaaatggtgccagatatgtagggtacaaagagagcagatttaatggtatccaacacatggagggagctgaaccttagagtattcgattcatgcatgttacttgtttttcttaagttttagcaagatgaaaaaatatcattccatgaaacagagtattttgaaggtactgagtacagagtacaagaacaatgtgttccagcacttgaaggcttagcggcttctcatccacatgtgttcaagcacttgattcatggcagacaccaccaccattccgcaaagcatgacagactaggaccgaaatcatagagggggtatctcatcttcaaaccaaaccagcaagatcatccatcaatgcattcgattcgattcaaggatttgaataataaactcatgaaccagcgtatctaataagaaacgcaccaagaagaggaggaggcgcccaacctgtggctagccgctagcagaccacggggctgcgaggctggccggggacgcggcaggcggcggcgcgacgagggtggagtgacgaatcggagttggagcagggtttgcaaaaggaaatcgttgggctgagccgtagtatcatcacatacctgggctcaataggccgaggcccatttaaaatcagcccagcctgagaccgccctactcagaaaatccgccttggctgctaatctatacttctatacttaaagcaccagttttaacggtcgttccgcgtc

SEQ ID NO: 23981 - DNA, 2463 bp, Zea mays
gggttttccagtcacacgtgtaaaacgacgccccggtccgtctttattgtgtttaacacgaattgggtaccgggccccccctcgagtttttttttttttttttttgagtaaaccaaatcacatttcaaatcaacaatggtacaacctgtacagtgtactacatcacttccggtagaaatcaacaagggctttagacagcaagtgtagtttcgacatgtgtggtccattgtacacgagatagtatttaagaagccatacagtgtaaatcttggttgtatgagccaacccacgctgcaaaaactaaaacaaaaaaagatggcgtacgtatattcgtagatgtggagtgcaagtaccatggagtgaacagatacagatgggagcagcagagcacagtggacggggggagcaactgaacacaatctgtcgaacgatggtaactgagatggagctttcactttgttcacttgtgccttgctactccggcgactcatgttggtatgcggttaagctgtccatcatatatgcatattcacagtcacggaggttgcttcagaagagctcttcagagttgaatttgttccatgcctccttaagaatgtcaaagactttttcggcaatatatttctgctgaagtgttgcacctttctgttgcaccttatcaggatgaatgcacagcgttgccttcctgtactgcttcttaacagcagctccagtaattaaatcagtcaatgatacagcttgccatccacattctggccaaagtatatattgtaaagttgataacaaagcacgcaagttgccctctttcccagcagaccacctcttgatttcgaagtctagagtgtctccaattctatctctctctgcctgctccctctgaacttgcatatcacgttcattcttctcagccagagcttttgccgctcgttcacgagtcctctgatgacgttctaacctagcacgtcttctttcttcactttctccctcaacttcttgaaaaacatcagaagatgcaggagctccaaataagtcagacagatcatcaccaaaacttgtggctgatgccacttttctcacaggagccgaagttgatgctgctctctgtgatccattagttgttcctctgccttgagctccagaaccaaacatagaatccactgttggtgttggagccctctgtttcggcgcactgttggcacgagaacccacaccaaagaatgactcaagatcatctggtgtgctctgtttttctcttgaagcagcagctgctgctgcggtggcagcggctgcagctgcagctgcctgcctttctcgagcctcagtagcagctctttccactgcagctcgttcagctctcttccttgcttcttgctgagctctctcagcagcagctctttctgctgctgccctctccctagcagcagccctctccctctccttggcttcagctgctgccttctccttggcttcagcagcagccctctcctttgcttctgcagcagctctctcccttgcttctgcagctaccctagctgctctttctttggcctcaactgcagccctctcacgggcttcctgttgagccctttgcacagcagcacgctgtgaacgctggcgggcctctctttcagcttttgcacgagcttcagcagatgctctctcacgtgcctcctttgtagccctctccactgcctgtcgttctctctctctttctctctgttgttccaactccctctccttttcaagccttctctgctccctctccatctcctccctcagcttcatttctctttctttctccaatctttcttgcctgtctttctcttcagtatctgatgagcttctttcatagtcctcatcaaaaacagtgttgccataagcaggcatttgaggtttgcccatggaaaagccttccaggtcatcttattgaagaaacctccggttgctttggcaaatctgtgtaatggttctgatttggggtagactgacgagcatgcccattctcctttgcatttgctctcagtggctttcgtttgagaagaggtggtgatctggagggtggtggagcaatagttggtgctgtgaaaaggggaatctcggaaactgtgagccatatatcatcttcagattcagtagatcgtggtgactgatcttccgtatcattaccacgaacgtcagaataccttgcagactgtgacttgggcatgacattatcaaagtcttccatagaagattgacgcgctgaatttctatccattgaatggtgtagaggactcgaatcgcggactgcgcttggcggttttgtgtccttggcatgaccattgaattcggaggtaaacaaaggatctgattttggagcctggtcaaaagcacttgattgctcgaataaactatcgtcatcagcagtactattggcagctttgccatcaaagcttgcaggtttatccagatcttccacgggat

SEQ ID NO: 23982 - DNA, 947 bp, Zea mays
ggccgcttttttttttttttttgtcttctttttttttttggaaaccatacataaattcccaaatcataaccacaacaaagaactgtagccattggatgttacagagcttttttatttgctggcagctatttccaaactactcacgatgaatctctccgattgtgtgcataacagaatgcagcgaaaattataccagctacatttgcagaaaacaaaaggctcctcaccagtgtctgaacagacgagataatgcatcatgtgacaaaaagcaagtatttggtccaaggagaggctccagcgtttacaactgagatgcagcggttggcggtcagtatcagttaactagtttcccatgccaaactccgctatgtctttattgatttgctacccacagaagttgagcttctttataacctttgcgtaggccaaatgcaccaaagcaggcttccgaagtctccgtttggcctccttagacttgaggtgtgcattgtggcgcttgccggccctccacctgcggacctgtccgtctttcatggttctgaatctgaacttcatggacgagggggccttcatcttgtatttcttgactttggatttagtgggcgtgagcggagcgcgcgacctctccttcttggcgtagtgccgcacttgctgatgatgcgccgacggagggcggaaggaagaagcgatgaccaggtggaagaatccctggagagagtggtgcctgcgacaggacaaggagaaagggacggtaaaggagggagatttgggcatcaggggtgccggcagcgggcgggcatgggatgctatggcggaggtggaggacgagaggacgcagcgggcgaggccgccggcggcgcaccaccaccgccgcattgatctgcacctctctgactcagttttctgtttgtgtgtgtgtttgtttggcctcccgccgggcctcgagg

SEQ ID NO: 23983 - DNA, 1270 bp, Zea mays
aactgattagtaactaataattgtttacatattagtcgttgcccatataaatataaatggagttctttgtgtcaaatgaacgctagttgaaccctagccggcggatctccgcgggcggcagtcaggagtggaggcgtggtcgcacgggcgaggtcgcaataggagaggctcagagagatggggcggccttacgcggtgaaggggcggaagaagaagcgcaagctcgaggaggcggcggcggcctcggacgctgccccgcccgtcgaagaagcggaggagctgccaccgccagaggtgagaagcggcgaggaaaagagcagcgaggaggatgaggcagcagcgggggaggaggagcacgcggcggcggacgggctcccaatcctacccaggacggttgatgggaagcggcgacccggcgccatcttcgtactcgagagggcctgcctcgaggtcggcaaagtcggcaagactatgcaaattttgaactctgatgatcatgcgaattatttgaggaagcagaatcgcaatcctgcagattataggcctgatatcattcatcaggctctactagcaatatttgatagccctcttactaaggctggaaggttacaggctgtttatgtgagaactgaaaagggcgtattgtttgaaatcaaacctcatgtccgcatgccaagaacctttaaacgtttctgtggtttaatgtcacaattgttgcaaaaactgagcattacggcagttggaaagcgtgagaagcttctcaacgttgttaaaaatcctgtcactcgttatctacctgttggtgcacgtaagattggcctttcatttagtgctgagaagtcagtcaacttgtttgactatgttgccaaatccaatgacgacgaacctcttgtgtttgtggttggtgccatggcccatggaaagatcgacaaggaatatacagatgattacatacaaatttgcaactaccctctcagtgctgcctgctgtttaaatcggatatgcagtgccctggagcagaagtggaacatccaatgaggaacttttgacaagcatgggaatcttgttttattatatacatcttacatgtacttccctctgcttatgtacaatgtttgaaagttaaaaccaaatgtttcagtgtggcattatgacgtgttttagacatcaattcatggctttaaactggtttgttcagagtcattttagcaaaaactgagtgttctgcatgccaaacttcggttaactcaaacattggtgtcagatctta

SEQ ID NO: 23984 - DNA, 4821 bp, Zea mays
gtggatttgattggaaaagtcgtgacatggcaacacatggggtgtacacgtacgaacgatggcactggaccaatggcatgagcatggggctaaataggggaactagcgacaagcagaggaagggcatcaagtttcccaaccctgactagctcttaatgatctttgatggcccagacctataagttgaagcactaatggtgtattacaagcgagagttgatcacccttgataccataactgccctgatgtggcttcggtggactgagatggttataatcttcaatcgaggcaatcatcccgaccatgtctcccacctagagtgctacccactcgtggttaacttgatcatgggaaacacacctctccatggtcctcatggacactatcattagactcatcatcctttgtgccgagaccctccataagacgatcctacgaaacaaacgcatacctgaatagaacatcgttctatggggtcatctgaggcaacgaagccttctcccttgtccgcacccgccttcgtgtcacatttggtgcgtcagataacttctacaaagagccactcacctttgaggcagactgctgtgacacttaccacaccttgcttgatggagggcatatttagtaaaatattatcgttcctaactatacctacctaacactgaagatggtgggaccaaatagagtgttcatcatgagcaccaaattccaatatgcctcctactacaactagaactgtgtcacccttgcgaccatgatctccgcattcatcgaccatgtgaacaatggccacaacacacgagagcaacctctagaaggaaagaagactgagaccctattttaaacctctaaaattaacagttagcagttaaaattagttgagaggtttagaatatttcagttaatatactagctaattgttaattatacttcttaaatatttattagcgattaactgctccaacctagctaaaatagttaataacttattagctgactaacaattaacggcgatacagctcgacagacaaagccccaggaactactaaagtggtctaaagcttagcagctaaactttagagcagggatacaaacaagacattagtttagcagctatgattctttaaaaaaacaaaaaccaatgcatatatgcccaagtcacttcagattttatgcatgcttgcatgcatgctgaacacaaaagaagtgggtggttgttttgcctttagtttttttaacaatggaattaaacacccggtttcttccctttggatttagactaaacttattacaaagtttaacacataaaaaagtcacatacttcatactctctccatccacataatttatttgttttaggtttgttttaagttaattaatatcaactttgattggttacaccagatatttcataaaactttacaacacaaaagtaaagtttctagattcattatgacttgaactaccataatacataattcttctagtttaaaataatttaatcttatatatatatatatatatatatatatattactggttaaagttcaaatagtttgatttagaacaaaactaaaacaactaaatcatgtagacgaagggagtagtcatcttcaattaaaaccaaacttaaaagtaaagcataaaaagtcatgtagtccatattcatctttaattaaaggtggtccttaattgaaatcgaacttaataaaaaaaaagtaaaggatcatccttggagtggaaaggaagttattttgccggcactatatcagcttattgtagcagtacatttggaccgaggagaatatttggcggcatttttactggtttccgagcgatcggcacagaacacgccacggcactgacggccagccacagccagccaacaataggaacctgtcgggacgttccccgatcggcgatcgcgcgcgcgcatcgcaagcaccgaaattagaccgaggaagagggtaaggaacggtcgcggcccacgcggccgcccacgcgtccggagagcgagcacccggcgtcgggcgacggtggcgccatgggtggctgccactccgccatcgcggccaccaagctgaagattctgcgccgcggaggccggggtgccgctgccgtcctccccgtcaccaaccacgacggcccgtgctgctcctccgaccacggcagcaaggagaagaagaagaaaaagaagggcgccaggaagggcaggaaacgcgcctccatcctgggcgacgccggcaccttcgacccggacttctcgcggcggtaccggctcggcgcggagctcgggcgcggcgagttcggcgtcacgaggcggtgcgaggacgccgccacgggggaggccctggcgtgcaagacgatccggcggaagcggctgctcctgcgcctcgccgggcccgacgcgaccgacgtgcagcgcgaggtggagatcacgcggcgcatgtcggaggtgagcgggggcagggtcgcgtgcctgcgcgaggcgtgcgaggacgacgacggtgtgcacctcgtcatggagctctgcgagggcggcgagctcttcgaccgcatcttcgagcggaagcactactccgagcgcgccgccgccaagctcgcccgcaccatcgtcgaggtcgtgcaggtaaccgtctgtctctgtctgtcgtccatgaccagacgagggaccgagcgaggccgcccgcatgaattcgccagcgtcttaccccgccgttcccgcctcgttcgacacgcagctgtgccacgagaacggagtgatgcacagggacctgaagccggagaacttcctgttcgtgaacaagtcggaggagtcacctctcaaggccatcgacttcggcctctccgtgttcttcaagcctggtacgacggccaccgcatctccgtcgcaagccctgttcactctgacatacatggcgagctctgtcggtgcaggagatcggttcaccgaagtggttggcagcgggtgttacatggctccagaggttctcaagagaagctatgggccagagatagacgtgtggagcgctggtgtcatcctgcacatccttctctgcgggttccctccgttttggggaggtgaacgctgttctattctattttcattctcatagttcattcggcgaccactgatgcaatgttgtttgtttcaacgatcgcaggctccgatgagaaaattgcacagtcgatactccgtggggtaattaacttacagaaggatccatggcccaaggtctcccagagcgcaaaggatcttgtcacgaggatgcttgacccagatccttgtacacggtggacggcaaagcaaggccttggttagtagccttaagttcaatcttataagtttactgaaaaccaaatagaacgggcaggctgcatccgttcctagaaaaaaaaacagggtttttcttgaagagcctgttattgccatcattgaagaaaaaaaaccgaaatggtttaatcatgctgcgtatttaaccataagcactttatcggggaaaaaaacagagcacccttggctcaagaatgctgataaggcttcaaatgtgtcactcggagaggttgttcggtcgaggctgaagcagttgtcgtctatgaacaagcttaagaagaaggcacttggagtaagttgcagataactcgctggtactacccttaattccttcaagcgacaggccgactgatctctctctttttttttttgccaatgattaatgcaggccggcgccctggtttttcccgtggaagagattggcaaattcaaagagatgttccatacaatggacaaaaacaaggacggtagtttgtcacttgaagagctgaaggagggtttccggataaacgatcatcctgttccagaggaagagataaagatgttgttacaagcggtgagtgcaaggaccaccatttggtattcttatattatacaaatgtagtactaggatgtctagcatactggcaagtgaactacagtgaatagagtcgaagaggtaaattccatctgcaattgcagcagtattcacaaacctaaaagtgtaatttgcattataaaatcaatgctcgcactacaaagttgcacaaaaatcaattatcagtttaacactgcaacgacctaatacaactttcttcgttttgcagggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggttagcactcagtaaactaattagtcaaaattattatcacttaaatattgatcacactgtaattgcaacaaaaggaaaggaaaagaagtgattcacttcactatcggtcataaagttttaaagttttcggtaggtattaggaacctagaattgtatgcaacatgtatcgtttgaccatttcgaatgaattgaagttagtttcggattggctaaagcatcacttataaattataataggcagagaacacagattttttactagcgcgctgaaacaagcaaatcaacaagctaccttcagaacaccccaccaccaccacccaacaccaccagcatccaccacatacacacactacaaactagtttttgacaaaataaaagataacaaactatggcgagggtcagtataaatctaaaagactggttggagggttccatctacgtttttattca

SEQ ID NO: 23985 - DNA, 1806 bp, Zea mays
  misc_feature (93)..(93): n is a, c, g, or t
tgcggcacgcgtccgagcggctgctcctgcgcctcgccgggcttgtcgcgaccgacgtgcagcgcgaggtggggatgacgctattcatgtctntcgtgaccggacgcccggatgcgtgccctccagaggcatacgacgactaccaccttgtgcacgccgtcatggagctctgcgagggcagggagctctttgtccgctcctgcgagcggaagcactactccgagcgcgccgccgccaagctcgcccgcaccatcgtcgaggtcgtgcagctgtgccacgagaacggagtgatgcacagggacctgaagccggagaacttcctgttcgtgaacaagtcggaggagtcacctctcaaggccatcgacttcggcctctccgtgttcttcaagcctggagatcggttcaccgaagtggttggcagcgggtgttacatggctccagaggttctcaagagaagctatgggccagagatagacgtgtggagcgctggtgtcatcctgcacatccttctctgcgggttccctccgttttggggaggctccgatgagaaaattgcacagtcgatactccgtggggtaattaacttacagaaggatccatggcccaaggtctcccagagcgcaaaggatcttgtcacgaggatgcttgacccagatccttgtacacggttgacggcaaagcaagtccttgagcacccttggctcaagaatgctgataaggcttcaaatgtgtcactcggagaggttgttcggtcgaggctgaagcagttgtcgtctatgaacaagcttaagaagaaggcacttggagtcgtcgccatgaatttaccgatggaagagattggcaaattcaaagagatgttccatacaatggacaaaaacaaggacggtagtttgtcacttgaagagctgaaggagggtttccggataaacgatcatcctgttccagaggaagagataaagatgttgttacaagcgggcgatatacatggaactgacacattagattgtgaggaatttgtgacagtcttgcttcacattaaaaagatgagtaatgacgagtatctacctaaagctttcgagttcttcgacaaagacgggaatggttttattgaaatgtccgagttaatggagactctaagtgatggtgaactaaagcctgatgagcaattggttaacgacattattcaagaggttgacaaggataaggatggtcgcatcagttacccagagtttgaattgatgatgaaaagtggatcggactggaggaacgcctctagacgttactcaacagagaatttcagcagcctcagtcaaaaactgtgcaaagatactttatgaaacaagaaagtagtttccaagcagcaattactgactgaagtaccacaccctcaactaaacagcatcagaagacaacgcaaaagcaggattactggatctggtggaaataagggttgaaggagatcacatataccagttgcatgcttgacaaacttcgtcaactagcaagccctctggcattgtcctttgctctggaagtaaaatttactattccaatagaatacatgacttagacatagacagatgtaaaggatgccccagcatccatgcaatccactaaccaaaatttggcattttactactgtcaaatatataaagaaaagaagatgtccatctgagtgcctagaattaaaataccccaacaaaaagagcatcaagttgctgagaggaagaacagtactttcgtccaaacagcattttacacaaacgatggaatgcacagcaccttgaaatgtgatggatattacgt

SEQ ID NO: 23986 - DNA, 3093 bp, Zea mays
  misc_feature (752)..(752): n is a, c, g, or t
tgaacgtgtgctgagcagatttgggaaaaaatgtacgacacggaaatttgagggagaaaaggctatgtattccgtattcgggacgtcaagataatgggggataaaaaggagagctgttggagggctcattttgcactttttttttcccaacaaatgctttacggtttgcgggttttgttggagttgctcttaatctctaatttgtgtaaagaggaaaatcacctagactgctttgatgttttaagaaaataagatcatgtttcaaatagaaaatagacttgctcatcctttaatctttatagtacaatttaatttgtatcagtttagttttgtaataattactgacaaatgttttgtgatatattaaagttgatgataatttatgtgctatccattttcatgcaatcattgtgcactaacatttttatcgaataatttgtatgtcatcgcaacacgcgggcattgtactagcatttattagcgataagatagcacataattttcaactcaactcatttttttattaaaactatctctagcagattacacatctccatctcttatttcaaactttactatataaatagtacaacctataatgcaaaacaatatacaacaatacttttgtatgactatatgcacgatctattaggcataggctaacactaacgccttatttgaaaacttattatttttgcagctttgaagtaatactatgatatttgataatattatagtattgaaagccaaangatcataagatgtttggttgtatagacaaaatcacatttaaataccatggtttatccaaaattttggtatttatggagttttagaaacttcacctaaaacttcggctttctttgttctctctacgtatactttggtttttctaatggaccaaacatatcttagttttaaataatattgtaactttagtgtaacaaagtaatactgtggtattatgtcatgtacaatcataaactatggtattttaaaactacattaccaaatatgccctaataagttgtatttcagttaaaaaatatcttgtgacaaggtgcgttaaaattattagctatttttattcatctaacacaccttgaaatatccttaaaaggagtcacgactagcacattttaaaaatcatggtatcttttgcaggtgcactataatcacgaggagaagcaatgccgaccacgtttataacggcggatcattctaattttagttgtagacatggaccctcctgatttgtccagttcagcacttggtcacagaatttgaatttgcaagcacaagggtcaagggagaaaaggctgccttctagccgcacatttcgtgtggatgttgatctcagccgttgatgtgtgatggggtgtcgcagcatcgtctcctcttcctggctggccacgccgcacccaccccccgctcctatccgtcctctaaaaaatccggaggcttcggccccccttctcgagcccttcgcccaattcctcaatcggaccaaaccctaggagccacatagatttcgattcgatcggaaatctggcatggcaatgtcagatctcacagccaccgtgatcccgaagccagacggggccgacgacgagtcggtggagatccgggaggtgtgggcggacaacctggaggaggagttcgcgctgatccgcgacatcgtcgacgagtacccgttcgtcgcgatggacacggagttcccgggcatcgtctgccgccccgtaggcgccttccgctcccccgccgactacaactacgccaccctcaaggccaacgtcgacatgctgcacctcatccagctcggcctcaccttctccgggccgcgcggcgagctgcccgcgctcggcgctggccgccgccgctgcgtctggcagttcaacttccgcgagttcgacgacgcgcgcgacatattcgcgtccgactccatcgagctgctccgccgcagcggcatcgacttccgccgcaacgccgagcgcggcgtcgacgcgcggcggttcgccgagctcctcatgtcctctggcgtcgtgctcaacgattccgtgtactgggtcaccttccacgcaggatacgacttcgggtacctactgaagattctcacctgcaacagcctcccagacacacaggccgggttttttaaactcatgaagatatacttcccgaccgtgtatgacatcaagcacctcatgaagttctgcaacagcttgcacggcgggctcaacaagctcgctgagctacttgatgtggagcgcgttggggagtctcatcaggctgggtccgatagcctggtcacgtcctgtgcgttctggaagcttaaggattcgttcttcgcgggctcaacagagaaatatgcaggtgtgctgtacgggctcaatgcagagaatggcgttagtgcacattgaggggtgctacctgtttgaattttagctttgtgaatcgattgatttaggacagaaagggtggcaagtgcgcaagaaggctcactgaaagatcaagtatgtaggttaagtctgtctcactcacttgggtgtatttgggatgtagtgctctttggctgctcagtattgaaatagctatttctccttcctccagctttgcttctgctctcagtttctcttttcttctagcaagatactaacacttgattaaacatagctaaaaatgacatctgagaattaaggcatgatacctgcattgccacaattgctgtactacccataatctaatacacccttcgttcttttttatttgtcgctgtttagttcaaaaatgaactagcgagcgacaaatattcaagaacggaggtagtatatttttatttatctctatggcaaaagaattgatatatcatatatgcgtgcctttttatatgagcagatggttgtctcaaaagagtaatagtgtaatactagcttatatctaagcatttatgagcataaacttggtgatgctttagagaaaaaatgccaccaacattcacatgactattcctgaggaaacagctatgctatacttcattcaagagactaataattcataatcaattatctaccctcagcgtaagcacgtcacccgttc

SEQ ID NO: 23987 - DNA, 635 bp, Zea mays
gggtaccctcgtgtgccggcccggggaaaatgcagatctgagggtttaaaaaccgatttcccccttttttctttattttcttcgtcctcttcgtctcgactcgccgcccagtcacctcaaatcccttcgatccaatctccaaaccctaggcaatccaacatcaaagtattagctgcccccttcgtcaaaccgcggcggcgcggccatggcccacggcggcggcgccgggaaggcgaaggtgacgccgaacctggcggtggacggcgagggcacgcgcacgctcaaccgcactgtgctgcagcgcctcgacccggccgttgaggatattctcatcaccgcggctcacgtcacgctgtacgactttgacaccgatgtcaaccagtggagacggaaggacgtggaggggtcgctcttcgtcgtcaagaggaatgctcaacctagattccagttcattgtcatgaaccgcaggaatacagataatctagttgaagatctcttgggagattttgaataccaactccaagctccttatattatgtaccgaaatgctgctcaagaagttataggaatttggttttacaactctcaggagtgtcaagaagttgcaaatctttttagcaggattctgaatgctt

SEQ ID NO: 23988 - DNA, 1561 bp, Zea mays
aatcgcaggagaaaccaaagaaaagttgctttttctttattttcttcgtcctcttgttctcgactcgctgcccactgcgtcacccgaatcccttcgatccaatctccaaaccctaggcagcccgccatcagattgttaggtcctccttcctttgggacctcgagccggcctgtcccacggcggcggcggcgggagggcgaaagtgacgccgaacctggcggtggacggcgagggcacgcggacgctcaatctcaccgtgctgcagcgcctcgaccacgccgttgaggacatcctcatcaccgcggctcacgtcacgctctacgacttcgacaccgacatcaaccagtggagccggaaggacgtggaggggtcgctctttgtcgtcaagaggaatgctcaacccagattccagttcattgtcatgaatcgcaggaatacagataatctagttgaagatcttttgggagattttgaataccaactacaagctccttatataatgtaccgcaatgctgctcaagaagttataggaatctggttttacaattcccaggagtgtcaacaggttgcaaatcttttcagcaggattctgaatgctttctcaaaggtggcaccaaagccgaaaattccttctgtccaaagtgaatttgaagagctggaagcagcaccttcgttggttgatggtcctctggaagcgcaaacgtcaaatatcatgtcaactactactcacgttcaagaggatcctttatctgcatttttcagtgcagctgcaaatgttggtggcaactctgctgtagctgttgcaaggcaaccaattcaaccttttggtgctactccggtggctacacatgcagctactagtatcactacaacacaatcgccaggcttgcattatttgcttccttcacaagcctcatcggtttctgggaggcctgctgatgctcatggtggcactggttctataggaaggtccacaagccttgtatatccgtcacttttctcaccattgacatcttcacagacgaaaatggtgcacactaattctgcagtaccaactgctccacctcaacatcctcggattgctcagcagccgcaaagtgctcccttgcttcagccttttccgttacctacggcttcatctccaccatatgggactccattacttcaaccgtttccgccacctaatccgtcgccatctcttgcatctgcaccagtcttaagcccagcgctgactagagacaaagtcagagatgcattattgagacttgtggagaatgatgaattcgtcgatttagtctaccgcgagatcatgaacagacagtaatggatttacaaggtacagtcctctccatcaggctagcttgtgtttggactctgtcattatctgttgtttagcctattccaagttatcctgtaaattattattgataaaatccttcggttggtggtgtttgtacaattaatgtactttctacatctgtataaatggttataaaatctgtgctgtattcatggtgcagaaaagttttgttcaaagttgtatgaaaaaaaaaaaaataaa

SEQ ID NO: 23989 - DNA, 1335 bp, Zea mays
tgggacctcgagccggccgggagaaccgatttccccccttttctttattttcttcggcctcctcgaggccggccggggcccagtcacctcgaatcccttcgatccaatctccaaaccctaggcaatccaacatcaaagtattaggtgcccccttcctcaaaccgcggcggcgcggccatggcccacggcggcggcgccgggaaggcgaaggtgacgccgaacctggcggtggacggcgagggcacgcgcacgctcaaccgcactgtgctgcagcgcctcgacccggccgttgaggatattctcatcaccgcggctcacgtcacgctgtacgactttgacaccgatgtcaaccagtggagacggaaggacgtggaggggtcgctcttcgtcgtcaagaggaatgctcaacccagattccagttcattgtcatgaaccgcaggaatacagataatctagttgaagatctcttgggagattttgaataccaactccaagctccttatattatgtaccgaaatgctgctcaagaagttataggaatttggttttacaactctcaggagtgtcaagaagttgcaaatctttttagcaggattctgaatgctttctcgaaggtgccaccaaagccgaagattccccctgttcaaagtgaatttgaagaggtggaagcagcacctgtgttggttgacggccctctagaaccgcaaacgtcaaatatcatgtcaactactactcacattcaagaggatcctttatctgcatttttcagtgcagctgcaaatgctggtggcaattctgctgtagctgttgcaaggcaaccaattcaactttttggtgctactccggtggctacacatgcagctactagtatcactacaatacaatcgccaggcttgcattatttgcttccttcacaagcctcatcggtttctgggatgcctgctgatgctcatggttctataggaaggtccacaaaccttgtaaatccatcacttttctcaccattgacgtcttcacagacaacaatggtgtgcactaattctgtagtagcaattgctccacctcaacatcctcagactgctcagcagccgcaaagtgctcccttgcttcagccttttctattacctacggcttcaccatctccaccatatgggactccattacttcaaccgtttccgccacctaatccatcgccatctcttgcgtctgcaccagtcttgagtccaacactgtctagagacaaagtccgagatgcattactgagacttgtggaggtatactgttctgtttattttatttcgatgtatgatttgaatgcattgttcttttttctg

SEQ ID NO: 23990 - DNA, 752 bp, Zea mays
aaaaaatgacacgatcgcaggagaaaccaaagaaaagttgctttttctttattttcttcgtcctcttgttctcgactcgctgcccactgcgtcacccgaatcccttcgatccaatctccaaaccctaggcagcccgccatcagattgttaggtcctccttccttaaaccgcggcggccggccatgtcccacggcggcggcggcgggagggcgaaagtgacgccgaacctggcggtggacggcgagggcacgcggacgctcaatctcaccgtgctgcagcgcctcgaccacgccgttgaggacatcctcatcaccgcggctcacgtcacgctctacgacttcgacaccgacatcaaccagtggagccggaaggacgtggaggggtcgctctttgtcgtcaagaggaatgctcaacccagattccagttcattgtcatgaatcgcaggaatacagataatctagttgaagatcttttgggagattttgaataccaactacaagctccttatataatgtaccgcaatgctgctcaagaagttataggaatctggttttacaattcccaggagtgtcaacaggttgcaaatcttttcagcaggattctgaatgctttctcaaaggtggcaccaaagccgaaaaattccttctgtccaaagtgaattttgaagagctgggagcagcaccttcgttggttgatggtcctctggaagcgcaaacgtcaaatatcatgtcaactactactcacgttcaag

SEQ ID NO: 23991 - DNA, 990 bp, Zea mays
  misc_feature (986)..(986): n is a, c, g, or t
caaccacgcatttaccgggctcataggctcttattacacttcccctaatcacaaagtgtgccccattccaatgagccactgccagcacgggtcaccaataggcacattaccccatagcacgctgtcagaaatcacataagatgcaaattcagagatcaccccttttcgcccgaaaggggccaagtcgctcaggcatatagctgtcacatggtacacatgcttctcacaatgtggagcagagaacacccaggcacacaacacgattgacagtgaacatcagttctcaaggtggaaaacacactcagtcaaacgctgcagtttgctagcatcaagcttctggttggtctgagactttggctttttcacagtaagcatcttggccgctgcatccaaactccacccgttttgcgcagcatagtttgtagcatcctcctcactcatccccatgaaatgagccacatcagcaactctaaccgtggaatgggcccacatcagcaactctaattgtggaatatgcagaagtcaacagcttgaatatcctctgtctgtagctctctaggaaggcagtgatgaagtcagcgaggtcaggaccccactcgaacccctgtgcagccgtgttgacgccagcataatctcttttccagaggcactgaccaatcctccagacagcggcgagctccggccgcgtgtccttgacctctgcggcaacgacttccagaagaaccgcgcgctgttcaggtcattaatgtagaggtgggcaagcaggtggacagagtagggccattcgtcggtggtgaacccctgggacgcggcctggaggagaagttcgtcgcagagggaggcgagggtggagtaggacttgtcggagagggcagcctggacagcggagagatccattggcggcgaaggagaagatcgccggcgatgggaaggagaaaaggttttggaattgggatttgtggcctgtcgactcggggctcggggantctt

SEQ ID NO: 23992 - DNA, 1458 bp, Zea mays
tttgtacaagaaagctgggtctcgagcagagaagaaacagggacacaacacgattgacagtgaacatcagttctcaaggtggaaaacacactcagtcaaacgctgcagtttgctagcatcaagcttctggttggtctgagactttggctttttgacagtaagcatcttggccgctgcatccaaactccaaccgttttgcgcagcatagtttgtcgcatcctcctcactcatccccatgaaatgagccacatcagcaactctaattgtggaatatgcagaagtcaacagcttgaatatcctctgtctgtagctctctaggaaggcagtgatgaagtcagcgaggtcaggaccccactcgaacccctgtgcagccgtgttgacgccagcataatctcttttccagaggcactgaccaatcctccagacagcggcgagctccggccgcgtgtccttgacctcctgcggcaacgacttccagaagaaccgcgcgctgttcaggtcattgatgtagaggtgggcaagcaggtggacagagtagggccattcgtcggtggtgaatccctgggacgcggcctggaggagaagtttttctctgttagtattgacataagatgcaaattcagagatcaccccttttcggccgaaaggggccaagtcgctcaggcatatagctgtcacatggtaaacatgcttcttacaatgtggagcagagaagaaacagggacacaacacgattgacagtgaacatcagttctcaaggtggaaaacacactcagtcaaacgctgcagtttgctagcatcaagcttctggttggtctgagactttggctttttgacagtaagcatcttggccgctgcatccaaactccaaccgttttgcgcagcatagtttgtcgcatcctcctcactcatccccatgaaatgagccacatcagcaactctaattgtggaatatgcagaagtcaacagcttgaatatcctctgtctgtagctctctaggaaggcagtgatgaagtcagcgaggtcaggaccccactcgaacccctgtgcagccgtgttgacgccagcataatctcttttccagaggcactgaccaatcctccagacagcggcgagctccggccgcgtgtccttgacctcctgcggcaacgacttccagaagaaccgcgcgctgttcaggtcattgatgtagaggtgggcaagcaggtggacagagtagggccattcgtcggtggtgaatccctgggacgcggcctggaggagaagttcgtcgcagagggaggcgagggtggagtaggacttgtcggagagggcagcctggacagcggagagatccattggcggcgaaggagaagatcgccggcgatgggacggagaaaaggttttggaattgggatttgtggcttgtggcctggcgactcggggactcttgaattcgcccacccgaccgccggccgg

SEQ ID NO: 23993 - DNA, 1610 bp, Zea mays
  misc_feature (229)..(229): n is a, c, g, or t
cagtatatatactaaaacagatccagtattccactagctagactaaacaaactaagctaacggtcaactactagtcagagctaaaaaattagcccaaattagctataacggactaacaactatttaaagatttagctagaaataactcatttattagtcctcctattttgatccactaaaactattttaactaactagcagttagcccttctattcaactacaccctanatcggagatatcccttttggtttgactctttatagccctcattttcctctctctcttgcttttcacgtgtttagggctattttgaaaacttaaattcactccataatttccaaaggatgagtagaaaattaaattaatttcccactcgatcctcgaaaatactggaagcgatataagtttccaaattagcctttagtgctttttcaatataaagttttctgctattagggttttccctatagtttagtttatcataaaaaagaccctagaattagcccttctatccaaccagaccctagaagcagctaatagttagcttattaatatttcctccgttctagttctaaatagtaatcgttttagcttagtttttatgtctacattaaaatgaataatgatgaatctagacacatgtacaaaacatatacatcaaatattgtataaatccactatctttttttttcttttggatcaaacatgaccttatgtctaatactccattgcacaaatgaaaatctacatcaaaggtaaagctagcctagcgagctatttttatttcattgtcattatataagtgttaatcatcatcattttgcacgtccctaacggggtgctaaatgcttcgctaaccgtttggaaaacgaatgtacagaactcaaatctgtgccaagattcgacgagcatcgcaatgtgaagagctcagcatcatgcacagtacataatcttttgacttgctcatcagtaagcatcatctggaaccgaatgaatattcaatgaaatcagtatactcgtcaatggtcagaccttttgcacctccaaagattcatctcctcctctctgcgctgatagtaaggcgttcaaaactcctcatagtgggatcatcctggccgattcttccaggttttgggaatgacgaggtcctgccctcaagtccagttgactggtgaagcctttgattggttgatggacggctgctgctgctggtggtcgggactaggtggctactgcgatttgggtcgctgggatctccagaacctcggctgcttgacagaagagccttccttgatgtgcttccattccgagatgatgaatgctttcttttatctgaatcaacagccatcttggatgccataagtgaatccaacagagtcctgtgctttgtgtctccgccggattgtcaataaattctttggtaaccaccatgccctgaatatgactaaagacggaggaacaaagaaattcaattacttcaagcacccatattatctgctgactagagctacatattttcaaggcactaaaagaaaaatttagggctaagggctagtttgggaacaccattttccccaagggattcctattttcccaagggaaaatgaac

SEQ ID NO: 23994 - DNA, 1079 bp, Zea mays
  misc_feature (1063)..(1063): n is a, c, g, or t
  misc_feature (1066)..(1066): n is a, c, g, or t
gaatcaaacatgaccttatgtctaatactccattgcacaaatgaaaatctacatcaaaggtaaagctagcctagcgagctatttttatttcattgtcattatataagtgttaatcatcatcattttgcacgtccctaacggggtgctaaatgcttcgctaaccgtttggaaaacgaatgtacagaactcaaatctgtgccaagattcgacgagcatcgcaatgtgaagagctcagcatcatgcacagtacataatcttttgacttgctcatcagtaagcatcatctggaaccgaatgaatattcaatgaaatcagtatactcgtcaatggtcagaccttttgcacctccaaagattcatctcctcctctctgcgctgatagtaaggcgttcaaaactcctcatagtggggtcatcctggccgattcttccaggttttgggaatgacgaggtcctgccctcaagtccagttgactggtgaagcctttgattggttgatggacggctgctgctgctggtggtcgggactaggtggctactgcgatttgggtcgctgggatctccagaacctcggctgcttgacagaagagccttccttgatgtgcttccattccgagatgatgaatgctttcttttatctgaatcaacagccatcttggatgccataagtgaatccaacagagtcctgtgctttgtgtgttctccgtattgaccagaaccagagccggttcttctagcaaaagcaccagcttgaccagtgaatctatctggaacatcttgtcttgctgcagctcgttcagccctatccacagatggtcccaccaagccacctgtcttcccgctcagtcgcaatctgttattgtccacagcttgccttgacacagtccaatcaaatacataatcaagctggtaaccttcacggatgaataaatcccggaaatttttcttcaaatagctatagtctggcttatcttcaaaacgcaaagagcgacaataatggaagtacctcggccgcgcccacgcttaagatttacaaagggcctcaattgaggttagcttttattntcnaccggacgctggg

SEQ ID NO: 23995 - DNA, 1507 bp, Zea mays
ttcaagatgaacacaacaaaggtatatttgacatggagcttgaggatttggctgaggatgaagataaccttggtcaagaaggaacaaaggtccattttggaggaaatatgtgtgccgagaaacttgatggtttaatggtggttgtgtgtgagcacctcaagtcacgtgtagaagaacctgagcgcctaattaaggaatttgtcactttgaaggctatatttaaatcacatgtgctgagggtgcacaaatccaaatttgcacagtttatcatgttttatgcttgttccctgcatcctgagattggcgatggctttgctaattttcttactgatatttttattgacaaggacaaaaacgaggatgcaattactagagtgtctgcagtttcatatgttggaagctatctgtcccgggcaaggttcatttccgtaaatatagttgtttctgtactcaaaaggctagtggactggtgtgattattattgtggccatcagctggacaatggggtgacagcaaatcctataaagcaccagctattttatgctagctgccaggctgtgatgtatgtcctatgctttcggttaagatctattatggactacccaaatcttaaacaacaactttttcgaatgcgaatccgggatatcttggtccacccattgcagccattaaaggtgtgcttgccttcaatagtgaatgagttcctgagacaggctacagctgcgagcctgttccatgcacctgcgatctcaatgcacgaagatgcagttgaatccgatctatcgaaggcatttggaggacttaataggcttgacatgttcttcccatttgacccgtatctacttaaagagtctgacagatatatacggccaaattttgagttctggtccttggtcaagacgacatacagtaacgacaacagcgatgaggacgacgaagagcttggcgacattgacgcacctggaatgaatgtgggcagcttggatgatcacttcgaaatagattttaacagtgacgatgacattgagtataagatgaataagatgtccataacgccgcaacgcactttctaccatccactggctacaaacagtgagtccaaccgcatgcctgcgaggatcagaccttcagtgagccccccatcatagcaaggttctgctcagctctttacttgactgatgatgacacaaaaccagatgctaggaagttgcacgtgccaagaagggaccaggggatgacgaccaaacatacaccggagtgtattctatttattattccagttgctagtagggtcaaaactttaatgcagagtgtatatgtgtttcagggcaacgcgtggaaaaccggtttgtgattgtatacttggtagtcagcccttaggaacaggtatgtgtttgtagcaagacttacgacgtgaaatgaggattctcttggggacattaatggtataacgtgcgaatgttagaacctaatttccaattatcaaaaaaaaaaaaaaaaaaaaaac

SEQ ID NO: 23996 - DNA, 998 bp, Zea mays
agccacagcccaccacctttgcttgctctgcccctccatcatcgccagcctgccagtgccgccgctaccgtagtaccgtaccctcagctagtcagctacctccatccaccagaccagaccataccagaccagaccagaccaatggccctgcgcctaccaatctcatcgtcccacgggctggcctccacgccggcgccaatctcattgggtacctcgaggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaagtgatgcaactagctagtgtagacgatgaatgaatgagtccctggccggcaaggctgctagatacgtacgtacgtacgtactcatcaacaattaatgatggatgatggcaatggcaaatatacagtcaatgattcatatatgcatgcatggactgctatgctagctagcagccctttgtaaatatattgtttaaggaaatgattcatatattcagcccttaaggacttggatgtcaaagccagccaaaaaagagaaaaaaaaaaaggaaagcggccatgagcgccatttatcttttgcgtgg

SEQ ID NO: 23997 - DNA, 962 bp, Zea mays
  misc_feature (21)..(21): n is a, c, g, or t
  misc_feature (940)..(940): n is a, c, g, or t
  misc_feature (948)..(948): n is a, c, g, or t
agccacagcccaccacctttncttgctctgcccctccaccctcgaggccggccgggccgggaccgtagtaccgtaccctcagctagtcagctacctccatccaccagaccagaccataccagaccagaccagaccaatggccctgcgcctaccaatctcatcgtcccacgggctggcctccacgccggcgccaatctccacgacgacgtgccggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaggtgatgcaactagctagtgtagacgatgaatgaatgagtccccggccggccttttgtgggacagcaaggctgctagatacgtacgtacgtactcatcaacaattaatgatggatgatggcaatggcaaatatacagtcaatgattcatatatgcatgcatggactgctatgctagctagcagccctttgtaaatatagtgtttaaggaaatgattcatatattcagcccccaaggactaaaatgtcaanaatacatnaaaaatgaactaaa

SEQ ID NO: 23998 - DNA, 1235 bp, Zea mays
gccagtccccccgggcggcggcgcggcgctaccctcagctagctccgtaaaccagcgagtacggccgaccagaccaatggcactgcggctacccatctcctcgacccacgggctggcctcctcgccagcgcccatctcctcattgggtacctcgaggccggccgccgccagtgggagcttgatcccgccagctgccctggtcgcagttgccatccgctgggcgtcggcgtcggcgtcccaaaagaggggcctgctgctgacgacggcgaggggcggcggagtcctcgcgccggtgaggtcgagcgggatcgagacgacgacgacctcggtgggagctgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctcccaagttccaggagatgtccgagaagaacctggacgtcgtgttcctcaagctggactgcaaccaggacaacaagcctctcgcgaaggagctgggcataaaggttgtgccgacgttcaagatcctcaagggcgggaaggtcgtgaaggaggtcaccggcgccaagatcgacgagctagcggaagccatcgagatagccaacaagaagtcaggctgacaaaggaatagcaagatcgacgtgcagtgcaagcaaggatgaatggatgatcgatgaactagctagtgaagactgcgaaagaatgcgccccggccgcgcatttgtgggaccggcaacatgcatgcagaaaacaagctattctagttcttctgcttaggctgtccgcaattgctatctcaaatagctagctgatatgaagctgagagaagaatacaaatagtaatttatctcagcactagtatttgatcccacacgtccagtttctttcttggaatacgtggaatcttctatctatttgctcgtcgctagctattctcgtttttcctagattttctatccacgtaggaaaagagagtgaatctagctagtgaaatagcgcttatgatttattactcatcaacatgcatgcgcgtgcgtgatgttaatcattcatatggtggagtgctgctagctagctcgctcgttgtaaattgatgacttgcttcacagctcagagctttgggtttcccggcccaaaaaaaaaactaaaaaaaataaattaaaaaaaacaaaa

SEQ ID NO: 23999 - DNA, 973 bp, Zea mays
  misc_feature (854)..(854): n is a, c, g, or t
  misc_feature (884)..(884): n is a, c, g, or t
gccggccgggtcgggaacgccagccgccagtccccccgggcggcggggccgcgtcaccctcagctagctccgtaaaccagagagtacggccgaccagaccaatggcactgcggctacccatctcctcgacccacgggctggcctcctcgccagcgcccatctcctccacgacgacgtgccggccggccgccgccagtgggagcttgatcccgccagctgccctgatcgcagttgccatccgctgggcgtcggcgtcggcgtcccaaaagaggggcctgctgctgacgacggcgaggggcggcggagtcgcgccggtgaggtcgagcgggatcgagacgacgtcgacctcggtgggagctgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctcccaagttccaggagatgtccgagaagaacctggacgtcgtgttcctcaagctggactgcaaccaggacaacaagcctctcgcgaaggagctgggcataaaggttgtgccgacgttcaagatcctcaagggcgggaaggtcgtgaaggaggtcaccggcgccaagatcgacgagctagcggaagccatcgagatagccaacaagaagtcaggctgacaaaggaatagcaagatcgacgtgcagtgcaagcaaggatgaatggatgatcgatgaactagctagtgaagactgcgaatgaatgcgccccggccgcgcatttgtgggaccggcaacatgcatgcagaaaacaagctattctagttcttnctgcttaggccgtccgcaattgctatctcnataagctagctgaatgtgggagctgagagaagaatacaaatagtaatttatcgcaaaaaaaaaaaaaaaagcggccctcgagctccagc

SEQ ID NO: 24000 - DNA, 901 bp, Zea mays
agccacagcccaccacctttgcttgctctgcccctccatcatcgccagcctgccagtgccgccgctaccgtagtaccgtaccctcagctagtcagctacctccatccaccagaccagaccagaccaatggccctgcgcctaccaatctcatcgtcccacgggctggcctccacgccggcgccaatctccacgacgacgtgccggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaagtgatgcaactagctagtgtagacgatgaatgaatgagtccctggccggcaaggctgctagatacgtacgtacgtacgtactcatcaacaattaatgatggatgatggcaatggcaaatatacagtcaatgattcatatatgcatgcatggactgctatgctagctagcagccctttgtaaatatattgtttaaggaaatgattcatatattcagccctt

SEQ ID NO: 24001 - DNA, 5336 bp, Zea mays
ctgttatgtaaaaaagttcctaaatctcagtttaaaaaattattagaaaattgtctctaataatactctaaacgatgttgctaaattttaaaagttgttattttatctttttcgtcctcacatttggcaaaaccaagagggactcctcaaaacactttttcgtgcaaaattagtgttctataccttctgtttttgttctcttttattttttattaataaactccgggctactatgtggaaaaaaaattgttgcatgttagactttttatttctgcaatttaggtcatatttagaatcaattaatcatagagatttgtgtatgttttgtacgcaaatttttctgtacgtagatgttagaaccattgcaataacaatatcatgtctgatgggaataacataaaattttctagatcgtgagagggataggagttttaactgacataattttgaaatattttggcagctaaaaataatgaactactagataacacatattttttacttcctactattatttagcaactcctcacatctatcattagagagatttttttataaaactatttgagatgctcttacgtgtcttgagtttaattaacttgggccctttattgctgagatgagaggtccgttttgttcctcagcttcttcaaatgcgggtaaacttaaacttcttttttttattgtgaacaaatgatgggcaaaccaatcgccatgcatagtcacggagttggcagcgaggacctattcctcaccacaaatcgaatggtgatgtacagccaatgttaggttaagcagtccggcacaaatcgaatggtgatgagaagtcaactgaatgatgtttagcttggtaggcaacgtgatgctctattgctcggcacgtattctttcatgacgtgcctaccgagcttattttatccgtaaattttatcttttctttttttttccccgtaaatctcaacaaaatgggggaatggaagccacgtataatttctgaaagatctttcagcaacaaaagatctgaatattttagcaacctgatcaccgtcaagaacgcggtgctatgtaaacagtaaacgtgatacggttctgcaggtttgacacttcagccttcagtgtcaacaacggctcttttctctgaataaaacatgtgcagcgatgtgcgtgccagttatgttgcctcaggcatgcacgaaatggacacggacaccccatgttacgtgcgcagatgatatacgcttcgctgcgtctttgaattgactcaaacagcgtgtgacgtcgtgggacggacggatttgagcaaacgaccgagctgcgtctttgaattgagcaaacaaatgtttctttttgatccaatccaagtatcgaactgatagcaggagacgcaacgaccagctgcaagttgctttcgagaagacgaaaagcggaaggatccactggcgtttcgccttttggcctgagaaacgaacgttgcggcttgtggcgagtttgaaatggaggctgctggctggtgaccctgtaccggtagtggtccccttaacgaacaaactgtccgccgaacatctttcgaaatttgaatggaagaaacatgcatggttttaatatcaatttaatactatcttgatctgagaagcatccaatgttcatccacacgcatgcaacagtcatgctagagaccggtacgctctgcatttgtgctggtcctacaacagcctcaactggtagatcctgacaggtgcatcaacagaacatcatatgggcagacatgttcgattgatctcaaatctaagggggattggagaagaacgagggaactaaatccctaacaagtcaaattcccctcatccgtctttaatccccttcgatccctttccaatcagtttgacggtccgttcagctaaccatgattcgacccaggaaccattccacctcattaaggttacacatattagtaaaccattcgaactagaaaccattccacggactcaatctaaaggaaccaaacaaggcctgaatttgtgaccaaacaaacaaaaacaagacatgaacggattcacagagtaaattctgtatgacagacagaacatgagacaattcgtaaatgccattagaacgaggaaccaatgttgcaaacccgcaacaaaggcttcctcactttttctctcactatccaagtattcatactgtttcacagctgctgcttcatctgactaacatacagcagctaagtagaatctactaaagcaatcacagaaacaaaaaaaaaggctttcttacaaatggcatcgaccaaaccacctgaaagaatcaaagaattggagtcccgtggatcattgctggagcaataggaaagccgaagcaacaaggaacggaaccagagcaaggccactgctgagacgggtgctgaatccagtgctgatcggaattctctgtggcatagcgcattcgtcgccattgaagaagacctttgttgggaagccatctccagcaacgacatttaaccccggggtcagcttcttggtgaatgagaggactgactgttgcttgccaggaacaaggtagtcggacccgctcatgttggtctgcttcaccaggtaattaagcccctccagaccctgcataaagatcgtgttcttgcccactgcggtgccgttgaacgagtaagccttctcaaagccgtcatacgccttgtccatgacgatggcagcaaaccaattggccatgtcgacatcctcccagttgaacaatgtcacccgagcactccagcccttgttgtagtccgttgagacatgccaattgatgctcacgccacagaagtcaccgcaaggcatcggccggggcacattgtaatgcttcagctcagcccacgccaacgccttctgtgaccggttgtcgaatggcacaagcagcgcctccggtggcagcagcatggattgtgcggtggtgctgcacgttggccctcgcctgtttgcagggcacccacaagcgcaggtgctgcaggggatcactgagtcgttgtagtacgccgagaaggtcacacaacacttgggcttggccccctttgtcgtggtaatgttgcacaccacctgccatgttgccacagcaagcgtcgtcgagtcaagcccgctcgggtctgggaacgcggttgggctgacaggcaccggctggccacaggcatagtccgggttcagcgatgatgcacccacgatcttgaaattagcaggggggaacagcttagtccggttcaggtctggtggcatcttgaaaacttgcatctggaacgcagatttcgactgtgcctcgtccatggacttgggcaagattgtcccattcctgcagcaattgtcaatcttcccaatctgagtgtcgttgtaccgggacaggggcaggtcaaggatcaccggcttgcggtcacaattgagcacctgcgaaaaatcaaggctctggtagtactgcccaggcgccccacagatacagcccgaggtgtccacctctgatgggtgagctcctttcattgagtagatgaactccccacgccgccactcccacgacagccgccagttgtcgaggcggccgagcttggcgttgttctcgagcgtgacgagcgcaaggtagctggaggggtaggcctggagcacatcgtaggtgatgacgaggtcgccggtgccgcgcggcaggaaatccttggtcgggtcggtggtgttggcgtcgatggcagtggcgttggcctcggcctccggcgtgaggacgcagcacgtggacagcacccgagcagtgacgttggtcgccgccgggcacgcgtaggccgggtcgtccagcgacagcgcggtggggagcggcacgaacgggccgggcccggcgaagagcgtgccgacgatgccgacggaggcctggatctgcgacaggtccccggcggtggcgatgggcgtgaggaggtctgtatgcgggtacccggagaacgaggtggcgttgccggcgtcctccgtggtgttgtacggcaggtcgccgccgcccgtgagcacggcgccgtcgacgccgacgaggatctcgccgtagccgaatgtgacgagtgccgcccaggacttgagcgggcgggtgccggagttgagcacggtgacgttggcgcggaaggcgtagggctgcttgttcttgtcgctgacgaagggccggatcttggtgcggtccacgaagttgtaggtcagctggatgccgttgcagccggggtcgggcgcgggggccgccgcagccggcgtcgtcgccctctgcgccgccgcgagccccgcgagcaggagaagaccgaggaccacagcgtggggagctacggagccagccatatcgctggatcgggggcgcgggcgcggtggactggtgactggggctgggcggaagcgcggtggcgaggtagatgaagcgatcggaaagcgcgtgcacagctgggaaaggaagatgaagggggaaggggtggtgggtttgaactgggggagcggcggcgtgcgtgcgtagtagcttgagtgctggtgctagctacgcctgtcgtctctccctctgctgtctatctattactagtccctacaaagaaatggagaaaacgatcggtttttaacaaaacggagtgggaatcgacgccggcaggaaaagagacgagacgacgagggggtccagtttccagtggagggatgatgaggagcgtgagttgatgttgattgacgaggggcgtgtgggtccgggcccaggaggcagtgactcagcggacgcggagaggcggcgcctggttgaaacggtagggttcggttcgggcagcggcgccgcggacgggcgagatgcgcggcaagccgtccgattctagcgtgcacggctgcggatggggctactgtcgcttgtaaagtggggcccgcgcatgtgccgaggagaggttcaggacggccgggccgtgggccgcggcgcatgttggcatgtgaaagtgaagagaagcaaggagtgggtccaggattcatggaccatggtgcagagaggcagcgcgatgtttccaggaacacgctttggtgcacgcggagttggtaaggaaatcgagtcattttctgtaaacaaatgggaaggccttttgtacacacggtcagttaccatgtttcggaaaaagaacgtgcccagtcccgtgcgtgttttgttgggggcggatagacagacgtgtatgtactggtgagtatttgcgactaaagttaaaactagcaaatgcttgtgtgtttactacggttttcatttatattgactatattcttttggatatgtcatcccacaaactagttagctagttagttcaaatctttgtgatggttatc

SEQ ID NO: 24002 - DNA, 1930 bp, Zea mays
ccatcgcttgaagttgtacgtatgtgcaggcaacatcgatcacagctcacatctcactaagcatgttggacatgcagtggctacgtactcaataatacagctgtatggtacaacctaataataccaatagaaaaggtagcacaaaacatggcttttccgttgtagctctcgatatgtactagctgccaacggtttgaatttttactacaaatcaagtcttaaatgcatgtgactcaaaaaaacattagagcatgttgggttgctagggaacggctactatagaatgattcctagacagattgtttatctaatttatataagcttttataagcagaaatgatttctaggtatgtttggttacaccggaacgaagctaggaactgtttccagatgatcaattagtactatacaaattagacaatcaatttagttgagaatcgttacaggtaataaatactggaaaaccgaacgagcctagtagaaattgaagaataaataaaaccatcagcacgaactgtgaaccttttgtttcagttttttctcctaaataaaaagagaaacattttgtttctctgcatagagtggtgtatggaacatccataagagagcttatcttgaggtgcaaaccgagatcgagatcccgggaataataaatcaatggacagaaccaaacctgcggctagttaaacaacaataagatgaatataccttcagaaaaaaagaagaagagagagatagcaacgatcccaaaattgtagacaacatcgatctttcctgcaatttctgaatttcacaaacatttctccaaatgaagttaaactgatgggcgcacacgtaccagtgtggtacgtgcatgggacgacgagctgggctgcatgcctgctttgctatttttgaaattaactaaaagccgcatgcatgaatcctcaagtgcgtgtttatatgcacgcacaaatctacggcatactatactactagtggttgataaacaactcatgaagcgcacgcatcagcgtcggcggcgtcggcgacgacggcgcccacgccgactccgtagacggccgcgagtgccctgagaagatccaccctagcccgcagccccacgatgtagtcggccgtgcggacaagcagggcccccgcgggcgcctcctccccgccgggcacgagacggcgcagctcccgcacctttcggcgcagcgcagcaccggccgcgcgcgacgacgggcgcctccagccgctggcgctcccgcggggcctccgcctctcctccatggcgctcacgaacgaagaggcagccgcaccagctagcctgctagctagcgagctgttcctacgtggcgggcgcggagagggcgagtcccggcctggtgggaataaataggccggccggccagccgaggctgccaacgcatctcgtcgcggcgcggcgctcggcgggggggtcatgtgacggtacgggccggggagcgcgcttttgcgcggacgtggatgaaaagggcgcccgctaccgaggaaaaaagggtcgaggcgaggccgggctctggtgccggcgggcgattggaccgatcgagacatggagtggacggacgacgagcggtggtttggtttggcggtagggtgggggcccgggcgtggacggcacgtctcgtctggttgtcctcgcccgcacgtgcccgacagctgttctgctctgttggccttggcttccagagtgatcggatcgctacgccgctcccgctttcgagggcggcacgggacgacgccggtcgccggctcccccgtgcgtggctgcctgccgcgatcagcaagcaggtcatcgaggctacaacgcaaggtatcgccatggccaatggatatccgctgcatgccagtgctagcggctacaaatctgtgcacgcgtagagcgctagtgtccgcttccttgtcatgc

SEQ ID NO: 24003 - DNA, 978 bp, Zea mays
ggccgcttttttttttttccttttggtgccagaaattaacacttttttaatctcttctttgccttgtgaaacacctatgtgatgtacagttgtgcatgtaaaaacacaaacagtgttgtctccctctcaactctaaccccagatcctacgacgtagatctgtacagcatcatcacgccgtcctcaggctgaggcactgctggtacaaccacggaccctgccccacctcgtccatcctcctcctcccgctaacctcgccgcgaaacctcaccggcgtcgccacgtcctccaccacctcccggaacggcgccagctcggagtcggtcgacgtggacgacaccgcggtcgcgccggagtccgagttggacggcgccttgagccgctttattattccctgtcgcctttccgcgtcgcagcagccgctgctgctgcagctgctgctgcttggccggccggtcgccagtgtcagctcaaggttgcattccttggccagcgcagccgcaggtgctgcggcctcgtggaagctgatgatgtgctgctgaggacttgctgtcgccctctcgccgcaccagatatccagctgcgtcggtctcggtctcggctcggcgtcgacgaccgccggagcaggaaccgtctgcgcctgctgcgtcatcagctgcttctgggcgtggtacagccggtgcagctcgtgtacctgttgtctgaagatccgttcttggttcaggatggccatcctcatctgctccctgtccatgtctcggacttctcgcgcgcaaccgtggtgtgtggtgtgtgtctcttttcaggatctccggcacggcactccccggtcagaaagcgcgatctcaagaacaagaacagcgaagcagagaaggccaagaagaagaagctctggtctctgctgggtaggctagccggccggcatggccagttatatctatctatctatctatctagcgagcgaggcagtggctcgtgc

SEQ ID NO: 24004 - DNA, 3206 bp, Zea mays
ctgctgcccctcaatacgttagcctttcagactttatcccttagtacgttagccattcggctgctaccccaaatccgttttttcccttcaaaatttacccttttcagctttcttaagtacttttgctgttttctttttcccctctgacctcaaatgaccaaagtacccttctgcttgtgcacattagagctgcgccgtttggtcctcctcatccacatcagagtttgcccaaagtataatcagagtttgcccaaagtataaaagacattacgaataaaaaatgtaaaaaaagaagaataggtatggtagaaaatacaaactcatgcattaaaaaattgtagcaactagggatggcaacggggaattccccgtcgggttttggctccccatccccgtccccgcgacgaaaaaacttccccgcggggatccccacgaacgcttgcgggggacatttcttccccatctccgttacccgcggggataaatccccatcggggatccccgtccccgcttaaattataattagatcatactataatttgttattaatgtaaaacattttcacttatacacattgttagatgtaaaaatcattatgtgtacattaaaatgaacgcatttgtacaactagtgatctcttggcaagataaatatttattttttatcattaactattatatgaaaacatcgtcacatgtaagtttaacgggtccccgcggggaacggggatgaggaatgcttccccatccccatccccgtttacccgtcgggggggaaattttccccgtttacatccccgtgggggaagaaatttccccatccccgtcccctaatagaggaattccccgcggggaatcggggatcgggtccccattgccatctctaaagccagacaacaaaatcattggggtcagttccattaattatcatctaaatatactaactaacactatatttatatagtattttccaaattttataggggtcagctgacccctataagagcacgtagctcagcccctgactaggattagatcacataggtctaggtgtcacttttccaagagtaggaggcagcccctctcggtgtagcagaattgttcatcatctgacaactaccaagcccaccgtaaattaaagccctcacttgttagcagcatgatgacttttcgtgttgcctcaaaggtcatatattggtgacgctagcttctaatttcctcctatactttcttctttgtcggtaggatacctttggttggcttccatgaaaaaaaaacttcaccttcgtaggcataattccagatgttgcaccaatgtttcttgtccccattcggctgtacacttcagaacgagttggtgtctcttaggttgtttacggccgtggatgtgaaaaatgagtaagaaaattacactattcatgtgtccaatagatcgcttatgcgattgcgcaaaaatgcatgtcctcccgcgatatggcacattctcgcgagctcctgcagttaaaacggctgctgctctcagctcatacttgtcctcgaaattcatgcgcgagccctactgagctgacacgcgaccgtttcctcgctcgatctgctgagatcgaaatcgatagcttttgcatccaagtgcaggaatccagatgatgcgatcatccataaatggataaacatactgtacagtgtatttgaacgatggatgtcacaactttactccacacaatcaacagattttgcaggtcaggaaaatgcagtcaatatgtctgaaatagtctaccacagctgggaaaccaaccactacaacaaacagaatgaaccacatgaataaactgaagggatagagaggataactaagtttctgagacatcatttctagcgacgtacaactatgagtacctatatttactgcactgcaaattcagctcaggttgccaccactggctgatgccgtgagcgtacttgaaatcagacgaagggctcacgttgacgattagatcggcagacggaagaaggtgcagcggttctgactcccaccctagtgccttgaagaacaggtctccgatggaattctgggtcgcaagcttctcgataaatccggcaccaagatcctccatgttcttccggtgctggaagtaccctatgtactctgagcaaatgtggtctcctggattaacgaacaggtacggcgtccatgatgacaaaatgctgaaagattcttcagcgacggatctctgactgctaccctcagttttagctttcatggcaatagtcaatccagcagtaatcacgcttcttgcaatacgaaatccgtgctttaccctttcgtccctgatcctttcaactggagcagcaacgaacggtgggttgaagagaaagctttctaaaagcacacccttcttaaccatgtttcttcccgtaaggatggccaggccagcgcctagtgaatgccctgctagccaaatcgtggatccagggaaaaccgaggctacgttttgaacagcttgcattgctatattaaatctcgaggtcctgtggagaccattttgaacaaggtgcaggtccagggaaaggtccctagagatagtatccttctctgttatggtgcctctgaatgcgatgacaaatcttggagcatttgcaccagaagcttcctcctttggagggttgaattcaaatattgcaccaaatatggacatatcagcatcatcaatcagcttgcgaatcagctcaaaatggaggaattcccaccaagcaggtgccaaggcttcaaaagattgatgattcagttgccggtctctctccaacacatatacagcctgaactaagcttgcagccacagatctccgattatgctcacagttccaatcgattgatttcagatacgttggcccagaaattccaaatatatctctttccacagccatggcgtcacaaaaacgtgttcttcacttcgtgccgctggagaaaaacatagcacgacaattgacgagatcagatccacgcgcagccccccgcaggggcacgctgcaaggaaggaggagaggcgcggttgccacggaaacaagagaggatgaccggccccggatctagaaatggcaggcaggcgtgtgcgcgctgcgcggcggggaaaaccaatgtctgttcgcctgttcggttcggtctgcactgtctggggaaacgaagggacagcggcgcgaggaaaattcggcc

SEQ ID NO: 24005 - DNA, 2367 bp, Zea mays
  misc_feature (762)..(762): n is a, c, g, or t
ttttttttttttttttttttttttttatacacataaaagtactaatatttaatacgatccaacaaatgttagatttttttactaaatctaatcaaagttgaaactgattgacatctgaaaaggagacgcccattatttttgaacaaaggtagtaaaataaaattgcagtgcagcgccctttcggtcagagggagtgcaatagactggaaacatgtgctgctgaccccccaggtttccagcctcacatcacacaaaaccccgttttcttggaattccacgcgaccatgggcggcctgccaagtttgccacgccgcccagctcctcgcctaagctaggcctaaccacgtgtggatggccatgagcccatgaccatgaccccattccagcgcccagccaggctgcacgaaatatgtgtgcgtctgcgtccagtcctcaaaagaaaaaggaattcagctcagtgcgctatcgctgctacgactatgacttgcactaacagaccaactgatggcaaggaatggctccacgggtgtgcttttgtcaggcagaaagttctccgcaaattacatggagcagaagttctgttaggaccaagcaggagggcacagcttgcaagacaccatctcatgttgaaagcagccttccatactcgctcaacaggacgggaatgtcatccatgcgcaactgtgaagcactttttagatggaaaaaacggagagcttccatttcacgaaaagctggcaatgaatttcccgtatagtgtcngcaagatgaggcgttgatagtccctcagcaaaggtcctagttcctgtagttgtagtgagcttgctggagaacttttccaatgatcacgaagtacctgaattgatgcaacctggtcactagctggaagcgattgaccagcaagtctagatgacaattccacaagttctttatcattggcttcgtcaacaaaacttgctgaaacttcttcagaaagtgcaatccccagacgtttggccaattctgttattggattttctagagcttgtgactcctttaggttcaatagctggttatcatcagtcacagtgctaggtttgctgtttgaatcgatgctaggaactaagtctcgttttgcgcaataggatcgtcttcaggaacaagccaccacaaatcaccaaatgtattctttccatcaaagccaccaaataaaagaaatcgagaccctatggaagttatggaatgatatgcccgaggaggaggtggttcattgcttgttggtaagcgcttccattgaacagataccctgtctaaaataatgcattcattatagtacacatcatatctacttagccaaccgccagttccatgtcctccaaacagcaagagataaggtccaccagatgttactgaatgaccgcatcgtggtgagggagattgccctggaagtttcaactgtgtccaacctggcgcctcattgtcttcttcagtaataccctttaaagcccataaatcacccattattggtcctgctccacctctgcctccaaatataaggagtctcttctcaatcatggttgccgaatgcccacatcttggaggtggcacagatccggtaacagctaattctgtccactctagtgacattgtgtccatgatgtatacatctgaaagccattttttgccatcccatccaccatacataacaatctttctgtttcctatggctgaagcagcagcaaactctcgtggtgatggtaaatcaccaaagccagtcatctccgaccattgccataagtcagtgtctagcatccagaaatcacctaaacgcttgcccccagatcggccaccaaagatgaacatgttgcagtcaatgacaacagctatgtgaaaagcccttgggcttgggccggcctgcccatccgacccattaccagtgcactcaggtgtgtaccatagcttattctcgacgtcgtagacggaaacatcagcgaggaagcgcttgtcggcgaatcctccgaagacgaccaccttggacttgccaatgataaccgcagtgtgcccgctgcggggggcgggacggtcgcccccgaagtcggaggagtcggccctcacccagtgcatctgcttcggttgcagctgctgcatcctttccctcgtctccttgtcctcgctccagctccccagtctacgcgcctctcttcgtgaaggaagtggacacggctgcgaccgggaggatgagccctgtaccggcggctggatggcggccgggggcggcgagcggtggacggcggggagtctggcaggtgggggagaggggatcggacgaagcagagaagtcagagcaggaggatggaaacagtagcgccccaccccgacccggccggc

SEQ ID NO: 24006 - DNA, 1164 bp, Zea mays
ttttctcgataagcttttttttttttttttttatccgaatggcttttttggtcttcaaatctgacgattttgagtagctggattcagaaagtcagatttcaaatatttggatttagatatagattatccatataaagttttgaccatttcataaccgacggatatcgaaaaatatccgtaccatttccatctagtctcgctgtatcgacgccgcaagctcctgacgccggcgatcaccagggcctctcacttaacaggcgcctagcctaggtgagatgaacggtgcactggctcttccgcggcctgctgccccatttctcatgttcctccagctgctctaccatgtagtggggcacgtgcacgcgcttggacccgtcggccagccgcttgcagggcacccggggcgccgcggccgcgaactcgttaaggacctggttcctgatggctccgaccagcatgtcacggcacccgttgacgtgcacgtcttccagcttggggcactggatcagcagccgctctggatgaaggttcgtgcaggagttgaggttcagctcgaccagctccgggcagctcacgtacagggcatcgatccctgaacagccccacaggctgagcttcttcagggcgctatgctttatgatcagcttctggcaagtagcctgctgctttctctggacaggtaatttggagcagaatttgatcccatcagttagatcgccagagtatgatctcccagcttcaggctggggggtagcacatatgctcttgccacagtccatgaggcgaaggagcggcagctgtgctgcagccacctgaatcccgcatggggtgatgtttgggcacagagcaaggagcagacgtgttagggtgttagggaacgtgttgctgatcatcccaagcccattgtcagtgatgccagacccgcttaaatcgagcagctccaagctcgcgtaagaacgaacaatcgatgcgacagctgcatctgttatttttgaacctagaaccaaggagagcatgcacatgcccctgaggttagcactctctagagcaaacacagcttcgttgcacaagcggtctgatgagatgtgcatgttcctcaagttcgggcaggtgcggcctaggctatccattagagcaaccaggtcagtagaatcattattttgg

SEQ ID NO: 24007 - DNA, 3273 bp, Zea mays
ctataccataggaaccttgattgcccgagacagacaggggggcaggtcgagtctccccttttttttttttttttttatatcatcacatctatactattcttcatattatttcagattaccgatagacatgaactttacaatatgatgtcccagaaacctctactgaggaatttatgtgggtattgggaggtagccctaactgaggaattcatcagctggctggcagccgcagttgcaatctatagagagacaaaatactgtagaagccacggccggattaaagccgcagcgaacaagccgggatttaagaaaatcctcggtctcatgtcgactttacttcgaccaccgtgttgactattatccatttatcctagaaaacaacagatcatatacaggcacacagcaaaaaaccgcagttgcctttattgttggcgcatttgatgctgcttgatcagaagttgagcataaaccagttcattccaggaatctggtactccagggaggcaccagtggctgcagtcctgaaatctttcgggcgatctcctctcctcgtcagtcaggttctgcttgcggtagatggaagggtgtgcatcctttctgtagtcagccattctcgttatgttcaagtaaacgaccggagttttcatcttgtggatcacgtcctccaggatgctcatctttggtgggtaggttgaaaggtactgatcgttggttattggtttactctccttgtcacagccaccgcctgaattccattgtccgccactgaaatgagatgctgagtagcctctgaataacaccagagtttttctggggttaacattggcatcgatccacttggaccaggtgagaagagctttatgaaaggcatccatgacattcagctcattatacacatggttaccttcttgatagtagtccttcccaagagcagttttctcatgtgtccaccaatgccccgtattgaaaatgataaagtctgcatccttgtacttcaatgacgattgctctaccagatcaagcctgagagtttcctttttctttccactgctcacttgcatctcccattcctggactaggaatggggagcggaagaactccacgctgcagttatagtccgtgaaaaggaaagagtatgagccttccgtcttaaactcgcgcctgccagatgcctcaaaaaccttcctcttgtctttgacagaatttctcaaaatacacacaagggattcccacatgttcctattgagcgaatcaccaacgaacaccagtctttttcctctcagcctctccaacatatcggttgggttcaatcttgggatactgcatccactgggttgccagcggagcttctggtaagctagatctcgccgaccgttgaggtagcagtcgaagggctcatcaatgtgaggacacgatccctcagggtagagagggtatgagtcatccctaacccaattcccactaaacatatcgcaactagccatttccttgtaccaatcacctttcttatttccaccagaaccaccatcctgtgttattgatgacctgctacccttgctgttatttccagattttgaggagtttacttgggccgaatggttctctgatgaaccagcactgccctgagcagcagcatttcctttcggattattcactgtaccactgctcccgccgggagcaacttggctccaggtctgttccgggttcttcactgggggggatgctccaactgtgttgttgttcctgggagaaccaacatctttctgccctaccgatgccggactcccagtttgattaacagttggaacaacactcacgtttctcttactaccctcaacttcgccatctcctgcaatgctctttgccggactagaacttccaggtgatttatggcttgcatctccacttccactgtctggttgagcatcttctgtcgtcacaacctttgcacctttactcttctcgaaaccagaacttacatctgattgatggcttgcatctccatttcgatttcctggctgggcatctgaacctttattcagatcaaccatggtacctgtgccgtttccagaagaccccctgctccctgccccaacagcatctccaggatgaggctttacagtgcttctatttccagcatccgaaccactgcctgaaacgacacttccactccctgccagattattagaagatccggtgctcaaatctaccttccccaagctaccactcccagcagaactattggttgaaacatcacttgcaactttggcctcagctctgacagtgctgccatgtccggtagcagcattgctcagggctccgcttccatttcccgactgcttattagacccattaacgctattctcgcggacctccgcggcggttccatgcacggctgaactactggccggggatccactgccgccttctgtagaaacgcctccgtcgcttcgtttattcagatccaccgcgtcgttcggagcaccgacacctgaggcggaactgttcgttggagctgcgcctccgccaattccagtgcctggcaaatggactgccggaggtacactccgagcgcccgcattgccgatcggagcgccgcctccagttcccagctgcttactagacccagccttggcagagctgatgctttccgccgcgctcccaacttgcacagtgctcgcatcacgggtcacctggccaccgcctccgcccgatccgccgaacgtgacgcgcagcggctctggcgagggggcgggcgagtcggcgggcaagatggacgagaagaggctggaaatctgcgagcggtacggcgccgtggacgcgtacactccgccgaaccacgaggcgccggcgcccgcggagggaggcgaggcgaaggcgacgtaggcggtgaacgcggcgaaggcaaaggcgaccgcgtacagcgtcagcctcgtgcggcgccgcgagcggcctccgagagggctgagggggccggcgtcggcgcacaccaggccgccgctctgcttccacatgctcttcatgccggccagccgctgcggcgcggggctacggtgtgccgcgctccgggatggggagcgcggcgagtggaggacgcggaagcgactagaaagcgagactggccgtggtggtggtgggctgttggcaattcccggccggtggcgagtggtttgaggaagcttttggggaggaagggggtggtgggcctggtggctataggaattttgggtgccaaaaactaacaaacccactacaaatccgtttagatttgtc

SEQ ID NO: 24008 - DNA, 1900 bp, Zea mays
ttttttttttttttttttttttttttgcaattaatccatttatattgtggcaaggctattattatggataaaaacaaatattgcgtgtcgtattacagtaactgcctagaaagaagattttgcagttcaactgcttacataaatgagcaaaataattaaccaacattacattacaatcttgctaacaaagctggaaaattgcggcagggaaccattatatcccacatccacacagctccttcacaacatctcatctacttctcatctacgaacagacttaaaacggtacaacataaggcagctgatagatatgaaggtccggcaaaaaagttgccctgggttgcaaataaggctgctgctgcaccatcggatgaatcggccctaaaccatcaggtactgtgggttgagccatgctaccatcagagcttcttgtactgctgaacagccagtcttgaccacccaaatctgaaccttcattctccatcaatagcggattccaggtaacaaacagatctctgaacttcttatttttcttctcagttttgtggattttcttccgatctgaacgggagagcttagcttccttcccttgatctgcttccacagtccttccagagaaacaaggctcttcttttggcaaagagttgataggctcccgctgtttaggaacaggcaagtccttgggtttctgcaaaacaggaggatgtggagcttgtggcaggcaaacagcagatcccatttccttctgtgacaccttcgcctgaggatcaactctctgtgacaccatggaaggtggatgctcaattctctgttgcgtcttaacaggtgcaggacaaaatcttccggtcactctagcaggtgaagggcccacacttcccgaaaactttggaggtaggtcagatcttccaaccggcgccttaacagatagctggggatcagcccgacgtgtgaccttcactgcaggctgggggacagttctctgcattgcccttgacagggtttctgtaaccaaagatttttgtactgcttgggagtcaccattgacccactgctggccagctgtagatctcacattcaccttacgattgattgaattttgtttgctcgacagggatgaaaccgaactcatttgttggaccagtggttgctccagaacccttggtttctccaaaagaactgattggggatcttggttactttttagcttgatgcgaatgatgttaccattcttagcttggctgggactgggcaggacagcctttcttctcttgctgctgtcctgcgagctctcaggagagtcacgaaacatctgtacaaaacaaggagctccatgctcttctgagagtccactcttctccaatagctcagctgattctttgaatacttttttgggctcctgatcacctgtgctgacatcttcgagctttctcttcttatggttgtgctttgaatgtttggacgtctcacccagttggggagctttcttgtcactccttttatctttcttcttgtgagccctttccctttctttctgaagcttagcggtcgactccgcctcggccacggccactgggtttcccaagtacacaggcggcgggtaggggaagcacctcgacatgaccgacggtcgaccgcgctctaccccttcgagagatcacaaggattggcggctttgccggcctaatcaatcgcgaagcacccgaaatcgatcaaatcaaccgaatcgctcggaatcgatcgattcgcggcaaggaaaccaccggaaattttcgggcgtggcgggatttggttttggcgcggcggctagggtttcgctacggggaagggggaaattttccggggccgcggtgggagaaggaaactaaaaggctggcccccggccggcctcgaggtacccaat

SEQ ID NO: 24009 - DNA, 3974 bp, Zea mays
ttgtaaccatcatacgtagcgccctaacagcttcaattcgacatctattttagttagccaatgtaattaaaatcacataattatttacacaccatctagaccgtacaatatcattatcatagcgagacctgttattgttattttggctaacagataaatgctgatcacttgtcagttgctgcaattaatccatttatattgtggcaaggctattattatggataaaaacaaatattgcgtgtcgtattacagtaactgcctagaaagaagattttgcagttcaactgcttacataaatgagcaaaataattaaccaacattacattacaatcttgctaacaaagctggaaaattgcggcagggaaccattatatcccacatccacacagctccttcacaacatctcatctacttctcatctacgaacagacttaaaacggtacaacataaggcagctgatagatatgaaggtccggcaaaaaagttgccctgggttgcaaataaggctgctgctgcaccatcggatgaatcggccctaaaccatcaggtactgtgggttgagccatgctaccatcagagcttcttgtactgctgaacagccagtcttgaccacccaaatctgaaccttcattctccatcaatagcggattccaggtaacaaacagatctctgaacttttttttttttttttaagttttgtggattttcttccgatctgaacgggagagcttagcttccttcccttgatctgcttccacagtccttccagagaaacaaggctcttcttttggcaaagagttgataggctcccgctgtttaggaacaggcaagtccttgggtttctgcaaaacaggaggatgtggagcttgtggcaggcaaacagcagatcccatttccttctgtgacaccttcgcctgaggatcaactctctgtgacaccatggaaggtggatgctcaattctctgttgcgtcttaacaggtgcaggacaaaatcttccggtcactctagcaggtgaagggcccacacttcccgaaaactttggaggtaggtcagatcttccaaccggcgccttaacagatagctggggatcagcccgacgtgtgaccttcactgcaggctgggggacagttctctgcattgcccttgacagggtttctgtaaccaaagatttttgtactgcttgggagtcaccattgacccactgctggccagctgtagatctcacattcaccttacgattgattgaattttgtttgctcgacagggatgaaaccgaactcatttgttggaccagtggttgctccagaacccttggtttctccaaaagaactgattggggatcttggttactttttagcttgatgcgaatgatgttacctgtaaaatgacaagtttgtgtgaataaaatcctgaaacaagtgattggtatctactcaaaaacaaaataaaaaacaagaaaacagtttcaccattcttagcttggctgggactgggcaggacagcctttcttctcttgctgctgtcctgcgagctctcaggagagtcacgaaacatctgtacaaaacaaggagctccatgctcttctgagagtccactcttctccaatagctcagctgattctttgaatacttttttgggctcctgatcacctgtgctgacatcttcgagctttctcttcttatggttgtgctttgaatgtttggacgtctcacccagttggggagctttcttgtcactccttttatctttcttcttgtgagccctttccctttctttctgaagcttcagccaccagagcaatcgtcaattctgatttagaacagacgacgggatgcaatgcagtatttttgcaatatatgaattttgatatttacaaggacacaagaaatggttgtagcatttgcacagttcagacagtgatgcttcacaaagattgttcaattatcattgacttataattacacagttagccaaagaattgcattcagtttacaatcatgttgaacacattactttcttgacaacagttaagacctgcaacactgcacactctagaacaaaaactttcaatgaacacaaaaggtgtcagttgctattgctatacacggccaaaataatcctgaactcctttgccaacagaatagtggcacaaattacatcagaccagaaaaaaaaaagaaacataaatgcagtacccacccacaggagcacagtagcaaagaaggaaccctaaaaacagtaaaacaagatatgcaattcccattcaaactaatttgtctttccaacaacacaaaagggcgtcaaatactaatgctaccccgtgctaaggaacacaaaaagaacagcacaacatggcaaccgatccttttaccaaaatatgatattgtataaaaattaatttaaaattcaactaagaattgacatacacacacttagggatgaaagtggatatccaaattgtttggacaaatttaatattttaaaatagatatgtatgaaatttcatgatcttcttttcttatgttatcaaacacataattataattagaataaaatttgtataaattgttttatgcatttttcgctccttacagcaaaaaagatgaaaagaaaatatctgattccatatttttatatgtatccgaatttcatacctatcatttgagaaaatatatgatacaaataagatttaccttttattaatctttacaggctcaatggcaaaaacaaaaaatacaaatttgcatagaagattatatatcttatttattcgcaatcaaagaaaaataaataaatatccaaataagtatccattttcatcccccactatttacacagaaaattttgtgcaacatctaattaaacagtcacaaaagcacccaggcgtcatattctaaccatgcaaatttggccataacagatccctccagctcacgccgatgtaatgctagggcggctaaatgtgagatacaacagtgtcgaatcaaatttcttgtcctagcattctttcaatgttcctgataatcatgcaaccagtattcaaaaatcggtcttaatcaatctctaataggtgccatccaacttaaatttttaaatcgatctgaatggcatcgagtagctaagctacacaggtccagaattcaaaaatcggacttaattaatctcgactagcggtcatccagcttaaaattttaaatcgatctgaatgtcatcgtgtagctaagctacacaggacgaatattcgaaaatcggactcaataaatctcgactagcggccatccaacttaaaattttaaatcgatctgaatgagatcgagtagctaagctacacagaattcagacacttccctctgactcagggctccgactcagggcttgttcggttattttcaatccatatggattggaggggattgatacggattgtgagagattttgacttaatagggattaaagcctcctcaatccatatggattggggtagaaccgaacaagcaggttagctttcccagcacgtgcgatacccaaatcacacacgcacaacccacagatcctagcagcaacaaccaggaagaacaaacgatccggtgtgcgtgtgtaaatccgaaggttcaacaaaccttagcggtcgactccgcctcggccacggccactgggtttcccaagtacaccggcggcgggtaggggaagcacctcgacatgaccgacggtcgaccgcgctctaccccttcgagagatcacaaggattggcggctttgccggcctaatcaatcgcgaagcacccgaaatcgatccaatcaaccgaatcgctcggaatcgatcgattcgcggcaaggaaaccaccggaaattttcgagcgtggcgggatttggttttggcgcggcggctagggtttctctacggggaagggggaaattttccggggccgcggtgggagaaggaaactaaaagcccgcccggcctcggggtaccc

SEQ ID NO: 24010 - DNA, 1198 bp, Zea mays
  misc_feature (56)..(56): n is a, c, g, or t
gtgcactctatttatactgtgccatatccaaaaataccgaaaggaaacacagaganccttcttataatataaacatattaaaaggtctgtcgtaatgtcgttcacaaaataatactctctctgtcccaaaatattttttttacctttttagttgattcatacaataattaatgtatttgttttatatatatgtctagattcatcatcatccatttgaacatagacataaaaatcaagagctaaaacgactaatattttgggacgtagtattgctgtattgacagcagtccaagagaggggtaatcatgcttacaggagttggcctcggagctccacatttcttcatgtgttgcaagtgtttctgaaggaaaagttaatgttgtcgcatttgggacaggtccagtcaccctcagaaagtccatcagggcctccacggcgctttcgtgaagcaatgttgtcattgttttcagctaatgctccaccagaccatggactagaaaccggcattggagaacctctaaacccatagctatatcggcctagctcaggtcctgggccatatcccataccactcattggcccaggtggaccatatgaagagaaaagaccgtatgaaccaggaggtcctactggtggaccatagccatatcgcatcccaaggtgtggatatggagcaccatagctaccagttccaagcggaattggaggtggggcgccaccacctcctccgtaaaatagaggtgaccggtcatatccagaagcaggaggtcctgacatcattcttggacttggactcggtgatggacggggtgcaccacaggctccacggttgcaaacatttctaaaactgaagttgacattaccacactgaggacaattccagtccccctcccttacagacacgtcgttacgtgaccttttggacagcgcgcctcggttctccacctgctgggcagcaccgaacttggccgaagccatcggcgaagagacggaacacagcaacggcggcggcggcgataaaggtggagggccgctccgcgagaaatcgagagagaagggggcgtgtaaaattattatttatttataatcatgaggatggggatggattcgctgcgctggccacgcgccgcggtgtggtggccggtgtgcccatgtgacatccatgacaatgggtacccgcccgcctcgaggtcccaat

SEQ ID NO: 24011 - DNA, 1231 bp, Zea mays
gttgggggggggatagatataatgatcttccctagttttcatcatttaataaaaatgtataatagtaaattaagcgtaacgaatcgaatctctcgtctccaggcacaaacatcttcgtgcagttcaaagattgcacacgactaggatacaatctacgggtacaacaatagctggacgatgcgcgaaggttgggttcagttgttcgccggggctggcttgctgtacgagcatcctttcctgttacacaccgtgcggaatgggtagttcaggttgttgcactctgggcaggtccagcttccttcaggggcttccttattgctgttgtccttgcgagatgagctcgtgttacctcccggagttggccttggggctccacatttcttcatgttgcaagtgcttctgaaggaaaagttaatgttgtcgcatttgggacaggtccagtcaccctcagaaagtccatcagggcctccacggcgctttcgtgaagcaatgttgtcagtgttttcagctaatgctccaccagaccatgggctagaaaccggcattggagaacctctaaacccatagctatatcggcctagctcaggtcctgggccatatcccataccactcattggcccaggtggaccatatgaagagaaaagaccgtatgaaccaggaggtcctactggtggaccatagccatatcgcatcccaaggtgtggatatggagcaccatagctaccagttccaagcggaattggaggtggggcgccaccacctcctccgtaaaatagaggtgaccggtcatatccagaagcaggaggtcctggcatcattcttggacttggactcggtgatggacggggtgcaccacaggctccacggttgcaaacatttctaaaactgaagttgacattaccacactgaggacaattccagtccccctcccttacagacacgtcgttacgtgaccttttggacagcgcgcctcggttctccacctgctgggcagcaccgaacttggccgaagccatcggcgaagagacggaacacagcaacggcggcggaggcggcggcgataaaggtggagggccgctccgcgagaaatcgagagagaggagggcgtgtaaaattattatttatttataatcatgaggatggggatggattcgctgcgctggccacgcgccgcggtgtggtggccgtgtgcccatgacgatccacgacaatggtcccggccggcctcgag

SEQ ID NO: 24012 - DNA, 1279 bp, Zea mays
ggccgcttttttttttttttttttcgcgcaagaaaaaaatgaatcttctatttttaaactgtgttgggaacaatgacgggtctttttttttcgaacatagaaagtatagcaagtaaattaaacataacgaacaaattaaacgtaatgaatatattcgctcgtctccaggcacacatttttgtgcagttcaaagattacacacgactagctaggatacaatctaaggatacaagaatagttcgacgacacgtctcaacaatatggtgcgctgtgcggaggttaggttcagttattcgtcggggctgacttgttgtacgagcatcctttcctgttgcacaccgaacgaaacgggtagttcaggttattgcactctggacaggtccagcttccttcaggggcttccttattgtccttcctagatgagctcgtgttagctccaggagttggcctcggagctccacatttcttcatgttgcaagtgtttctgaaggaaaagttaatgttgtcgcatttgggacaggtccagtcaccctcagaaagtccatcagggcctccacggcgctttcgtgaagcaatgttgtcattgttttcagctattgctccaccagaccatgggctagaaaccagcattggagaacctctaaacccatagctatatcggcctagctcaggtcctgggccatatcccataccactcattggcccaggttgaccatatgacgagaaaaggccatatgaaccaggagctcctactggtggaccataaccatatcgcatcccaaggtgtggatatggaccaccatagctaccagatccaagtggaattggagatggagcgccaccacctcctccgtaaaacagaggtagtcggtcatatccaggagcaggaggtgctggcatcattctctgtaaaagaaatagaagttaataaaaagacatctcaaagagttgaatagttgataacccagacatgatgcataaacatattccctttcatggagacttttgcgattatgaaacgccgcggatgtggcttcgacgaaacggaggcgttggcgagggtttcgacgatatgaaaaaccaggggacagactccactcgtcgttgcgtaaccttttcgacagcgcgcctctgttctccaattgcgtcgcagcaccgaccttagcaaaagccatcggtgagaggagacgacggaacacgcggcggcggcggcggcggcgagaggaggggagggccgctgcgcgagaaatcgagagataggagggctcgtaaaagtgct

SEQ ID NO: 24013 - DNA, 1135 bp, Zea mays
ccccccccccctcccccccctcctcctttcttttaaaggaatatattcgctcgtctccaggcacacatttttgggcagttcaaagattacacacgactagctaggatacaatctaaggatacaagaatagttcgacgacacgtctcaacaatatggtgcgctgtgcggaggttaggttcagttattcgtcggggctgacttgttgtacgagcatcctttcctgttgcacaccgaacgaaacggggtagttcaggttattgcactctggacaggtccagcttccttcaggggcttccttattgtccttcctagatgagctcgtgttagctccaggagttggcctcggagctccacatttcttcatgttgcaagtgtttctgaaggaaaagttaatgttgtcgcatttgggacaggtccagtcaccctcagaaagtccatcagggcctccacggcgctttcgtgaagcaatgttgtcattgttttcagctattgctccaccagaccatgggctagaaaccagcattggagaacctctaaacccatagctatatcggcctagctcaggtcctgggccatatcccataccactcattggcccaggttgaccatatgacgagaaaaggccatatgaaccaggagctcctactggtggaccataaccatatcgcatcccaaggtgtggatatggaccaccatagctaccagatccaagtggaattggagatggagcgccaccacctcctccgtaaaacagaggtagtcggtcatatccaggagcaggaggtgctggcatcattcttggacttggactcggtgatggacggggtgcaccacaggctccacggttgcaaacatttctaaaactgaagttgacattaccacactgaggacaattccagtccccctcccttacagacacgtcgttgcgtaaccttttcgacagcgcgcctctgttctccaattgcgtcgcagcaccgaccttagcaaaagccatcggtgagaggagacgacggaacacgcggcggcggcggcggcggcgagaggaggggagggccgctgcgcgagaaatcgagagataggagggctcgtaaaagtgctcatggccgtggccgcccgtgtgcccaggcgtgcgacc

SEQ ID NO: 24014 - DNA, 1340 bp, Zea mays
tttttttgtccgcttgttatttaactcaagcataagtaactaggtatatatagatgtcaacatggtaatcacgaagttcatcaaagggattacattctggaactgttgagttcagatataaatgaattctccacccctaacagcatttgccgcaccccttctatcttcttcctcttccctttcacgctccttcctgctctcatacacatggtcatccgtcctcagctcatgccggcagatagggcaggagttgttctcgtccagccatggcttcagacaaagaggatggaagagatgcttgcagggaagctcctgcatcttgtcatccacaaccaagttttcgcggcagacagcacactccgtctcactacccaatctagacatgacttcctcggtaacagcaatgacaggaagattggcgacaacttcctttgaagccgggggtgccctctgtggatactcaatgattccctgcagtgattcttccaaagcagtttctagatccctgtcgcctgatatggtttctaggaggttcattatagcaggtgtaatctcctcggctctaggcactgttctgttgttgctcccatcttgatcaccagaggattcagttagtatgctcaattccctcgttaaattctgggcaacaagccatgctggaggtggaggttcctgtcccacagtaaggtgcccttcaaaaagaaatctggtgtctgcttctctgttgcttggcacagaatcctcattttccttttcatcaagatgctcacgggccctcgaaatgcaggtcttcaggtgctccttttcagcaggattacttaccagcttctctattccaacgaagaggttcagaccaacatgccagaatcctggagctgtatatctggtttgaagcactgttgcaacgcggcaaaccgttgaatacatcgctttgcggagggcgggggaggcgccggcgtagcggtcccggacggcggcggcgagctcgtttacggcctcctcgaagtgctgcttcttcccgagcctcccccgcagctcctggaggcgcgcctccaccgcggcctcgtccgtagcggtcgccgacatggcggtaggctgtggtgtggtgggggagtagagggcaggcaggggcctctggtttggatccgcgtcctgtgatctcgagagttcgggctttggtagggttaggggggtcgaaggttggcgtgggtcgccgcggcggaggtataaaagaaaggcgggtgccggtcgccggaggcgggcgccgcgcgctggcttggaggagaggaaagaaacaccgcggtaggcgccaggcgggagtgcgggactttcccggccgg

SEQ ID NO: 24015 - DNA, 852 bp, Zea mays
ggggaaaacattcacaatatattattataaaaaaggcacaaaaaatcgttcatatagtgttgttccttatcaaaacattttttttcaaacaatgtagttgtttacatatcatggaatggtttctggagcgagctgattacagaagcaaagacaaagatgcaactcagattagctgttccctgtcatgtcaagcagttcatcaagaccttttagtctctgcttcccttcactaatcaaaaacctaatcttttgtttgtcatcacaatggcgatatttctcaaactcggcccttgcggtctgcctcaactcatctcgagcatgtaccggggctcggtgagtgatacgcaatgcctgtctataaagcttcaagacatgtgtacgcaggatgaaagcccgtaaatccatgaaatacgccattgaagaacaacttaatgccaagtaatggtcaatccatgtgaaacctcccagcaagcaacttactaccgcaccaccgctgggatgtgcgtctgctccgccgcctttccgccaggtgctgtcgacggccgctgcctacttctctctctccggtcgctcctttgctccttgcctgctcggcccgctggggcttgttcacaaggctgcgtgcgggagagacagcaaccagcaacggggaagggtctgggggcggcaacggtgtcgcgccgaggagaggacgggggcggggccgcgggggcggaggaggggcagcccgggaggaggcccgcgagtgccgccggccgggcccggcacgaggggaatatttgtgtacaacaaataatcatataactccaaaccatatatctcaaatcctttacttaaaattcaaagcaaatc

SEQ ID NO: 24016 - DNA, 1279 bp, Zea mays
gcacccgctgccgcctgccgtagtgctgctcccggccctccctctaattgctcttgccgctttatgtatttgccgcgcgcggcgacagagaatatacacgagtatatacagtagccgccgccggtggagtctctatctggcagccggccggtcggtcggtactctgctctagaagctagagagatactactctgcaggctagctagctagctagaggtagtagaagaggccggcccggcccgattgaagaataacatagagctgtctgctgctgagcgacgacggcgatggtgctctacttcaaggcgcgtccggacgccggcgactacaccatctacatgggcgccgacaagaacgagaacgaggagctcatcaaatacggcctccccgaggacgtctggttccatgtggacaaggtatcctcggcacacgtctacctgaggctaaagaaaggcgagacgatacacaccatcagcgaggccctcctggaggactgtgcgcagctcgtcaaggctcactccattcaagggaacaagatgaacaacgtcgaggtgatctacacgccctgggctaatctcaagaagtccccatccatggatgtcggccaggttggcttccacaacccgcggatggtacatgtgcttatagtcgagaagcgtgtcaacgagatcatcaacaggctgaataaaacccgggtagaacgccgggcgccagacttgaaagccgagaaagaggcatcaaatgcagcagaaaaggccgagaggaagatgcagctgaaagagaagaaacggaaggaggagatggaaaggctggagaaggagaaatgggcggagatacggagctacaagggcctcatggtggccgagaagatgacgtccaaccgccagatcgcctccgccggcaagtccatgcaggaaatggaggatgagttcgtctgaagacgactgtcatcgtcactggagtctacatctctctctctctctctctctgtctgtgtgtgtgttgtgtgtgtacgtacatatgtccatgctcgcgtgataacgacgagtcgaagcaaccaaaagatctcatggatcgattattcgatccgttcctgatcctccgttgatctgtgctctgtacataacatgtgctcccagcatggacatgtataggtcacgagaagagctagcgcgtatgtatacaagtaactagtgacgagctgttgctcggagggatcaacatatatggagttcatcaagagaatcggtgcaacacgcttgccaccaggagaaccagc

SEQ ID NO: 24017 - DNA, 5602 bp, Zea mays
agtttattaagggcactattgttggagcgcaaatattttgtgccctaaaacactttaattgaggcccctttttaatttatactcctgtagatgctcttagctgcatataaacttaccgcacccatcttaaaataaatgaacgccccatgtttcgaggaaccaactaatttcaaatttaactaggtttaaagaaaatacaaccaacatttttttatctccaactaggtttactataaaatatgtaatgtgattaatctaataatatatgcttaatactgttggcgttcgaaaaaggttataaccacagtggaaatttacttatcatggggatattttttgtgggcagggttgcgacgatgcgacgtacggacattacaatagtataaataaagttatacttataaaagtcctatttgaaaatgatctaaaaaaggagagttaaaaaatttaatagaaaaggcgattattcccgcttaaatgcggctgcggcgacgaagaacaccgaccagtgcatcattcatacaaatcgataagctttatgagccccctttatccaaaaatttcccagcatttctttgccgacaatcctcttatctaccaggtgaccgatgacgcgatacgtgcgagatcgacccttttccccttttttattatttcctttgaaagaagaaaataatgccctcgtggattcggccactcttttatttaacgaccgatttttccactattcgtaccatgtaatctgataggctgtccttggcttgttcctttcgcctccgattccgtcgccattcaggccggagtaccgccgatctgagaaatactactgcgacgcgagtgccgaaaggctgacgcgaacggatagagcgaatcgcgcctaggtgccgtgcgtgggtatcagccgctcgtaggcgctgccgcgtcggacgggtgtagatagcggccgacccggcgccgcggcgcgccccgcgtctatccccccaccacgtttcgtggcgctgaagcgctgctgccctcctgccgtgctgagtcagggttgatgagggttacaacttacaacccccaacggcttctcgtggccactcgcttttcacgcaagacggcagaacctgcacccccgtcccccgccggctcgtgtcgtggtgggtggccacccctcctccgctccgctccatttgggcggaaaccgaatcactcgggtcagtggccacttgaccccctgagctttccttccactttgcaggctcgagatcaccggtcacaaacggcagtggtcgtcgtatcgtaccatggtaatcatgggatcactatgaacggacccgacggaccggcgagagttgtgcggcaaaaggggtcgactcatcgtccatggtgtggttcggccggacgttaaccgacccagtgaagcgcgcgtcgttgtcgctgtagatccgatccggtgcgttgacgatgccagtagtagtatgtactgtagtagctaggtcaactcgggtagtgttatccccaacccttttgccacgtcaggcccaggccaggggagattaccaggggctctctccgccttcccagccagcctgggatgctggtgccgctccccgtccacgcacgcccaagaaaagtatattaagttaaccaggaaacatacatacggactctacagcaggattaacgaaagcgagagtggaggggccagcatagcaacgccaacgatggagcaaaagcggcgaagggataaggcccccccgagtggggtcctgtcgcaattctttaatcggacccatcgtgtttccacgtggcggtccaaccctctccgggcgagaagatcggcaagatgacttgcgcggagacgcgcaacgagacccggccggtccgcctccgcccccgacgccgttatatacccgcccctgtctcccccctcgcctggttcgttgccgcacccgctgccgcctgccgtagtgctgctcccggccctccctctaattgctcttgccgctttatgtatttgccgcgcgcggcgacagagaatatacacgagtatatacagtagccgccgccggtggagtctctatctggcagccggccggtcggtcggtactctgctctagaagctagagagatactactctgcaggctagctagctagctagctagaggtagaagaggccggcccggcccgattgaagaataacatagagctgtctgctgctgagcgacgacggcgatggtgctctacttcaaggcgcgtccggacgccggcgactacaccatctacatgggcgccgacaagaacgagaacgaggagctcatcaaatacggcctccccgaggacgtctggtacgtacgtacgtcgtcgctagctgctgctacctcttacttcctcgcgacgacgacgacgacgacgacatgccgcatgcgattcagtggtgaattgaatcatggcgaggcgattcgatggtgggttgggttccgatcgaccgcgacatgcgcgcgtctcggtctgccgctacacgtagaggcagcttagcattgcacgcatagaggacggcagatggagagggcgacgacgagagctctgttgagatagctaggcttgagcagtttatactgcgagggcggatagattaacgcgtgactgggccttgacgaggctgctggcgtggacatcccatccccaaccccaactacctaccggccggcctactctactaccaagacgatagataggtagatagatacgaccaaacctgcggtgcggagcacaacacgactgtcttctgttctgtctgtcgcatgcgtacaagtcgttttgtctgctcaccgctggctatgtgaatcttttaattatcttgtacggccaggggacgggggacctcagctcacaaacatacagtagctagcttgcttggagctgattacacttacacccggccagctagctaggccaggtgtgtgtgtatgtagccagctggagcgctttctgtacagtacagctctcgcgtaacgtaactaaccgtagaattaatatagtacaagataccatcagctagcagcgcctaaatacgcgggcggctggttccatgtggacaaggtatcctcggcacacgtctacctgaggctagagaaaggcgagacgatgcacaccatcagcgaggccctcctggaggactgtgcgcagctcgtcaaggctcactccattcaaggtgcgtgctcgatctcctctgacctctctctctctctgtctctctccatgggagaagaaccaaaaacagaacacggtgtgccctgccctacaaggcttttcagctcccacattgcagcatgttgcggcggctggaatcttttctcactccccccctgtagccatcgagcaggagatctatcaggagagcgcctccttcgtctccctctctttctcctagctccattattggcgctgcgcggggccactagctagcaacaagctcctccaatcatctgcgctgcctgcgcgcgtacatgttgatgtgattcgcgatcatggaaacgtgacaccaatcggtggagtgggtgacggacgcggctttgctgtacgtgcagggaacaagatgaacaacgtcgaggtgatctacacgccctgggctaatctcaagaagtccccatccatggatgtcggcccggttggcttccacaacccgcggatggtaatcactttttttttgccccccccccccccacctcgttacccctctcccccaaaaatctggggctcggccaggtgggagaacgggcccacgtgtcagccaagacagcatctgattaaaacacgtacggacagagtggtggtggtggtctttcgcgcttgtacagtgttgcaccgttgcatccttttttttttatttcctcacccgttaaaccagtctcctcaaataatgcaaagttggggttcgaactgggggggaaaaataacacccaacggccgttaatattgtaaatggatcggagatgaagatgccaaaggtgtatgtgtgtctggacatacgacgacgaccactggtctgattgtttcagcactttaatcatgtccaaatgttatatatgccttgcattattgcatccaaccttttgcgtcatatgccacgctggaaaagcatcttggggattttttttaaaaaaaataggactagctagcagctagcgtcgtattggctggacatgtttgaatccttttggagttccttaattaggttatcctgtgtctgtagctagcgaattaatactcacgcctgatcgacaatattttgtcagtcagcaatagtcctgacaatgcgagaccatgtcctgtttatattccttgctatacacacacacatatgtactatacgtaattatgtagcaaaaaataattcctttaaatctactgcatctctatgcatgtagtcgtatactgtgtgttgtatagctgtacctcagctgcttgttattgatttgctcgtgtcagttgggctgacctatttgcgaatataagcagtgtgggagttgtaatttacttactagctatctactgtgtggcaggtacatgtgcttatagtcgagaagcgtgtcaacgagatcatcaacaggctgaataaaacccgggtagaacgccgggcgccagacttgaaaggtgcttaattactaacacacagacacgctgatctgcccatgcacgcttaattattatcagttgattaataatctttctcccctcgcgctcgtgtgcagcggagaaagaggcatcaaatgcagcagaaaaggccgagaggaagatgcagctgaaagagaaggtatactcagttaacattgctgacagcgcggccatgcacacatgtatggcgtctaacgacggtcatcgctgaatggattggcagaaacggaaggaggagatggaaaggctggagaaggagaaatgggcggagatacggagctacaagggcctcatggtggccgagaagatgacgtccaaccgccagatcgcctccgccggcaagtccatgcaggaaatggaggatgagttcgtctgaagacgactgtcatcgtcactggagtctacatctctctctctctctctctctgtctgtgtgtgtgttgtgtgtgtacgtacatatgtccatgctcgcgtgataacgacgagtcgaagcaaccaaaagatctcatggatcgattattcgatccgttcctgatcctccgttgatctgtgctctgtacataacatgtgctcccagcatggacatgtataggtcacgagaagagctagcgcgtatgtatacaagtaactagtgacgagctgttgctcggagggatcaacatatatggagttcatcaagagaatcggtgcaacacacttgccgccaggagaaccagctgaggtaccgaaaatatatggagttcctcagtttccacgatgtccatgcccaaaggggtagcacaggtaaacatattcagaatgccatcatgctttacctaaagattcaaagccatccatcatatgtccatccatcatctctgttaactgacaccaaacctccctagctacagctagcagatatctccatttcattcagaatcactaaagcatcgctcaggg

SEQ ID NO: 24018 - DNA, 1851 bp, Zea mays
gtggccataaaaatatttactgccactagaatttaatgaaaatcttttctcaagccaaatagatgctaaatttcctacgcatgtgggtaccgccgctcttctctgggcattttcttttcctttttgttgcaaaccaaatcagccaaattcgagcagcttagatcataacccataaggacaactggtatctggactctcgactgattaatgtgttttacaggtgccagcattggcattcggatgctgataacaaaactacagcagcttacacaggcaacgtgtttcaaacacctgatatacagcagatggctccatcttgatagcgtcagaatcgtctcttctgctgaggatacccagggttctgcatccccatcccttgatccgccttccttctcaactggtgcggatgagactgaccacctgcgcctctctgcataggcatgttaccaggatttagcccagccatgccagcctgtgaggcagcgttgaaggcagccatggttactccacctgccactcttggaatccccccaaccataggttgctgcggcatttgtcgtggcatgggtcttgctacagattgacctccaggaggagcgttccctgatggcggttgagttggttgaaggcttgttgttccttcaaaatctgttgtagtatctactggacgaataggatactgtacaattttctcccctggctgggatggtaaaagcgcgtttcgtccaggtagtgggtccatccgaaagtattcatgctccaaagcttgtgcagctgttatacgctttcggggatcatactcaagcatttttgagagaagatcaaatgcaggactctttggtggtaaatgaacaatgttatggaaacctgggttctcatacttatgtccttgaatgtgttggtggtcgttttgccaccatggaagattggcaagggtaggccacttttcaactgtagggtggcctaagaccttaaaaatcttgtcgagttgatcaagctggaatgggttcggaggattttttgcttccacaccttggaatagaggtttcagtgtaagcagttcagcaaaaatgcaaccaactgcccacatatcgacagcactggtgtagtgtttccccccaagtaacagctcaggagcacgataccagatagttacaacaaccccattatcacataatggtttcagtggagcttgatatatcctagcaagtccaaaatcggctatctttataattccatgttcatctccttctcccatgaccagtatgttggaaggctttagatctcgatgtataatccagttactgtgaagatagttgaggccgttgagcagttgccacagcaaggatttgacagtgtatgggttaatggaggaactcagcttctccctgtgatgcctgataatctcatagaggtcgtgctctgcgtaatcgaatgcgaggtatagggacatgtcagcgtggttgatgtgcacattgacgagcttgacgacattctcgtggttgatctcgcgcaggagcatgatctctctaattgcggtgggtgatactccgtccccctcctttgactgcttaaacttctttatggcgataggggggccgcgtcggccaggtgccgggtggggcggcttaaggcgcgcgaggaagacgaggccataggtcccctccccaatcttgccaatcagttcgtactgctgcagccacgccggacggttggcgccgcctgtgcgcccatcccccatccccgtcgccgcgccggccagccgccgcagctgaaagtcctcttctccgttgccgtggtggcgtacggcccgcttctctcgacttgttgaccaaagattgccgccccaat

SEQ ID NO: 24019 - DNA, 1868 bp, Zea mays
gccccccctcgagtttttttttttttttttttttttttttttttttttttatttcgggaaatgccattatgtaattgattgaaaagtactacaattcttgttaccgtgcgtacatttcagattgcaagcaccaagcattccaccacttggctgaacaacaaatcaatgcaaagtgatcaatcaccatgtcgcgaaaaggaaccatcagacagcataacaaacgaacacaaaaccagttaaccgataccggtctgtttcatataacttgtacgcttcaccacagtttcactcagcaaatggacgcggaacgccagaactctctacgctatctgcgtctgggatagcaagtaggatgaaggccaaagggattaaatggcagacccatatactgcggtgacatgaactgtggtacgaatggacttccttgagctgcagaccaacctggctgggcagggtaattgtgaactccaggcacagcggcgtaagctggacgcgcaaagttttggatctgagctgcattcagaaccagaggaatagcaggcgtcggaagcttaagagtagctggccttgttgtcggttgcatatgctgctgctgctgctgtgtcacttgcgccatattttcttgatgcagctgatgccgctttccttgaattaacttgttttcattctgttcctgctgctgctggttgtattgtgcttcatggtgctcctgctcctcctccttgcgcttcctgttcctccttttagattccgttggcggatgctgtgaagcccatgttgagagattttctgacctttgttccttttcatatccactcatcaaatatttaatttctgccatgatagcactgcgttgcttagaatcagtgagtttctgctcagctagataatgtgcaatccatagttcctttggtatagcccagttatgggaaagaatgacctcagcatcctggaagaggtatgcattcccaccctaaaaaaaatctgtcaacagaagaatagcggcctcaaatttctgtctacagcataatgtggcctggatgtccagtgttcgtgctacccagggcgccatgcagccatataattcctgtcaatgaaatacttgattttagagtcagaaggggtagttcataccaaggactcgtgtgtttgactctttttaaacatctccacaaaagtctgcttggccttctgaatgtatcccttcagaagagaaaatggaggatacttgtcctccaaattaaaattttgtaccaaatgaaaaacttcgggatgctgcccatttcccaatcatatagtcaattaaacctgtggccctgtctgcaagcccaagatcctcgcaaagcttggcaatgttgttattcttgtaacctttgcgaaccatagcaaatatactgatgatatcatggatattgaattcagatacaatgttatatgcgataagaaattggagaagacccctagacagcgtgtcaagttccctacaacacactgtgttgtcaatcattttcttccaatccttcgccaccagcttggcctgctctgttgtgtctgcagaatgtttggcagatttcatagacaaccaacgaaatagtgtgatacattgcacccagaccttgtagcacctgaagttcttgttggatacgagtagcttgaccacttgaaggacaagtgccgccggatctggggcatggtgcattgcggacagcaacttcttactagagatgctgaaacagatcacgaactcgaccagcgtctctgcatccattctcttgcatgcctctacaaattcctttctcccatctgcaggaagccctctaagctgtttcttagtcgtctcttcgaccatctcctcctcgtgccgaatt

SEQ ID NO: 24020 - DNA, 1555 bp, Zea mays
ttttttttttttttttgttttttttttttttttcgccctaaaacaagcttaaattttaccgatccctgatgtccttcctcgttttctttgcaacatcaaggaactcagcacgatccacatatcgtgctggaacaagttctaaagctgtaaaacatcggatgaattgtacactatgaatgcttatatcatctatcctacaagctgaaattggaatattacattctctgtatgtaaggcatctaagtattgacacgataaaactaactgccgcaaatgtatacgctgatttactaaactgtcggcctgcagttcaaggtagatgaaatgaggcactaatctaccgatctgtagtccaatgtgctcatattgtttgttcatcttggaatataaccagttcttccctctaatttaccaccagaaagttgcagtgcgttagttcaatgagactgtgcttccagtaggatgttcgttgccacgttgatgtcatttctagccctcacgagtgcctgccttgcgttattgccatcaaagcccattgagaccagcatagcaacggaggactctggaggctccacgataggtgcaaatccagttgatggctgattctgaacagcacggcctctatgggacggtgtgtttccaacaagactcctggaggggcgagatgtgcttcctggggaaggggcgaaatatcttgcaaaaaatgatgaaataacctgtggaagcttcatcttgcggatgccgagcacatttagacgatagagagaaccagcaaccagaccaaatataccaggaataagggagcgcttccaagaagataaaagaagctgaaaaccagctaagtaaatgaatgatttgtcactgaaattcagaccaaaaatacggaaccgtgatgtgattggaatgtcaagaaagaagggaacaaaagaggcaaatatgagaccataaggccctgatgcaagcgtgctgatgtaatttgtatctttcaagataaccaatgacaggatctcgaggagcgatgatgctgtgatagtgaagagacaaaaaaccgagtatttgttagagcctatctgcctctcaaacacacggaagtaatacagaaggtacagtccaaacattaactctggtgttgactgaaaagcaaatacagatgggaatatcttccataaacgaaaattcgttatagtgtcctggtatgagatgccgagggcgcgggcgcgccgctgcgcgctgaagacgacggacaggaggccgctcgcgacgacgaccgcccgcgtcaccggcgcgttctggaatccggagacgccgccctgcatcttcagacggaggccgctggtccggtcggggaggcgaggcggaagcgaggtcaggaggcgcggcagcctccccggccgtacgatcaggtcgcgcggcagggaacgcgagtgggggctcggctgtacttcccttgggtgatgcaggcggcgggacgggacggagcccggtaggagactgccggacgagcgtggcgagacggccagacgggtgttgtcttcccgccccgcccgccctcgag

SEQ ID NO: 24021 - DNA, 1988 bp, Zea mays
ctgaacacattttggttaaggataacaatttcaagcggacctaaaaaaagttttaaattcaagagagcattgatgactacggcattcaccattttttttctaactcatgaagagtttcacgggttgggccctgcgggaaggaaagctacagtagtcttcatgaatttttgaaatttcgaatacatgtcttgtactcttgcaatgtatacctacaacaggctttaatggagaacataaaaaaaatgtcaaatttaactgcaaatcatcctccgcagaaaagaaaaacagatgagctacaattcctgtacatcagcaattcacagcggccttcgcatcctacgtagctctaaaacaggatgaaaatggatcaggccttccatatcaagcgattttgtccgggctcagcacaataaaccttgtgggaggcgcgagacacctctgaagacgtcaaacaatagtcgacaacgtcaccgtggtgatacatcagttgtgctaaactgagagctgttcatgttggtctgtgtgctgtatgattcagctgggttgcctttagtgctttggcttgaggacgtgtctgctatcaaacccccaaagccaccggtacgctgccgaggttctttcagcacacctggtggagctacattttgcagatcaatttctgtttggttagatagcatattaacgacctgcttcatggacggcctctgctgggacgtggcttgcgtacacagcagtgccactttaatgaaacgaagcatttgctcctctgggtacttttccagttctggatcaacaatttccaagagccttccttcttcccgcagcttccatgtccattccacgagaacatgcatattaggtccccaagtcgacttgctgctgctttcaccacttatcatttcaagaagaagcaccccaaaactatatatgtctgctttcttggtcaattgtcccaacaaggcatactctggtgccaaataacccattgttcctgcaacacgcgtgctaatgtgagtgacagtatcaggaaagagtttcgccaatccaaaatctccaattttcggcagcagcttcttatcaagtaaaatgttgctagccttgatatcacggtggacaatccgtggttgtgcttcctcatgaagaaaagcaaggccagaagcagttccaatacatatagcaactcttttctgccagtccaatgggatacatttgttctttggtccaagcaaagcattcgccaaactattattctctgcatattcgtacaccaatagtctgttactcccttcaacacagcaaccaatcagcttgataaggtttgggtgcctaacatttgatatgacattaatctctgtcaagaattcactaattccttgttttgactcagctgcaagttttttaattgcaattggagtgccatttttcaggtttcccttatacactgctccgaaccccccacggccaatgcaattcaacatgtgaaagtttcgtgtggcagtcttcaactcgtttagggagaatacatgtacattatttccaggtcttgataattcatgacctgaacggggagacgaacccgcgacgacctgaccattctgatcttgcctcgacttggagccgcctcccaagcagccgaccgaactccccatgttccaattcccaatcccgttgcctcctccagaagtctatggcgaagccagctctagtttgagtccacgactggtcgacagaagacgggatcgctcccgcaagccagacgcagaagcagacagctgaaggtccgggctgtctgggtgttccgcctccgcgctggcaccgccggcgcaccgacgccgcctgtccgaggacagggtggagggggttgggggtaggaggcggccgatgcccggcgttttttttttactcgatcggcagcggcccgcagtacgcagccaccccccgcccccccgcgggggtccccgtgtttctagtctcccgggcccggccgg

SEQ ID NO: 24022 - DNA, 4826 bp, Zea mays
  misc_feature (1188)..(1188): n is a, c, g, or t
  misc_feature (4254)..(4254): n is a, c, g, or t
gcttgatagtagtataataatgtatagaacttaatagttctaggaccctaaaacatttgaaacgagtgagctatagttcacaaaatatggtgaaaacgtaaatatcggttagtgaacatgtggacatcaaaaatcaaaacaagaaagtcggtccaagaaaaaaaaaatagttcgttgagtgcccagactgtcatgtttgataagccaaaaacaaacaaaaagcttagtaatcgcatatctaaagtagcaaaaaaactcatgcccctatatatttgagctccccacgggtgtagtaaatcaaaataactcatagtttacgagaaaaactagctagaaaaatattgcattgtcttatatatacatcctagtaaccttaatagtgatataaaaatgtctagagtcaatagttctggaatccaaaaatttagcaaccaactatcggtctctatctttagcaaccaacagttggtgcttaataaggatcgctaaaactgaatcgtggtgtagtgaaacaactagaataagtgagctatatagctcacgaaaaattgagaaaacatgaaaattggcacgagagccctagggccaaaacctagagaaaaaagtgggctaaaacaacatttgcctgagtgccttgactgcccatgcttgaccagccgaaacaaacctaggaatcacaaatccaatattcactaccggaaacagctgctttgctgagtatttaaaccactcggcaaagcctgtaaaaaactcgacaaagtctttatcgagtgtgacactcgacaaagaagtctcggtgaactgtacatcggcaacagcttctttgccgagtacgttttgtcaggcactttgtcgagtgtcaggaggctctcggtaaagaaaagtcgtcgtcacggtgtcaggtgatggcgacggcgacagagactttgtcgagtggcactttaacactcggcaaaggctctctctttgccgagtgtctattgtactagcactcggcaaagaaggctctttgtcgagtgtcaagaccacaacattccgcaaagaagttttaccgatttcgaagtgtgtcttatttgccgagtgtctattgtactagcactcggtaaagaaggctctttgtcgagtgtcaagaccacaacattccgcaaagaagttttaccgatttcgaagtgtgcgttatttgccgantgctatggtcttgaccctgagtatttgaacttttcatggtgtagtaagtccaaataactccttgtttgtaagaaaaaaaacgctaaaaaatattgtcttagcctaagcacattctagtggcgttaccggtggcggtcgtcaaagaatgtatcgaagccgatagtttggtgatctcgaaaacacataaaaaccagtgagctatagctcacgacgacaaatagcagcccatagcagctgactaagatcgagttgccttgatgaccaatccttcactaagaattcctcgtcgatctcatttggcagtgttgaagccttgcttaattacatccgtccaaacggtccaagtccagtcgttgcaaacagctagcatgtggcagacgtactcctactccaaccaagttcattcccccatgttacttgctttgctatacaccatgcatatgccatctaccgctgcggtccaggagcaaaacggccaagaatgaactgaactgacgacaacgtcccaatgattggactgcggaggaagctagatagctagctaaagaagcagcagctcggcagtgcaatttgccgacgatatatggggtcgacacaaagcgcggccggtcaatgctgtggacactagctaaaagagacagatggtgcttggccaactcctcctcctcctcctcctccatgtggagggagacgcatcatctcaacttgtttatgtatatatgtagtggtcaaattcagacgaacatcacttcacaatggtcttttgctcagtcaaagagaagcaaaaggtcgtgtgtgatgactgatgaggtggtgacgcagatcccatgcatcctcctctcagggcaacacgcatgttcacacagctcagccatatgctctagctactctccgcccaaagatatggaggagagcacgtagcatccacgttccctgcacgttcccacagtaaccaagttagctagggtgcttcgtcttcttccactctcacccacccatgttagctagctctatcgtacgcaatatactgcaatataccacggcatatcatatgtatatatagcacgcggttacctacactatagctatatatctctgcaagtccaagatcatcttctactccaactgcaacagaccatagacctaccagtcctcctgctcctgctctgctggctactgcttgtcacacacacagctcaacgctctgcagatgaagcaggctgcatgccgctgccgcgcgggcgcggccacgagcgccgtgatcctgctctatctcctcctcctcctcaacagcagtgcgacggctgcagtggtagtagtagcgtcgtcgtcgtcggcggcggcggcggcccagcgtgcaggcggcagcgacagcaaccctgcggtggcggcggcatcgcaaggctgggcgcagcgtcgtgccacgacctcatcaaggaggttgctgcgaccggcgggggctgccaccatggccaccaacaccttcgacgtcaagagccatcggacgacagcgtccccgacggcaacgacgaagccgggagtggagtttaacggcagcaccaagagcgcgccgacaagcagatacaacccccggcagaattagtagccctgacgatgaaccggctgatacagcttagcatcacttgttccttgattaattccttcgttctcttttagctagcaaactagcatgtagccaacctagcttgtgactttactctcttcatgttgtgtagagcaaaaactaaaggactgacctgatagataggttttgttgtcagcgctcactcagcaggcagccatttttgcatttccttccttcctagctatagtgcgtagcttcaataataagaatcaacatatttaaacagcatgggaaatatttgcagttcattatcatatctgagactatgaccggtagttccacagctgtttcagtcctaaaactgtttccatcagttgggcaaacaccagttttttttttctttccaaagtcactttcttctgcctcgggggatcaatgcaaacgggaaaaaggaaaagttaaaactactcagacaaacaaaacaaaacaaaaaaaagtgaatagttatacatagcagaggacgcatgcctattctacaatctctctaattcgtggccattggccctgcctcgcttgcaggaccagccagccacgtttaagctcgacacagagtgaaatattgttcagtgtacaaagttaacacacaagggcgccgctgcctttacgcccatgaatgccagagccaccgttgagtcactggcgttgggcagatggagattgctgcacctgcgcaggcggaaagaaccccatgcccgatgactgaaagaatccagttgatgttggtgattgctgtgccgcctgaggagactgctgctgctgctggggctggctctgagctggtggaagtggaggtggaggaggtggcccacttggtcgcggaaaacctgccggcagaatgttggacaatggaggcggaggtggcatagatccagccatcatcccgaaaggtcctcccattccaatcatccctccagtattttgaccgaactgttgcaggagcggtggcagtagagacggcaatggcggtggaggtggtgggaatgagcctggagctggagctggtggatgcgtgcctccaatctgttgttgcacctgtgccgcttgcccaaaaaagggaggaggagcacccatgtcagaggcctgacctgttttctcaagcctaggcctcttatcaatgtggaaacctggtggtcctccagagaattccccagaagatgatccaccatttatggaagcagcttgctcagcagcaaaagatgagagaatggaggtcagcacctgcacaggtgctgacaaagatgcaagcttatccgccatagctgccgccgttctcttggactcatcacccactgcactgactgtagggggaagcgaagctgcaggcttccgtggttgtgactggggatgtgtcgatcttacttctgaaccctgcattatagccgaagtttgttctggtggagtaatcatgagcggactagaantagaatgtgtgacgctcgtgacaagggcaccccccagttgtttcctaagttggatgacacgttgagcctctgtttgagcaacctgttttgataattatattagagattagcaagatgagatgtcatgttacaatcataaaatggctaaagcatgactacagttgcataaaagatactaatataaaaaaacagtgatatctaccaatattaaagaaagttaattgtgacctcaaaaataaattttcaacaagttaattgagaagcagcaacagacaagacgcctgtttaaaccaaactcaagcctgtttaaatcaaactcatgatgttgagcatttcatgctatatataggcacaacaaacttcagtgaacactaaggctttatatatatatatatatagtatttagagccctgggctctgtataactattggaagccccgaccacccaccgaccaggtgcgcagaccgcaccagaccctttttggcttattatacctaactgcttacgacaaattataatacgagttatgctgatgtgtataacaatttatgcaaatttgtgggccatcgcg

SEQ ID NO: 24023 - DNA, 2412 bp, Zea mays
ccagatcccgattcctttgtccaaactagccccttgtgtaagaaccaggtgaaagaattctgcagttttaaaccctttttaggtggtatgataataataataatcaacagatttaaacagcatgccaaatatgcagttcacatcatatctatgagactaagaccagtaagttctacaactgtttcagccataaaactgtcctgtcagttggcaaagtcccaatttcagccccagttttccaaagtcgttttcttttgcctcgggtgatcaatgcagaccggatcaaaaacaaacgaagtctagcaacttcacataaccaggaagagttaaaactactcggacaaaaaagggatagttctacaacgtgcatgcctattctacaatctttctaatccgtcgtcattggccgtgcctcgcttgcaggaccagccaacgtttaggctcaatactcggtgagatattgtttaatgcacaaagttaatgcaaggtgctgcctttaagcccatgagtgcaaatagacacagttgaatcactgtcgttgggcaggctgagattgctgcacctgcacaggaggaaagaaccccatgcctgatgattgaaagaatccagctgatgttggtgattgctgtggcgcctgagaggtctgctgctgctggggctggctctgagctggtggaagtggaggtggaggaggtggtccacttagtcccggaaaacctgccggcagaatgttggacaatggaggcggaggtggcatagagccagccatcatcccgaaaggtcctcgcattcccatcattcctccagtattttgaccaaactgttgcatgagcggtggcaatagaggtggcaatggcggtggagggggtgggaatgggcctggagttggtggatgtgtgcctccaaaagaagtaggcactgctccagcctgttgttgcacctgtgacgcttgcccaaaaaagggaggagcgcccgcctcggcctgccctgttttctccagcctaggcctcttatcaatatggaaacctggtggtactccagagagttctccagaaggtgatccgccgtttatggaagcagcttgctcagcggcaaaagatgagagaatggaggtcagcacctgcacaggtgctgacaaagatgcaagcttatctgccatagctgctgccgttctcttggactcatcacccactgcactgactgtagggggaagtgacactgcagggttcagtggttgtgaatggggaggtgtcgatcttactcctgaaccgtgcatcatagctgctgtttgatctggtggagtaatcatgagcggactagaagtagattgtgtatcgttcgtgacaaggacacgacccagttgttgtctaagttgaatggcatgttcagcctctgctcgagcgacttgcaattgatcacggagaattattgacttcgactcctgttcgctgagagcttctttcaattgattgatcagggatatcctcgccctacctgcactttcaagttgttcgatgcactgttttaaggtcatttcctgctcttgaaggtcagagatcaatgatgatgctggctgattaccgttgatgctagcatcgttaatatctttatttattctctccaaaaggcccacagtactcttacatttgtttagagctgtgtcttcatcaaaatgttgatcaaacactgattggtatgcagacacaatcttttcaggcatcccgccaacagtgagtttttttactactgtaccagaatccttccgtgcagctttggaatttgaagtgggattagagctaggatttaaactattcacattgttatccaatataggagggttgtcaccaagaatgctattttgcgtcccgcctggccgacgcccggaaactttacgttggtcccagattaatatcaatctcgccacctgcttcctcccttcctctcccccattttcataaacatgcttcagggatctaggtagaaccctccagaactcatccacatagtctgcccccttgcgtttactgttttgcaggatatcatttgatagatagaggaatggtattttcttctcctcccttgaactagtaaactgtttttcccatgtatctacaacccttttggccctcttgcggtgaaaaatgcaccattgtgaaagtgtctcaatgctagtggctgagttgttgagcctgttgagcttatcaatcagcatctgctcgctaaagaggccgccgccgccactgccgaccccgctgccatctcctgtttctgcgtctacatccgccttcgcgcccgccatcacgaagcctccaactaattctcggtagcgagttcctaagcttgagcctactgccgcggacgaggcgaagagggagtgggaggggaaggacccaaggatggggggagacgaag

SEQ ID NO: 24024 - DNA, 1061 bp, Zea mays
aaaaaaggggggcatgaaaccaacagagagaatttctctcagacatgaggaatgggggatcctttgctttattatatacagtccattccatgcacaaaaccttgggaagggaaaacttacaacgagaagacaaagcacgcctcttttcttcacaacgagagtacgagacacaagattggcatgtgaaagggaaaatggatctctacgtcaacagcttgagtgtatgagggcttagaccggtcactcggtccttgtcaaggcctggaccggcatcaccaggaatctcattattttgatctatcttctatttccattgcaaaatgagagggggctgtcacctgaggcaggtgtttcaggcgaaggaagcccgacgctgcaaatgcctcaggctctgctccatgctgaccttcaccatctcggcaagcatcttcttcgccttgccgccacggtcttcgccatctatttgggacgcaatgttggtcacgatgttctcgagcgtgtcagcctgcagcttcggtctcgagtacggtgagtcccgcaacaggtcgagaagaacatgagccttcattcgggacttgggtgtgccatggactgtgagctcgagaaggccaggaatcgccccttcattcagaatgaggtctctgtacttgctgcggtcgctctcgcacatcgtcaggagcgctcccacggcatgttctctgccctgaagggagccttcctcaagtacctctacgatggcgagcactccgccttcctcagatgtcaaggccagccgacattgattaaaagcaagcagtgactcgagaagagcacagcatttgtctgctgttttggaggacttcttgctacccttcagtagctttattaaagggggaatcggctgaacagaaaggatagcttgaaggttgtctgtgattgtggagaggttgtacagagccatcacggcatcattcttgccttgatgattcccttctttgaggacttccacgagtagaggaattactcctgaagcacttatgatagacttagtggtggatgaggctgaaagtgtacccggccgg

SEQ ID NO: 24025 - DNA, 2318 bp, Zea mays
gctgccttgtctatacttgttcttgtcctgagcaagtctctatactatataagtatatatctatatatagtgttatatatgtcctgaaaatacataggacgaccaggggactattagggtcaatcagggacgactaatcgccctaatcgtcgcctaatcgcgactagtcgtctgatcgcccaatggcatcgatcagacgatcaggcgatcggaaaacaatgagagctagttgattatttttaaccttttatccatgtgcatagcttacaaatatttgtgatgaaatcttaaagtttatcgcttcaatggagaagacttgcactaacaaccagtatatgactaattggcacaagaaacacacaggaatatttgttattaatttgacttagctatctatgtttttggataatatcaaaatacataatttgattccaaataatggacactgccataaaaacaggatgctctaccagcccttttgccaattaattgtatttttttattatgtccagtatagatagtatcaaaaaccaacaggcgaagggccggacaaatcgataattttcaagaaactataaggggacggatgagcgatgcacaaacatcaacctgatctagtatacaaactgtcaaaggagtttggatatacaacctgatcttgaagtttaggtgccttgtgtctcaaaaagcggtggagcccgcggtggacggcaacgcgcgcgagcttctcagtgtcgacgttagcggcgcggagccttgtgagcgggccgggctggagcgtgcggtaggtgcggaagacctcgcgcgacatgaggcaggtgaggacgccgtcgccgaggtactcgaggcgctcgtaggtatccccggggcggttgggccagtagaaggagccatgcgtcagcgccagctcgacaagagatttgtcgatgaagcagtatccgaggagggcttcgatggcggtcacgtccttggcgctcatcggcgggacttcccctggcggcccgtcgtgccgctgctctctcggtgcgtacggcggcattgctgatgactgcttgcggtttcctcggtggcggagggcggcgcggacgatgtggtcaatggccatacgccgatggggagggcgtttatcagaaaggagggcggcggcggcggcgacgcgggtgtggattggggccgtgtggatttttttttgtttttgtttttgtttttataagggaccgtgtggatttggtaaacagaaagggcggaagcggtgtttggggttcggcatcggagtccgatggagaaatcagaaaagggcggaagcggtgttgcgtgccgcgtgcgcacaagccggctttggaagcgtgtttcaccaacaacggagcagcgcttctgcgcttgggattggggtcgttggattcatggcgtgatcacatctagcattgatgagcgcgcagactctgtccgggtggttgcttccgtcagaagtgatctagaaggatctaacaaccgtcgtatttattttagtctttctaaatatcggcatttatccctcgataaacagtgtccatcgaggtaaccaaccaaatccaatatttttatagcaaataagagatctcttataagaagttgtatatttgattactaaatattaaaatagatcttattgaaaatgtttagggtcaaaaaatatttgagctccaacatttgaatcgtatatcatgttattaaaaaatagatcatgttatttagaaaataaaatgttagaaaagtgtacaaaatgaggatagagctttagcatatgaggttctatatttagaacccgagagaccgagtaatataatatttgatgatttttatggaataggaccggttgatcacttgttttcaattgcggtgaagaatcaaaaataagtcaacacaatgttaaatattaagaaccttcgttcttacagacattatctttaataatggtacttggacgaagataaatgataaatataggattttaccatcaaataacctttcttcgaaggttacaagtaggtaataatttataacagaatggaagtatttgtgtttaataaatgaaagacaaataacaaaggattaatcttctattatatatatagatatatatatcttaaagatctcatttcgaaccatacaataaataattacattatataccttcggttttgcacaaaagaaaacacaaagatacccttcggaagaaaagtgagtagtcgagattgctccttattctctctctgatgaccctctcaaaagaaaagtaaacagtacggaatactttttcatttattaataggcccaag

SEQ ID NO: 24026 - DNA, 1275 bp, Zea mays
ccgggccccccctcgagttttttttttttttttggaaccatgaaaactggtattttcatatagtagagataattacatagcaacacagaaattcaatgaaaatggaccaaccaagtgttgctatgattcaaaacttcattgccattaattgcacctattatgcatttctatatatgtcactcaatttagtgttccagctatgtctaattcgtccaatgcctcagaaacatctactgatgctgattcactttgggtgttgtctaattcgtccaatgcctcagaaacatctactgatgctgattcactttgggtgtgtccatgtgtgtcctttagcttatccagagcatccttcgcagcacggttctgagctatctccttctttggaccataaatagcacttccaactacctcaccatcaatcaacacctgaaccttcaaactcttatcccattcgtctttcagaaatttcacccctcggtgagtcttttggcaaaactcaaaaagctcgcttacagggtgcttgcctaatgtctctaagccaataagtggatcagccaatgttcgaaagacccgccaaacctcctcttggtcgaagttggagtccaagtatatggcaccaataagagattccacaatgtcacacagaactttaggaggatccaatagtccatttgagtgaactggatatttgcgcatttcttctatgaaaaaacagatctgatcttgaagtttaggtgccttgtgtctcaaaaaacggtagagcccgcggtggacggcgacgcgcgcgagcttctcagtgtcgacgttagcggcgcggagccttgtgagcgggccgggctggagcgtgcggtaggttcggaagacctcgcgcgacatgaggcaggtgaggacgccgtcgcccaggtactcgaggcgctcgtaggtatccccggggcggttgggccagtagaaggagccatgcgtcagcgccagctcgacaagagatttgtcgatgaagcagtatccgaggagggcttcgatggcggtcacgtccttggcgctcatcggcgggacttcccctggcggcccgtcctgccgctgctctctcggtgcgtacggcggcattgctgatgactgcttgtggtttcctcggtggcggagggcggcgcggacgatgtggtcaatggccatacgccgatggggagggcgtttatcagaaaggagggcggcggcggcggcacgcgggtgtggattggggccgtgtggatttttttttgtttttgtttttgtttttat

SEQ ID NO: 24027 - DNA, 2438 bp, Zea mays
  misc_feature (1198)..(1198): n is a, c, g, or t
gctccaaacataaggacaagtcccttgacattaccaaatcgagaagcacaccatacattttcgccggctctcctacctgaactagctagagcaagtttttgccttcctagaacagtggtgccggccttcttttctccttgccttcttctagtcttgcgcattatttgccttagcagatgggcaacccggcgccttgcggcatcggttgcgcgaaacgtacagacttacacgaacgacataaaaactgttacaacgtacaaacaaaggccaatcagtacaacatctccttcgatgtcaggcagtgctgcatgctgttttctgcagcgttctgcctgccatctggctacacaccccgccgtttgtgcgaggccgagaccctagcttgtgtggggttcagtaactggcgacgatgagcaggccgatcgccgtgatgatgatcgtcgacggcaagccgaagcggaggtggctccagaaggtgaggttgtacccgaagaactgtgcccgccgcgcctgctcgcagacgatcaggttcgccgccgagcccaagagggtcaggttgccggccaccgggctcacccatgctagtatgagccaggctttcttctctgactctggggagattgggcctgctgacgctgccacccttgggcccagcagaagaacagttggaacgtttgaggccacatttgaaaggactaggatcacgactgcgagaagcgccgtgcctttggcgctgtcgattctcgagggcggttcgaccagctcccagagcgcattgggtatgccggtcctgttgaagccgtcgaccgttatgaacatgccgcagaagaagatcagcaaagagtatgacaccttctccaggcacgcctgtgcgtcagtgaaatcaagcgcgagaaggacaagagcagcagtgatggcggaccaggacatgttgagccccatgaggagcgcggccagcatcccaagggtggtgagatacacggcagtcttccacacgagcaccttccacctctttctccttgttggtgacgctgtcaccgtccttgccccctgtggccatcgtcgtcgtcgtcggcggcgtcagcctcgggcgcgtcctcgatgatgacgctgcgctggtggctggtggtcctggtgacctttctgggcccggcaccgccgtcgtcgcgcctgtcgcagacgggtggacaccttccancccttctcctgcgacatgctggacgcgcgcatggacctgatggcgacctggatgtcgccgccctccgagttgtagctccggctcctcatgctcatgcctagcgtagtgtcggcccggctgaggctatcgctccggcggatgagctcgccgacgcagtcggcgtcggcgccgcccccgttgacggacgaggcgcgcgacatccgcgccggcgtgaacctgtgcgaggtgacctcctcgtcggccacgacggcgacgtcgggccccgcggcggcggcgccgccctcctggtccttctccggcgcggagaggcacctccagaagtagcagagcaggatgcaggtgttggcggcgacgccgacgatcatggccgggaagacgccgacgaggaactggccgaaggtgatgccgctctgcacggcgatgacgaggttctgcgggttgccgatgggcgtggcggaggagccgatgttggagctggaggcgagggccagcaggaacggctgcgggggcaggttgttctgccgcgccagcttgcccggccgctcggtgagcaccacgcagcaggtgtcgttggtgaagagcgcgctggccacggcggacacgaggcagacgcggaacagcaggtccttgctgccccggctccgccacgccagcgcgctgccgaggtacttgaacatgtcggcgcgctccaggaagatgctgaccaccatggtgccgaagagcaggcccaggatcgggaggtcgatggccttgtaggcctcctccggggtcatcacgcggaagagcaccatgagcatggcgcccaggagcgagcccgcggtgcggcccaccggcatgaacggcaccgaggggaagacggccagcacccagaagatgctgaacgcgatgcatcccagcaccaccttgtccgtgctcgcaagcgtcatggtcgatcgaggcggcggcggcggcgatgggtcggtcaatgccgcgcgctcggtcgtgcggtctgcgtgagggggcctagcttgttgttcctggctgctgcctggatcatgcagaaccggaagcacagagaagcatatcgtcaacaacaactactaggtgttaaaatggcaatcgacgacggagaaccacagagcaggcagcctcagcgactggcggctgggacgggaatctagccgcgcgagaaccaatggccactagctgtagtattagtaactgtcacgtctgttagatatgcctgcaacttcgccgtggg

SEQ ID NO: 24028 - DNA, 1827 bp, Zea mays
gcacgagaccattacctagaacatcctaatcgaaatctctgtctccctcgtgctgccctcgccctccttttttttttagtttacccgccgtcccgcgcgccgccgtttcggttgctcggctagagggactagggagtgccagcgagtccatggcagcggcgagggcgtgcttcgtcgcgctggcgctggtggcggcgctcttcgtggccggatcggcggcagcggcggcggggaatgccggaggccgctcgcagctgacgctcaggcagcggcgccggcagctgctgcggcagcggcaggtgcgcagccacctcaagaggctcaacaaggcgccgctcgccaccatcgagagtccagacggagacatcatagactgcgtgcatatctccaaccagcccgccttggatcaccccttcctcaagaaccacaccgtccagatgcggcctgcataccacccggaaggtctgtacgacgacgagtccaaggttgcatcgcagcggaacgcgcagacgatcacccagatgtggcatcagaacggcaggtgccccgagggcacgataccgatcaggcggaccaaggaggaggacgtgctgagggccagctccgtcaggaggtatggcaagaagaagcgcaggagtgcccccaaccccatgtcggttgaccctgacatgctcaacgagagcggccaccagcacgccatagcgtacgtggaaggagacaagtactacggcgccaaggctaccatcaatgtgtggcagccgaagatcgagcaggccaatgagttcagcctgtcccagctctggatcctggggggctccttcggccaggacctcaacagcatcgaagcaggatggcaggttagcccagacctgtatggggacaacaacactaggctcttcacctactggactagcgatgcctaccaggcaacaggatgctacaacctgctgtgctcggggttcatccagataaacaaccagatcgccatgggcgccagcatcttccctatctccaactacggcggctcccagtatgacatcaacatcttggtctggaaggaccccaaggagggcaactggtggctgcagttcggcaacgactacgtcctggggtactggccgtcgttcctcttctcgtacctggcggacagtgcctccatgatcgagtggggcggcgaggtggtgaactcggagcccgacggcagccacaccagcacgcagatgggcagcggccacttccccgaggaagggttcggcaaggccagctacttcaggaacgtccaggtggtggactccaccaacaacctcaaggcgcccaggggcgtgggcaccttcaccgagcagtccagctgctacgacgtgcaggacggcagcaacgccgactggggcacatacttctactacggcgggcccgggaagaactcaaactgtccatagcccaagactgactgagctgagccgccgcctatcacactcactaccagagccgcctaaccttaacacacctcagctgtatcattcatgcatccggtcaattagtttatactgcctcagatttttaacttttttttcgttttgtttcgctctttcttgcttctacctaccccctagtttactgactcctaccctaggtgagtgagcgtgtgtgttgtagacatgtgagattgttctctctgcctcagagagagtgagatgaaggagagatgtcggtcgtctggttctagggaagagatgaggaggactagggggtaggtagaagcaaaaaaaaaaaaaaaatcatggttgctgtgccttttgcctgtcaaataattttgttttgtttcatccc

SEQ ID NO: 24029 - DNA, 2604 bp, Zea mays
ctgaacatgaaacatacaggaatggggtgcatagccaacaagtgaacataaaacaaaactagcaaatttctgaattcaagtgatactgtaacctacaagaaagggtcaaagaaaaccatggggtcaagtgcacggcgccaatttttttttttttgatttaagaactttttcatgttgatgagtgaaatgtaatatacacgatacatcatttaggccaaagagagcacaagatgctaatcttccaaaaactataccaccaacaagagaaattggagttctgaacatccaagcctacaaataaaacttacttccctatatcaagaacccaaccagaggtgtgtaacttcaacaacttttgccatgccgggaataaaaaaaggtttagccagagtatacatagaagccgttggatgtatatacagtacttggccgatccaagaagaacgccttaaaattcccttcccacagcaggtaatctaataatagccttttgcgcctctggattgatacagctccaatctgatctttgcttctggcaacaagttgtctattactgggtcttgcaccatgtaagcttgcttggaagcccattcgagcaccgtgaggatttccgcctgtgccaactcctcgctgtccgggacattgtgtgcgatgtagcatgcaagggtgagtgatgcgatctgaaccacctgctcgctgaaatacacgagctgaaccaggtgcttcgctccgcctgcactgatgatcgctttagtgtggtcaacgtgcaggtaattatccgtgcacgcaaacttggtcagtgcaatcgctgcctcccgagagacatctgcttccctctcatcaagaagcttcaccagtggcccgatgatccgggtctctgtagcacggaaggttctggacaagcaacccagcgagataatgcagggaatcaggagatcgtcgtactcggccttctcaacgacacgtaggaactggtcaacaacagcccgggcagccggagaagttggtttgaacgccgatcgtcggaggtcggaattctgctcggccacgcagcagatctccatgagagccattgcggaattatactgcacgtcaccttcacctttctcgaggagaacggcgaagcagagcagagcccttgactccgtgatgttcttacagatagcggcgtttcccttggcaagctgccacagcgccttggctgcgttagctttcatgtatgccttcgtctcagggtcctcgaactccctgccccttgtactcgttcctgacagtgacgcgttgtgctgcttcgttgccgcgacaccagcgttactagtggatgatatgttgctgtgcttaccactgcctccgttaggcttcgcagccatggtggactgcaccagactgtggatctcgttcttgccctggggaacgtgtccagtcggatacctcatgccggcgtgctcccctgcatccagcaagtccggctgaaccgcagaggcggcgttgttctttctgtccatcagcacggctcgtgccgacatcttggacgtgacggcgtacttggagtgctcctgcaccgtctcgaaagcgaggtggccgacgagcagccggatgacgttgtgctgcgcgaaggcgtcctggcacttggggtggttggcggcgagctccgagacggcccaggccagcatggcctgcaccttcatgggtccctccttgagcaccttggcgaaggcgaggcacaccccggcctggaccatctgctcgacgcactccgggtcgcggcccagcaggccgatggcgagcgcgcagttctcctgcccctcgaggtgcggctccttgacgagcttgagcagcggcggcacgccgtcctcctctatgatgagcttgcagtacctgtcattgtcgcgcgcgagcgagacgaggctggcggcggcgtcggcgcgggcgtcgaggttgccggtgtagagcacggcgatctgctcccagatgaggaagaggatgggctcgttctgcgcgatgggcgggaggccgatgtgggcgtcgaggtcgtcgtcgtcgtcgccggccgacgaggagacgcggaggagccaggagaggtcgccgacggagttgtcgagctggttggtcatcttcttgaaggagcccgcggggatgatggtgaagacgcggcggacgaggccgtgggcgcggcacttgtcgacgagggccagcgccttgtcgagcgccttctcggtgtcgtcgaagatgcggcgcgccgggcgctcgtagaggtcggcgcgcgcggcctggcggaggaggccggcgaggcgctccaccttggccttgagctccatgcactcctgccggaacgtgtaggcctcgtcggaccactttattacctgctcggcgagctggatcgggcgcgccaggatctgcttgaggtcgtccatcccgtcccgcccgacgacgctggcccctcgccgcggcggcgcggtcaagcaacctaaggcgggccgcccccgggcgccaggccctgtccccaatcccgcagcaggcgggctgctcgatccgaccttcctccctgcctcctccgcagggtgggaattgggggagaactggaggaggaagaggaggtgaacg

SEQ ID NO: 24030 - DNA, 1187 bp, Zea mays
ttttttttttttccggctcgagagtaccaataatgatgtcttataaacagtagtaattatattttataaatatttaatgtttttcttgatgaaagttgaataccaaggataattaagaagggtcggggagagtatatatatatatattatatatatatatatatattattataattattacagcacgcaccgtttcctgcatatcgatctacccgatcgagctgagcctgagactgcgagggcgacgacaaaaaggctgcagctgtagctgcaggagatgaattgtgggattcacgaggagtactggacgatggatctgtagaatgtgtttggcctccagttgagtgggatgacgtcgcgtgcgacgagcgtcttgccggagtcggtgcgggtgcggatggggaagggtggctgcaggcggtggttggagtcgaggcgccagatggatccccatgactgggctcatgggcgtccagcggcgggcgcgcttctccatgaggtcgacctggacgacgtcgccgtcgccgttctgtactcgaccagcacggcgaagtagacctgggtggagccttcctcgacgtggaagccgaccttgaggcctgggaactcgcagggtaccctggcgaactggatgtcgatgatgccggcgcggcgcaggtcgtcgttgcggccgggcttggccagcctgccgaaggcggtgccgctgaggtcgaagtggtagggcgcgacgcccggggtgtagttcatgtcggtgatgacgacggtctcggtgcggccggagcaggcggcgtgcttggagcacctgatcttgtagcaggagccgcatcccttgccgtcgcggtagagaggctggttgccgcaggaggtcatggccatgaacgggtactggttgacgttcttgaacccgcaagcgccgccgttgtcgtagggcccggcaccgttgggctggccgtaccatgtggccctggcgttgccccactgcagctgcctggcggcggcatcgctggtgttgtagttgttcacgccgccgctggcgaaggagcaacaacaggccagcaggaggaagacggcccgaaggagggacgaccccatccccattctccaacaacgtataggaaggtatagtagccaccgccgccgccgctgctctgctccaacaatgtactagctacccggccggcttttat

SEQ ID NO: 24031 - DNA, 547 bp, Zea mays
ctaaaaaaatagtctattccattagtaagattataattcctcaaaataaaaggaaacaaacgagaccttagtgttcgtctcaattgtcgccatgcggaaagcacatgaatcaaatcttactgttcgtctcaattgtcgccatgcggaaagcttttgaaacaaatcttaccgtgtctgccgatatcttatacatcaagtaaaataaatataaactcctttgtgatgtagggaattcgtgtgtacaactatttataaaccgatggctgttcctcctcatcagtatactataaagctccctttgggtatctatgcttcttgttgatgaccaaatgttattgtgaaacagccctatctatgtactagtaaaaaaaacatctcgtacgaatggaattaagcaaagaaaggaggggaaaaaatgattcaaggaaataactttggtcagctagatgctatgagccagtgagggccggtggatcaggccaccatttgctccagctccggccactgcgcaaatatgtcgccggcgtggccgtccttgacaagagag

SEQ ID NO: 24032 - DNA, 995 bp, Zea mays
tagtttgtagtatactattacacgattctagctatagctatagctagctcatatacaaaccatcacatgatatatagatacacacacgcatgcatcatgcatgcatttttatagtatgtagtaatctataatacttaattacacgcacgcgcgctatctctcgatcgtgaagaagagagattgctagctttattccggtccgatgatgatggaggcacacatatatatatacatagatccttggttctacaatacgttgacagtaatctgtatatatgcttcgtgtagtggttttggttggttcttattgtcttcaccgccgtcgtcgtcgtggtggatgacgacgagtcgccgccgtcgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggccctgttggccctcctcctccggcgcctcctcgcggcggcggcggcagcgtggtccacgggcggcggcgcgtcgtcgatgggtccagcacggcagccgaaggggacgagcgacaggagcctcatcagcttcctgcgcacgagcccctcggtcttgggccccggcccgccgccctccggtcccctatctctcttgcctctctttttcgtgctgtacctctcgatctgggccagttttttctccctctccctcccctctctaccgcggcggcggcggcggtggcgagacctggtcggcaggcacccactggcgatgagtggtcagccgagagctgatcgacgagcggagctgctgtgtggtcagagggtgtcccggccggcctccgaggtcccaatgg

SEQ ID NO: 24033 - DNA, 636 bp, Zea mays
cttcaccgccgtggtcgtcttcgtgaagacgaccgagccgcccgccgacgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggctctgttggccctcctcctccggcgcctcctcgcggcggcggcggcagcgtggtccacgggcggcggcgcgtcgtcgatgggtccagcacggcagccgaaggggacgagcgacaggagcctcatcagcttcctgcgcacgagcccctcggtcttgggccccggcccgccgccctccggtcccctatctctcttgcctctctttttcgtgctgtacctctcgatctgggccagttttttctccctctccctcccctctaccgcggcggcggcgagacctggtcggcaggcacccactggcgatgagtggtcagccgagagctgatcgaccagcggagctgctgtgtcg

SEQ ID NO: 24034 - DNA, 849 bp, Zea mays
ttgggtacctcgaggccggccgggaccgagagtggcagtggagtagtggtaggaaaagctcgtcgccgagtcgccgtacgggggctcggctcgggtgagcgagcggcgggtactgaggcctgagggcgaggcgatggaccgcctccgcgacgggcgagccttcctccaccgcgcgcttgtcctctcgtcgctgctccttctcgcctccggcgaaatattcttcgaggaacggttcgatgatgggtgggatagccgctgggtgaaatctgattggaagaagagccaaggacaagctggaaccttccgacacacagcgggaacctactctggagaccctgacgataaaggtatacaaacaactggggatgccaaacattttgctatatcagcaaaattcccacaatttagtaacaaggaccggacattggttatccagtactctctaaagattgaacaagatattgaatgcggtggtgcttacatcaaacttatgtctggttatctcaaccagaagaaatttggtggcgacactccttacagcttcatgtttgggcctgatatatgtggggatcagaaaaagaagctccatctcatactttcataccaagggcaaaactaccctatcaagaaagaactaaaatgtgaaacagacaagttgacacatttttacacatttattcttagacctgatgccacttatagcatccttatcgataaccgggagagagaattcgggagcatgtacactgactgggatatccttcctcctcgtaagatcaaagatgttaatgcaaaaaagccaaaagactgggatgacagggaatatatttgagatcctgatcaagttag

SEQ ID NO: 24035 - DNA, 825 bp, Zea mays
cgatcgtgagaaagagagattgctagctttattccggtccgatgatgatgagggcacatatatatacatagatccttgttctacaatacgttgacagtaatctgtatatatgcttcgtgtagtggttttggttggttcttattgtctcccccgccgtcgtcgtcgtggtggatgacgacgagtcgccgccgtcgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggccctgttggccctcctcctccggcgcctcctcgcggcggcggcgtggtccacgggcggcggcgcgtcgtcgatgggtccagcacggcagccgaaggggacgagcgacaggagcctcatcagcttcctgcgcacgagcccctcggtcttgggccccggcccgccgccctccggtcccctatctctcttgcctctctttttcgtgctgtacctctcgatctgggccagttttttccccctctccctcccctctctaccgcggcggtggcggcggcgagacctggtcggcaggcacccactggcgatgagtggtcagccgagagctgatcgacgagcggagctgctgtgtccggacaggcgtgggtcaacccccggccggcctcgagggtcccaa

SEQ ID NO: 24036 - DNA, 1012 bp, Zea mays
ctagttctagaacgcgagccgcccctttttttttttttttatagcaaacttggatattgtattagcttagtttgtagtatactattacacgattctagctatagctatagctagctcatatacaaaccatcacatgatatatagatacacacacgcatgcatcatgcatgcatctataatacttaattacacgcacgcgcgctatctctcgatcgtgaagaagagagattgctagctttattccggtccgatgatgatatggacgcacacatatatatatacatagatccttggttctacaatacgttgacagtaatctgtatatatgcttcgcgtagtggttttggttggttcttattgtcttcaccgccgtcgtcgtcctcgtggatgacgacgagtcgccgacgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggctctgttggccctcctcctccggcgcctcctcgcggcggcggcggcagcgtggtccacgggcggcggcgcgtcgtcggaatgggtccaggcacggcagccgaaggggacgaagcgacaggagccttcatcagcttccggcgcacgaggccccttcgttcttgggccccggcccgccgccctccggtcccctttcttcttcttgcctctctttttcgtgctgtacctctcgagctgggccagttttttcatcccttctccctcccctctaccgcggcggcggcgagaccttgtcggcagggcacccactggcgaggaggtgtcggccgagagctggtcgaccagcggaggctgcttttttcgcccgg

SEQ ID NO: 24037 - DNA, 1101 bp, Zea mays
  misc_feature (57)..(61): n is a, c, g, or t
cagggccccctttttttttttttttaaattttttttttttttttttttttttttttnnnnntttttttttggccgctttttttttttttttttttatagcaaacttggatattgtattagcttagtttgtagtatgctattacacacgactctagctatagctagctcatatacaaaccatcacatgatatatagatacacatacgcatgcatcatgcatgcacatatatatagtatgtagtaatctataatacttaattacacgcacgcgcgctatctctcgatcgtgaagaagagagattgctagctttattccggtccgatgatgatggaggcacatatatatacatagatccttggttctacaatacgttgacagtaatctgtatatatgcttcgtgtagtggttttggttggttcttattgtcttcaccgccgtcgtcgtcgtggtggatgacgacgagtcgccgccgtcgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggccctgttggccctcctcctccggcgcctcctcgcggcggcggcgtggtccacgggcggcggcgcgtcgtcgatgggtccagcacggcagccgaaggggacgagcgacaggagcctcatcagcttcctgcgcacgagcccctcggtcttgggccccggcccgccgccctccggtcccctatctctcttgcctctctttttcgtgctgtacctctcgatctgcggacgcctgggactggactgcgtttccacgttgcgatgcaatatgagctgtagtactgtcctcgcactactatttaccgtttgtgctgcatatgtgatataaaccttcaagaaacacacacacgaagggtctgaatgagcacggcctttgttgtttgcttcttat

SEQ ID NO: 24038 - DNA, 1796 bp, Zea mays
actccatagggccattgggtacctcgaggccggccgggaccgagagtggcagtggagtagtggtaggaaaagctcgtcgccgagtcgccgtacgggggctcggctcgggtgagcgagcggcggccggcgggtactgaggcctgagggcgaggcgatgggccgcctccgtgacgggcgagccttcctccaccgcgcgcttgtcctctcgtcgctgctccttctcgcctccggcgaaatcttcttcgaggaacggttcgatgatgggtgggatagccgctgggtgaaatctgattggaagaagagccaaggacaagctggaaccttccgacacacagcgggaacctactctggagaccctgacgataaaggtatacaaacaactggggatgccaaacattttgctatatcagcaaaattcccacaatttagtaacaaggaccggacattggtgatccagtactctctaaagattgagcaagatattgaatgcggtggtgcttacatcaaacttatgtctggttatctcaaccagaagaaatttggtggcgacactccttacagcttcatgtttgggcctgatatatgtggggatcagaaaaagaagctccatctcatactttcataccaagggcaaaactaccctatcaagaaagaactaaaatgtgaaacagacaagttgacacatttttacacatttattcttagacctgatgccacttatagcatccttatcgataaccgggagagagaattcgggagcatgtacactgactgggatatccttcctcctcgtaagatcaaagatgttaatgcaaaaaagccaaaagactgggatgacagggaatatattgaagatcctgatcaagttaagccagagggatatgattcaattcctaaagagatacctgatcccaaggacaaaaagcctgagtcatgggatgacgatgacgatggtacatggaagcctagaatgatacctaatccagaatacaagggaccatggaagcggaagaaaattaagaatcctaactacaaaggaaaatggaagaccccatggattgtcaatccagagtttgaggatgacccagacctatatgttctgaaacctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaagaaagaggaaggctagagaagaagaggaagcacggagggcacgggaggaaggggagagacgaaggcgggagagggatagggaccgcggcagggaccgatacaaggatagatataagcgtcataggcactacgactaccatgacgagctatagatcctgtattcttttgaaatctgcacgatattggatgtctgtctacggagagcgcacgtgcaaaacttgtatgttgtactcacggatgaagctgaacctgtgattttggcgatgggtagagattggccatcgcgtctgtaactaaatttccacgttgcgatgcaatatgagctgtagtactgtcctcgcactactatttaccgtttgtgctgcatatgtgatataaaccttcaagaaacacacacacgaagggtctgaatgagcacggcctttgttgtttgcttcttataaaaaagaactgttttatctgtgtatacttgccctactttttgctatttccaagcagctggacagaaactgactactgtaccagaaccag

SEQ ID NO: 24039 - DNA, 1069 bp, Zea mays
ggccgcttttttttttttttttttattttttttttttttttttggttttggtttttttatagcaaacttggatattgtattagcttagtttgtagtatgctattacacacgactctagctatagctagctcatatacaaaccatcacatgatatatagatacacagacgcatgcatcatgcatgcatatatatatagtatgtagtaatctataatacttaattacacgcacgcgcgctatctctcgatcgtgaagaagagagattgctagctttattccggtccgacgatgatggacgcacatatatatacatagatccttggttctacaatacgttgacagtaatctgtatatatgcttcgcgtagtggttttggttggttcttattgtcttcaccgccgtcgtcgccgtcgtggatgacgacgagtcgccgccgacgccatgatcagaacaggaacgccgtcggcgcgaacgctggcagggacgacgcgccctcaaggtgccggtactgcttgccgccgtgcgcgcggggcagcgcccgggcgaggtcccaggacgccgccttcctgaccttgacggcgtcggtgctgctgctgtactcctcgcagatgtcgccgagcgaggggcgccactgctgcggcgcacccgcagcagcccccagcagctgggcggctctgttggccctcctcctccggcgcctcctcgcggcggcggcggcagcgtggtccacgggcggcggcgcgtcgtcgatgggtccagcacggcagccgaaggggacgagcgacaggagcctcatcagcttcctgcgcacgagcccctcggtcttgggccccggcccgccgccctccggtcccctatctctcttgcctctctttttcgtgctgtacctctcgatctgggccagttttttccccctctccctcccctctctaccgcggcggtggcggcggcgagacctggtcggcaggcacccactggcgatgagtggtcagccgagagctgatcgacgagcggagctgctgtgtcggtcagtgtgggttcccggcccgcccgcgcgggccccgcacag

SEQ ID NO: 24040 - DNA, 2077 bp, Zea mays
ggccctaggggccttttttttttttttttttccggttttttttttttttttaataataaacataatgtttgaacgattcgtgacttcttcgttaaccaacgaacagctggttaccttgtacaccgacccaagttaaaatcattggaataatttacatacatgacaaacaagaacacgtttgcatctgaataccttagagacattccttttttcatgctaaaatcaaggaatgctgacttgtagagggtggagttcaggtttcccaccactatatatcccagaccaacatactagctgtcgaatcctatgtatgatctactacggtccacagaagcagccaccgcagcgtaggatactcgatcctgggactcgtcccgtttggcgaatcttctcggccttctgaaccgctatagctgcttgctggttcattttggcgttggccgaagctcgtttctcttcggctatgcggcgcgtcatctctagcttttcggccatcttttccatggcctcacttctcattctctcagcaaattcctctattcttctcatttcatattcaatttttgctctttgacgaccctcccaagcttcaatcttcacctcttcttttttgaatcttgctgtatgtttagtattttctgcctcctcatacgatgcagcacgagcagcatattccttcctgatgcgctccaaatcagcgatgctcggtgccgcagagactagctctagctcctctttgctggcccacgtagcaatgttcatctttcctagctgtatgccaagcgcagcgatttcttgccttgttttaagcctcgtctcagtatctgacaattcatttgcatgtacgccgcatttcctgtggaaaaatgggccatcgtctgtgcagtcttctccaggaggagatgctattgacctcccccctacaggtgttgacggtactgaacagttagggcttcgagttggtgtccttgaccctagtggagttccagttcttgaaggttcctggctaggtattggagtcatctctgtgcccacatctctcacggacaccgacgactggactgttggaatatcattcgtatcgttgcagggcttcacttcaatcgatgaaccagtatcagttgccttgtgatgctctgagttagcaccagcgttactaactggacagacatctgcatgcctaaccaacttaggctgatacgaagcgaaggacaacctctccagtatgctgcgcggagcagacaaagctggattcactctcttcattttctgcacgggacgagcagagattttgggcacaacggcgcccctggctgcggcggagctcatctggtttactgtctggttctgcaacgcgcccttggcgacgttgttcttctgactgacattctggcggctcacgatccatttctctgcgtcattccacttggaggaaatggaagtctgcctggacaagtacccggctgctggattctgcgtcgccgccgccttctccactccgtggaactcgaagctgctagtgctggcgttgtcgagaccactgtcgcattcggtagtgctgtcttcttccgcgggtctcagtgggtgtatctgtatcatactcgagctgcctgtcgctggcttagcagccgaactggtggaagcgttctgcacttgactgttgtccactgctgagtacttttctacggcttcggttttgttaatgttacttgccgacgggtgttttgtgctatctgcgctgtcttcttcaagaacatcacaaactagtagcctgttctgcgcctgtgaagcctcgatggttttcgcaggcgacgtccgcgatgacgagttgctggtgatgactctaactcgattgtgggctcccaggatcttcatcctcagctttgttggagaaagagcaccaggctgggctttctgatgaatcctctcgtactccattcttcctcgctgctggcctgatggggagggtgcggcgggtggccagcgagcgagaaagagaggctggagattgaggggaggggagaaggcgagcaccgggtctggcgagtgggcaccagtggtcaaaataccagtgacc

SEQ ID NO: 24041 - DNA, 2096 bp, Zea mays
ggccctaggggccttttttttttttttttttcttttttttttttttttttttttttttttttttttgtttgaacgattcgtgacttcttcgttaaccaacgaacagctggttaccttgtacaccgacccaagttaaaatcattggaataatttacatacatgacaaacaagaacacgtttgcatctgaataccttagagacattccttttttcatgctaaaatcaaggaatgctgacttgtagagggtggagttcaggtttcccaccactatatatcccagaccaacatactagctgtcgaatcctatggatgatctactacggcccgccgcggcggcccccgcggcgtaggatactcgatcctgggactcgtcccgtttggcgaatcttctcggccttctgaaccgctatagctgcttgctggttcattttggcgttggccgaagctcgtttctcttcggctatgcggcgcgtcatctctagcttttcggccatcttttgcatggcctcacttctcattctctcagcaaattcctctattcttctcatttcatattcaatttttgctctttgacgaccctcccaagcttcaatcttcacctcttcttttttgaatcttgctgtatgtttagtattttctgcctcctcatacgatgcagcacgagcagcatattccttcctgatgcgctccaaatcagcgatgctcggtgccgcagagactagctctagctcctctttgctggcccacgtagcaatgttcatctttcctagctgtatgccaagcgcagcgatttcttgccttgttttaagcctcgtctcagtatctgacaattcatttgcatgtacgccgcatttcctgtggaaaaatgggccatcgtctgtgcagtcttctccaggaggagatgctattgacctcccccctacaggtgttgacggtactgaacagttagggcttcgagttggtgtccttgaccctagtggagttccagttcttgaaggttcctggctaggtattggagtcatctctgtgcccacatctctcacggacaccgacgactggactgttggaatatcattcgtatcgttgcagggcttcacttcaatcgatgaaccagtatcagttgccttgtgatgctctgagttagcaccagcgttactaactggacagacatctgcatgcctaaccaacttaggctgatacgaagcgaaggacaacctctcccagtatgctgcgcggagcagacaaagctggattcactctcttcattttctgcacgggacgagcagagattttgggcacaacggcgccccctggctgcggcggagctcatctggtttactgtctggttctgcaacgcgcccttggcgacgttgttcttctgactgacattctggcggctcacgatccatttctctgcgtcattccacttggaggaaatggaagtctgcctggacaagtacccggctgctggattctgcgtcgccgccgccttctccactccgtggaactcgaagctgctagtgctggcgttgtcgagaccactgtcgcattcggtagtgctgtcttcttccgcgggtctcagtgggtgtatctgtatcatactcgagctgcctgtcgctggcttagcagccgaactggtggaagcgttctgcacttgactgatgtccactgctggatccttttgaaccttttctacggcttcggttttgttagttgccgacgggtgttttgtgctatctgcgctgtcttcttcaagaacatcacaaactagtagcctgttctgcgcctgtgaagcctcgatggttttcgcaggcgacgtccgcgatgacgagttgctggtgatgactctaactcgattgtgggctcccaggatcttcatcctcagctttgttggagaaagagcaccaggctgggctttctgatgaatcctctcgtactccattcttcctcgctgctggcctgatggggagggtgcggcgggtggccagcgagcgagaaagagaggctggagattgaggggaggggagaaggcgagcaccgggtctgggcagtgggcaccagtggtcaaaataccagtgaccagatcccggccagg

SEQ ID NO: 24042 - DNA, 3124 bp, Zea mays
aataatgaaattcggcacgagggtttggtcgtgaacctgccgctgtggctgtgctgcatcccccaccctcgccgctccctcgtccaaatccaccagccgttcgctttcctctcctctcctctccatcatcccggccggctcgccagtcgccaccctccctttcctcttttcagctacagttgagcttgggcagtagtaggttggttctgcttcccttcccctcccccgatcccttttccttgctggggatcgggaggccttcaggcttcaacccatcttcctccctgtccacatctcgctccttgtttggggtagtgccggctggtggtgccgctactgctagccgggaacccaatttcttgataggactggacgactggtgcgtgccaaccacgagtttttcctgttcgctttgctttctcggctcagctactgctgctctgctaggaacaccaacagtagtgtgttcttgcgccggcttttcttgccgtgtttcgggtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggctggaagagcttaggaatatctggcagcatgttgttaggaggagattcagtaactgtgattcgtgctaacaatgatggctattaggagtggcataaggccatcaaatccaggatttgatcttgctcacacccaattaacagctgggccacctgacccaaagtgggaggcccagcaaaaagaggaaggaatatcatagtgaagaggaagatgaaggagaagagagtaatggccaagataacgatgatccttcagctccaaagaaaccaagggttgtttggtcagttgaactgcaccgaaaatttgttgctgctgtcaatcagctaggaattgacaaagctgtgccaaaaaggatacttgagctcatgaatgttgagagactcaccagggaaaatgttgcaagtcacctgcagaagtatagactctaccttaaacggctaagtgctgtggcatcacaacaggctagcattgttgctgctttgggaggcaacgacccctttatgcggatgagtgcatttgaaggactccatgattatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatccaaatgataaatatcaccttagcttaccaggcactagttgcctacaaggaaatctagcacaaggtttgccaactccagttgggcaggtccagctgccacagaagtggatacacgaagaaaccgacgatctatctactatcctttctgcgagtggccgggctaatagtggtgttcctggcacactccaaagtgtcacgaacagtcacttgctgcagcaaggctttgttgaacgtagacaagacaaagttgttatccagccatcttcatctgcaagttcagatcgtcctgaaggcactgttggagtttcctccagtctgatggattcctgtgcaacccagcagagggttgttccattgtctgccttctctagcagtgcatctccaatgaatggctcgttttgcagcaacggtgtagctgagttgggtgctacatcctctggaggtacaagtattttcccctccaatgacctgaggatagaaagagacagcaaagtgggagctagctcttttggtagtgtgatacttctgtctccagacactgtgccaaaccaaaaatacttgaacttcggcggtgaaagcgatttgagatcgaacatggatggagggaacgcaggcaatctgttgaatcccaagctactatggagttgtttgccggcctctcagccgcctaatcttatcggaagtcatcatcccatgagccaaagactgaaccttggcggctcaatggtcagacagacaacagcaagtgcttcggcagctgccccacagacaaggatcgacatgtttatctccggagacgctccgaagagcgcgtcggatttgagcttccctaaggtccacagcgagcttagctctagcagctgcagctttgacggcctcctcaactccataatcaaagtggagaaggacgatgcttccttcagcgatgacctgggatgcgacttgtactccctgggtgcctgtatatgatcgctaccttccacgtatctgcatctgtgttaatctcccattgtatgctgtgcagctagtgttaatcttaggtagaattgtagctgtgcgcctatctttgcttgctcacagccaagaaaaaaaaaattgatgtctgcacgtgatgtgctagcagtaagatatctggatttgtggaagtcaatgcccatttgctaaatcgagctggagacactgttggcacgagttgattctaaaagcggccttgatgatctaggcccaatttgaatgtcgacacactgaaagcctaaaccgccgtttgagtaatgacacgtggtgttcatgtaaacaaatccaaaagtttaaaacaaattgggagatttgaagtcgatgctcaggtgctgccgaacccaatgccaactcgacctgactgcctccgtctcgacctcgcttcccgcacgccatcaaaccctaaagccctcgtctcctcgagttgagtagtggaacttttgggttctcctggctctggtctttgtcgaatgtcgacgcactgactgttactgtatcggttgagct

SEQ ID NO: 24043 - DNA, 2297 bp, Zea mays
  misc_feature (2277)..(2277): n is a, c, g, or t
  misc_feature (2290)..(2290): n is a, c, g, or t
acgatcaagttcctgggtgtgctcattttggtgattttttttgttgttgctcgtttgcatcgagattagtgaaaacaaaatcacgttgtttctatctaggacggaaacgagtatcttgttacagcatcggaaacgttttcggtgaaaatcgatcgtgaacaagcaaagaacaaagacaaaaacaaccgtaggtgctatctttttcaggtttttttatgctttggttcccacttgaaacagagtagcacgtattaaactcggtgctgtttttctaatctaaagtggcctgcaaacatcaaggcttacctaaaggcttgagcagtacacatgaaacatgaaaagaaccctaacatgcgcaccttttttttgaaaaacctggagctcatcaaatataagcttaagaaaacttatcataattatgatcagcaacatgcgcaccacaaattccaacagaaaaaaaatcctaccgttcatgtctgttccacaacatattacatattgcagacttcgctctttgcatagtaaaatccaaagtatgatacaaacaaaagcagatattaatgctgcagcggaggtactgatgggttggtcttgctgccgcagaaaagatctgggactggaacttatgggtgatagctgagaataagttgtccacctagagcggcattcttccaagcttacatttagtgacgccttctgtctctatgttcgtctctagaatagcgttgttcataatccctccttgaatggtaatgcgagtcatgccttgacctcttggaatcatgactatccatatatctattgtgttgaccatgctcttcctgccttctattgtcatctctgttctgagagtctctgtatccctcttctctatctctacttgaatttggatcataccgatcatctatcagtttccttttgttgtccctctccacatcatttccacctttcctttcgtattgctctctctccctctgtctctcttcctccctctctcgctgccttttcttctccttctccatctccatcctctcttcctccctttgcttttgcttatccagctctttcttctctacctctctcttctgttgcttttcaagctcttttctttcctcctctttctgcctttgtgtagtcagctcatttcttctccctccagcttgactccttttctgttcctcatagctatctgcactcgtgtcagaatcactactgctgaggctgctgctgtaatctgaactatcacttgaggtagctacttttcttttctcttgcacatcctttttcaacactgcaacattcaattgtctttccttaccacgggaataaccatctgaatctgagtcatggcgaaagctttccttgtacttactatgtttctcatgctcggaagcccgagagccataattataatttctcaatctaggcttctcatcctccaaatcatgacaagagctttgcactggtctcttgtttttcccattattatctgcaccagagtcagaatcatggcgagagcttctcgctggtatcttctttctctcatcacgaataccctctgtatgttctattttcttcttcctatagtcaatatctgcatcagactcagaatcatgatgagaactcttcaacggtaccttccttctctcatcacgtacattctttgtttgctcaattttcttcttgccatagccactatcagtatcagactcagaatcataacgagaactcttcaccggtaccttccttctctcatcacgttcattttttgcatgttccattttcttcttgccatagccactatctgtatcagactcagaatcatgacgagagttcttcaccagcaccttctttctctcatcgcgttcattctttatatgttccattttcttcttgccataaccactgtctgtatcagactcagaatcatgacgagagctcttcaccaataacatctttctctcatagtgttcactctttgcatcttctgttttcttgccatatccactatctatatcagatttgaaatcatgacgagaattctttaccggtatctttctctcatccctatcattccttgcatgttctgttttcttgccatagctactatctgtgtcaggctcggaatcttgatgagagttcttcacttgtatcttctttctcccaccccgatcattctttacatgtttagttttctttttgccatggccactatctgtatcagactcagacccagagttctttccacgctttgccttctttcgatccattttcagnaatcatcatctgnaaccaag

SEQ ID NO: 24044 - DNA, 688 bp, Zea mays
  misc_feature (672)..(672): n is a, c, g, or t
ttttttttttttttttttcttttgacgaagaacacaaattttgcatttcagaattgattgaccagttacacggtacactacaggttcaatcagaacctttggtcacttcaaaaacagagcctacatgctcaagccgtttgctgattacaacagtcagtcatgtcagagaccaactaaggcgtgtctcgtcccctcaggacggacagatgtgcagtctcagtgaaggtatggacgcgtctgaggagaggacgccatgaacgttcgttgtatgccatgaatgagtctgactggactctccacatcaagccttccggacgatcacatggcgctctctcttgtactccacctcgtctctttgatgcataatcagaagagctcttctcacaatggattcgttcattcccatcctgtttagtccatcaatcagccgtcgctcagatatgtggcttccaatgcccattcttcgctttatctgtgcttccgcttgcttgatttcatttgcgatctccggcgacaggttcaaatgctcgttgattccggatctcgcagcgtcgacggtggagacattgaacagtctgaatgcctacgtagctttgacatgctctggtgtagtcacgcttgtcaatctgatctttgcaagagattcactcaaacgtatgcccgtgtacctgnccggacggacgttcga

SEQ ID NO: 24045 - DNA, 1145 bp, Zea mays
ggccggctgacgcgggaggaggcagacgcgcggacgaagcggaaggtggaggccgtgatcaaacgcgagagagccctcgcctacgcctactcccatcagctcggacgcgtggggctgaaggcgacaccgatggcggcccacgcgatcctggcggacctgcagtcggggcggagcccctggtggtggacgcccatcgagcgccgccacgagccgggggcctaccgccctgcggatcccgccattagaaagcccctgccggcgctcgccatcgcccaccgcgacatgacgacgacgcctgtggcgatgacggcggcgacgacaccggcccggtcggtggtctcggcctactctaagacaagggccacgaggcctgtgatcagggtgggagccccgccgccttcgaaccatagccacgtggggagcatccgcgacgacgagagcctgacgagctgcccggcattcggcggcgtgcccaactacatgacgcctacgatgtcggcgtccgccaaggcacgggcacgggcgcacctgcaggagcagcagaagaacaaggcggcccaggagaagcccaggttctcgttcgggctgggccagagcatcgggagctgggccaagagcccgttctggaaggccgctgtgccgtcgtcgagggtggccacgccggcggcgtcgatggccggcgggcgacaccgatcgacgcggtcgatcagcgggcttagcacggactccaccgtgtccatgccagccaggctcggcacgaggtcctttaagtagatacacatgtcggactcatcgttgcttacattgcattgcattcttcttatatctcttctcgacgcatttgtgcttggaagtggtacacatgtgattgatggtgtggcttgttgtgggataccatcgtgtttgctgatttattattgtgccttactagctccctggttgctagctcctttgttcacagccttccgtgggtttttgagaggggccagagttgtagcatgtaaaatctgtgactccatcgaacaaccgtacatgcgttaagttcgtgctttttgccaattaccatggcatgtaaaaaaagtcgacttaagttgaacgtgacactgaggtgaaaaaaggagtagaaacattcatgttgttgggag

SEQ ID NO: 24046 - DNA, 2385 bp, Zea mays
tcactggtgatttggctgcaacagtgaacagcttcccacaagaaattgatggttctctggaggcagccattggctatccatttttgaagacacagtcatccaatctatctgatatcttaaaagacagctttaagaaaactgacagttttacaagatggatgagcaaagagcttcctgaagtggaagattctcaaattcaatctagttctggggcgttctggagcagtgaagaagcaaataatatcatcgaagcatcaaaccatgaggcactggatcagttcactgtttccccgatgctctcgcaggaccagctctttagtatagttgacttttctccaaactggacatatgtaggttcaaagactaagattttagttgctggtaacatcctgaatgacagtcaaatcaccgagagatccaagtggtcatgtatgtttggagaagttgaagttccagcaaatattttagcagatggtactctcatctgttactcaccgcagcataaacctggtcgagtacctttttatatcacctgctccaacaggttggcctgcagtgaagtgcgagagtttgaatttcgaccaactgtctcccagtacatggatgctcctagtccacatggtgaaacaaacaaagtttatttccagatacgccttgacaagttgttatcccttggaccggatgagtaccaggcaactgtatctaatcctactctggagatggttgacttaagcaggaagataagttcactgatggcgagcaacgatgagtggtccaacttgctaaagttggctgttgataatgagccttctactgctgatcagcaggatcagtttgctgaaaacttgataaagggaaaattgcatatctggcttctaaataaagttggtatgggtggcaagggacccagtgtgttagatgatgaagggcagggcgtgcttcacttagcagctgcacttggatatgattgggctataaggccaacacttgctgctggcgtgaatattaatttcagagatattcatggctggactgcactccattgggctgccttttgtggccgagagagtactgtagttgcgcttattgcactgggagcagctcctggagctttgacagacccaactcccgatttccctggaagtacaccagcagatcttgcatcttctaatggtcaaaagggaatatctggtttcttggcagagtgttctctgaccagtcatcttcaggtccttaatctgaaggaagctaatatggctcaaatatctggtctacctggtattggagatgttaccgagagagattcactgcagcctccaagtggagattcattgggtcctgttcgaaatgctactcaagctgctgcgcggatatatcaagttttcagggtgcaatccttccagagaaagcaagcggctcaatatgaggataaaggtggcatgtctgatgagcgtgctctctcactcctttctgtcaagccacccaagtcagggcagcttgatcctctgcactctgctgcaactcgcatacaaaataagttcagaggatggaaggggagaaaggaatttcttcttattaggcagcgaattgtgaagatccaggctcatgtgcgaggtcaccaagtgaggaagcattatcggaaaatagtttggtctgttgggatcgtggagaaagttatattgcgttggaggcgtagaggggctgggttacgtgggtttcggtctcaagaaggatcagtggagagcagtagtggcggaacaagtagcagttcgatccaaaataagtcttctggagatgattacgattttctgcaagaaggacgaaaacagactgaagaacggctccagaaagctcttgcaagagtgaagtccatggctcagtacccggaagcaagagatcagtaccagaggattttcactgtcgtgtcaaaaatgcaggagtctcaggctatgcaagaaaagatgccggaggagtcagcagagatggacatgagtgaattcaaggaactgtgggatgacgatgcacctatcccgggttatttttagtgtggaaacctgttttgttggatttatttctctgtagattgctccgtttgtcttgagtgctactgaattgatggcacaaatggctgataacccaaagtagcgttgctggtgcatgatctgacatgtttggatttggacttaggtgtggtatttcttttgccttatgtacagtagaatattatctacatttgaaggagccttgtatttactgtgtgaaatcggtgtaaagagtttgatatcagagatcttacccagacttaacggttgcatgttactgcagtgcagcagttaggagtttgaggctttttgcacgggaaaaaaaaaaaaaaaaaaaggtttt

SEQ ID NO: 24047 - DNA, 2134 bp, Zea mays
catatttttttttttttatttttttttttttttttatattattttttttttttattttttttttttattattttttttttaagcctattccgcttcttaataaaaatatggccgcttttttttttttttttttgtgtcaacttcagccaatcagctccttgaagaaacggatattaaatagctagtgatacagagagctgctttcacagtgagcttataaccaatctattgtacaattgcatttacagtgtaagcaatcatgacacatgccaaaaaggaaaacactagtccacaaacggtcactaccaatcatctgcgcgcagtcccaagaccatgccaaaactgcatcatttccagtgtttccaaccgtccagggtaggtaaggacgtaaggagcattgacataatttgagttaagctttccaatcaggtgagagatctgcctgcccattcgcgctctctccgcttaagctttgcttgcatcttgttgaatttttcttttcctttctccagaagtgggtctaccactacatagtcatctggatcatctttcctagccattccatccttggaagaactgggtaagaaagacagtaggtttgtgtgccaccctttgtagtcatcctcctcttcatcttccttttccgccttatcagtagaaggattcttttcttcgacatgattggtagcaagattcttactgaggaaagaagacttgaacttctgtaacttcgctagagtctcatcttcacggccttggagccgacgttttttctgtttttgcaaatgtctctcttgttcagctggatttagtagctgcaaattagcatctgctttggacatcctctcagcactcgcttctgagccagcaccttttttcttcaaggatagttttttagctttttggagctcatgctcctgatcatcgtcctcatcagtgtccctcctatgttcaatattggacctgcggtctgataattccttatccttatgatgaggtttatctgctttagaggtttcacgagggcaaacatcaccaagctctctacgttttttaaggatttgtgcgcgcatcctgttatcaaaatcctcttcattctcgtcttcaggaaaatcatcagataatggagcattctcttgctcccttgattcaactttctttgagatcaaagcatccctgacagtttgaacagtaacctttttcatctcctcttgctccttggacaactgtacatcctccggttcccctttaagaaaacggggatcgtccaacacatcatgaatactttttattttggcctgaacagaggtagctgcttcattctcctcctcttctacttcatcaccaaatgagaggacgttaagttgcttaactgccttcttcttgggtttcacctcagcatcagccttagcaacagattcagccttcttaagttgccttggaacaatatcctcaaatgggtcccagagaacctcgactgaaagaatcttctgcacgtacacaggtcgatcatccttatcagtctcaacgtcggccaaggaaagaaggttgaaaatagaatcaccagtaaccttcccaaagatggtgttcttcttatcaagccaatcacaacggtcaagggtgataaagaattggctcccattagaatgagatgtaccagcattggcacaagccactaaacccctgtggttaaacctcagccgcgagtggaactcatccgcaaatggagccccatagatgctctcacccccagtgccggagccagtggggtcgccaccctgcacgaggaaattcttgatgacgcggtggaagagggtgccgtcgtagtagccctcgaggcagagctgcacgaagttgcgcgtcgccttgggggcctccttgggccacagctcgatatcgagcgggccggccgtcgtctgcaccaccaccttccccttcgtcgggggctcaagcacgtataccgaagacatcctgcctcactcctgccgccgccgccgctgctctacctcgcgcgcgtgctcccttccctttggaacggtctaggcgtcggtcggacctccgggcgggcgtggcggagttttttcggaagtcaggtacgcccaagcccaacactggcttccccgaaccggccggc

SEQ ID NO: 24048 - DNA, 3544 bp, Zea mays
cttgcatgcctgcagtgaatacatcggatttcatcgaagcagtggcaaggaatccagattatgcatgctatagtaaatccacccccgatttgctggagcaataagcataaatagcaaatcaacctaacagagcatgaagacatcactcatcagactattggattctgatggctgcacacaggctgctacagcactctactgagagcggaactacacacttttaagttctgtgtttccttatctatttcatgataatttgcagatcatattcacagtagtgagtattccaggtcaattttcatgcatgagttttcaacaccggagtttgagggactaatgagaatggtggaaccaagtctgataaagatgcagataaaaatcgtcttaaaaagccccagtttctggtggaggcatgtttgatcttctaaagccgtcgaaaaaccatgtactgctttcaaaacacactgctttcaaaacatttcatccttaaccactatctataccattgcattgcattatgcgacgcctcaaaaaaccatggtcagaggtcagaatattgctcacttctgtaatagtggaactttactcaattttcagagttcgccaagctctaaccattcaaatataaactaaccgcggttgatgctagacgaaactaggttgcttcttttcaacacaactgacaaagcacatagattgaatagaagatcttcattagacaagaaaatgtgattctataggggggtaacaccaagctaacttcatgaagcagcatgaaaatttagctgtatttctatgacgacttaaccttcttggtttagttctaagccatttgaagacaaacactgaaatgtcacaacatgtcttctttcattggttggttggttactcataacttcagtagggcagtaaaagttttagaatattaaacatagtaactgaaatgacatgttttctcctgctcttttagaaagaaagaaaagagcaatgtcaaacagcaccagatacttgcctaacaatcaaacctatcagttaacatgactggacagtggacagttatgcataatttattcacttaagatttaaactttatttcatataagctagcagtgatgaattttcaaaatgcataatgggtaacaacccttcttcagcctcacctggtgacacagcaattcatcacttcttgcatatatctaatagatgaaaatgctgtggcctgtgacaaggtttcatggtttgatgtccattttgggctgcagatactctatactctagccatcatcgagttagatcatccacaaagttatcatagaaaaaacttagaagttcaaaaggttgagcacaaacttattgaattaaatattgaaatgcacacataacacttaatggggttaaattaaagtagtgcttgaaacagatatggaatcctaatattgttacaaaataatcatgctactcatggaggacaaaaacagtgatgcacagttgtaatttgagcaacagcatcaccatatgtgagtacaagacattaaccacaaatggagaatccatggtagcatcttcacaagttcagaagagcagaagctgcagtataacaggctacaaggatacatatcatttatcactttgctgctccttcaaacaagtgctggatgtgggctacaacatcctctggggtgtatttgatgtacaaatcacgcccagtttcaggagaagacttcaacttggcaattaaagaggcgtaaactggcatcactgtctcctccaccgctgccctaatgtcaacctttagctggtcatctgctatcacccattctgactgtgccgcatagatctcctcaaaatatgtattaaacattcgcagtttctgcagcattgccttggctgggagtccaccaatgcctggagtgccactttgcagcacagttgtaaccttgccccatgttgcccgctgataatccatgctccagcgtcgaactctatttgtcatctgctttatccactcatcaccgagtaaaacacccaactcactgtcattcaccttgtgtatgatgtacttgccattattcatcaagaagatagaagcaagagatggatcacggtatatcttagacttcatatccagattcttttgaagaacatccatgatccaagcaatgtgcacagcaagggatgatgtgggacggtcaggatcaacagccacaggcgcacctccattagccccaaagtcaccttccatcacctcttccaatgtctgccgcgacccacacgcagctcggagatagttcataacataccgagtgataggatgtatgacgccaccttgggcagcaattcgggcagggtcacggcggatgagattttccaattccataaatatacccttgatagaggaccccagtgtgttgcacatcgaggagacctccgcacggagtgcagcggagtatgggtcagagaacacaggatcaaggtcagggaggatgtcacgcacagcctcgtacatgtcaacgacgcggaaaaggcgctccggcgcgcggcttgaggaagagatagcgtcgccgaacgatatgagctgcagagcctgggtacgcacggcggcgatgaaggcaagatcgccgaagggggcgaggccgtcgaaaacgcggtcacataggcggcgctcactgggaatcagtatgcgaaacaccatgttgaacgccgggatccagcgggcgatgtcgaactcaagctcctcccagggtgaggcatgaacctcctcggcggtgcgggaacggacgccgaggcgcgcaacgctctcgtcgacgaagccgcggcgcgccgcggcgtaggcctcagcgcactcgcggccaaagccggcgtccaccatcctcctggcgatctggtgcacgttggcgatggaccccggagagagagcatcgatcacgacgtcgtagtccgtcaccggcttggcgatcgggataggctcgtcgccgtagttgttcccacctccgaagtcctcctcgtcgtcgtcgctcccgtccgacccgaacccacccggcaccacgggggcggcggcgtcggggcgctctatgagctccctgaactcatcctccagacgcgccatgcaccggctgagcagctcgtcggagcggtcgagcaaggcgcggttggtccccgcggcgtccagctcctgcacggtgccgatgaggtcgtcgaccgcctccaggaacgcgtccgcgtcggcggagtccgcccaaatcagccgatccatggccacgaactgcgagatctggcggtccagcgcgcgcacggtccgctccatcgacgtgaccagcggcctcggcccagcggccgacaccgccgccgcgggaggcgggggcagcggcggtgacgtcggcatcgagcgctcccctacgattcctccccctcctcctcctcctcctcctccgccaccaccggacgcagcggccgccgccgccgcgcgcgcggcgtagagcttgtcgagcgagaggcggccgtcgtagttggagaagaccttgaggatgtcccctcgtgccgaatt

SEQ ID NO: 24049 - DNA, 1955 bp, Zea mays
gggtaccgggcccccccttttgcttgaaataaatattgatctccacgcataacataatggggttaaattaaagtagtgcttgaaacagagatggaatcctaatactgttacaaaataatcatgctattcattgatacagatacactacacgcatatacaacatttgccgaactgcataacttcctcatggatgacaaaaacagcaatgcacagttgtaatttgagacaacagcatcaccttacgtgagtacaagaaattaaccacgaataggagaatccatgacagcatcttcacaagttcagaagagcagaagctgcagtatagcaggctacaaggctacatatcctttatcactttgctgctccttcaaacaagtgctggatatgggctacaacatcctctggagtgtatttgatgtacaaatcccgcccagtttcaggagaagacttcaacttggcaattaaagaggcgtaaactggcatcactgtctcctccactgctgccctaatgtccacccttagctggtcatctgctatcacccattccgactgcgctgcgtatatctcctcaaagtacgtactaaacattcgcattttctgcagcattgccttagctgggagtccaccaatgcctggactaccagtctgcagcacagttgtaaccttgccccatgttgtccgctgataatccatgctccatcggcgaactttagttgtcatctgcttgatccactcattaccgagaaaaacacccaactcactgtcattcaccttctgtatgatgtacttgccattattcatcaagaagatagaagcaagagatggatcacggtatatcctagactttgtatccaaattcttttgaagaacatccatgatccatgcgatgtgcacagcaagggatgatgtggggcgatcagggtcaacagccacaggcgcacctctattaacaccaaagtcaccttccatcacctcttccaatgtctgccgcgacccacacgcagcacggagatagttcataacataccgagtgataggatgtatggcaccaccttgggcagcaactcgggcagggtcacggcggatgagattttccaactccataaatatacctttgatagaggaccccagtgtgttgcacatggcggagacctccgcatggagtgcagcagagtatgggtcagagaacacaggatcaaggtcagggagaatgtcacgcacagcctcgtacatgtcaacgacgcggaagaggcgctccggcgagcggcttgaggaagagatagcgtcaccgaacgatatgagctgcagagcctgggtacgcacggcggcgatgaaggcgagatcgccgaagggggcgaggccgtcgaaaacgcggtcacataggcggcgctcactgggaatcaggatgcgaaacatcatgttgaaggccgggatccagcgggcgatgtcgaactcaagctcctcccagggtgaggcgtgaacctcctcggcggtgcgggagcggacgccgaggcgcgcaacgctttcgtcgacaaccccgcccgccgccgcggccccggcctcagcgcactcgcggccaaaaccggcgtccaccatcctcctggcgatctggtggacgttggcgatggaccccggcgagagagcatcgatcacgacgtcatagtccgtcaccggcttggcgatggggatcggctcgtcgccgtagccgtagccgtccccggccccgaagtcatcgtcttcgtcgtcgctcccgtccgacccgaacccgcccggcaccgcgggggcggcggcgtcggggcgctctatgagcgccctgaactcgtcctccagccgcgccatgcaccggctgagcagctcgtcggcgcggtcgagcagggcgcggttggtccccgcggcgtccagctcctggacggtgccgatgagatcgtcgaccgcctccaggaaagcgtccgcgt

SEQ ID NO: 24050 - DNA, 2366 bp, Zea mays
ggaaaatacggcaggagatttgccgtgttatattatttccagagacaacaggtaaggtacatgtacagcactacaggcccaaaatgaagagaaaaaaaatcccagaccgttgaaaccgaacctaaagaacatcaatcaaacaaacaatacagcagcagaaacaacctgccgcacgacatggaaacaaggactcaacacccactgtggacaaagaacaaatgcatcgatcatgttcaagcagacaacacggtctggacgaactgaatagcttcagttctggccgcttttttttttttttttctgcttcacccaatccttatttattcttcgggggcatgtttggttacaacaatccagaaagagatagaggggattaaatctcctcctagtcaaaaataattagaaggggatttaaacctcctcctagtcaaaaataactagaaggggatttaaacctcttcaatccccttctggattcatgtatcagggaaaagaaccgcatccggctactcatgttgaagcagacaacacggtctggacgaactcccggggccgacagactgccgccaacggcttggccatgggcatggacagcccaacgccttcggccatgtcaacacacccaccgacctcccagtcgaagcactgcaggagagccgccagagtcaagctgaggagacgcaaggccatcccttccccagggcagcgcctccgtccaagcccgaacggcagcaagggggcggcgaccgtggcagtggcgtccaggaaccgctccggcctgaactcctcgggggcctcccacagcctggggtcccggtggatgagccaggcgttcaccaggaccatggtgccgcgccggacgcggaacccgcccacggcgcagtcctccatggcctcgtgcgccgggatgactgggccgacggggcagagccgcagggtctctttcaccacgcattgcaggtacgggaggtgagtcgtgtccgactcgtctaccagccgggatgtgccgacgttggcgtctatctcggctctcgccttctgcattgcgtcccggtgcatcagcagctgcgccattgcccactccattgtcagcgccgtcgtgtctgtgcccgcactgagcagtatctgtagcagcagacgcatcgtcgtcgtcaccatcgttgagattgcaacacaaggatgctcgattcacacgagagactactcactcaccgagacaatgcctttgatgacagtgtcggtgtagtagccaggatcagtttcctgcagcgacaggagctcgtcaatggtgctcctcttctccgtgtctgttgggccaccgccaccaccaccgacagctttgcgattgcggcttcggcgtccgtcgtgaacgaggccggcgacgaatgcgtcgcgtctcgcctggagacggagcagggccgcgtcgaccccgcgcagacggtccacccaccgcagcgccgggtagaagtccccgacgctcatgacgccggtcaccgcgaaggtctcctcgatgatctcctggaggccgcgcacgtcgccgccgccgtggccgggcgcgccggtgagcgcgcgcagcatcacgttcagcaccagctcgaagagcctgggccggagcgccaccgcggcgccggcgcggggggcgtcgcggaccagggcgccgacgagcgcggcgacctcggcgcgccggtcggcggcgcgcgcggcgaggcgggacgcggcgaacagctcgacggccatgaaccggcggagggcgcgccagtggtcgccgtgcgaggaccagcccaccgtggtgtacccgtagttgagcctgtccccgaccagcagccgcggccggccgcccagcgcggcgtcgtgcgccgtgaagcactcctcggccgcggcgtgctccgacaccagcagcgcgcgccgcgcgcccaggcgcagcgacaggagcggcgccggggcgcccccggtgccgcgcgcgatggccagcgccgccagcgagtggtgcagcggcttgccgttgccgagcaggtggaggtggcccagcagcggtagcgacggcgggctcggcgcttcgccctgacgacgatgcctgctccagaaagtggcagtgatgagcagggagatagctacggcggcaaggaggagtacggcgtcgctggccgccactgcatccatggctggcactggcagcagcgtggcttttgcaggcgccgccacgtatggagcagattacaccagggtcgtggccgccgacggcggacggcccgagggtggcgccgcagctgggagaaggaggaaggtgagggaagaagaggtgtattatctgattaaaaaaagggatgtcagactaaagtagacacgtcgcacacatgaacactttg

SEQ ID NO: 24051 - DNA, 711 bp, Zea mays
gggaaggtacatgtgttatattatttcaagagacaacaggtaaggtacatgtacagcactacagcccaaaatgaagaaaaaaaaaatcccagaccgttgaaaccgaacctaaagaacatcaatcaaacaaacaatacagcagcagaaacaacctgcgcacgacatggaaacaaggactcaatacccattgtagacaaagaacaaatgcatcgatcatgttgaagcagacaacacggtctggacgaagtgaatagcttcagttctgcgtgactgaatatcttcagttctgcgtcacccaatccttatttattcttcaggggaaaaagaaccgcatccggctactcatgttgaagcagacaacacggtctggacgaactcccggggccgacagactgccgccaacggcttggccatgggcatggacagcccaacgccttcggccatgtcaacacacccaccgacctcccagtcgaagcactgcaggagagccgccagagtcaagctgaggagacgcaaggccatcccttccccagggcagcgcctccgtccaagcccgaacggcagcaagggggcggcgaccgtggcagtggcgtccaggaaccgctccggcctgaactcctcgggggcctcccacagcctggggtccccggtggatgagccaggcgttcaccaggaccatggtgccgccccggtcgccgtccccggcctccc

SEQ ID NO: 24052 - DNA, 2497 bp, Zea mays
  misc_feature (3)..(40): n is a, c, g, or t
ccnnnnnnnnnnnnnnnnnnnnnnnnnnnnnnnnnnnnnnttttttttttttttttttatgaatttaattagttttgtctaaattataattattaaaatggaattcaatgccggcgattccttcggggcctcaacgtaagcatgattagttagatcatgctcatgatgagctgtttagcatggtgatttatatctggattagtgcaacggtggtgatacaaaccaggatcactaaatatttaggagttgcttagagcaattacagctaataagcaaggtgtcaaagcaactggatagaagggctcaggatgggggagggggactagcagcgactgagaatggcaagtaaaataagctgtaagcctcagctacttccatgtaccacattgcttcacgatctggctgagaagagaggtccaccatcttatgcaccttgatagatggataattgtccctggactctgctgcaatgtatgcaccaataaccattacatacatccctggccgccagaaccggccctctgcttctcttggcaagacgaaaaggttggcgacgcaggacccatcatccagcaacaagcgccctccaccggattcgttgtagtccgttgacaggatcataccctggacccaggcgcgctggaagcggatgccggagagcatctgcgcggcagagcaaccctcagagcacggcgcctcggtgcaaccggcgagctgggagccgaagatcttcagcgccgcaagggtatagtccatggccaccggtcaccggacagccggtcgccgccgcagggtttcgggtgacactgggtcaccaatcttgcgaatgttccgtggttcgtgtgtccagaactgtgtttgggtgggaccgctctcgggccgtaaattcgccatttccttttctttcttttactagactggatcacgtaggcccatcaagaggaactcgctttgagtctgagtagatggggctgcctgaacacgggaatgccggaatctctaatgcgcatccgcacggagcctgccctcagttcaggccttcagggttccccttctgcagcgccctcgaaactcgaaagcgtcctgtagttcaagctccgccggccaatactcaggtactcgctaatctccgccggtcacgtcgcaatggcgccaggcgctccgcgagagtatgccctcgaggggggcgaagcggcgcaggacgaagcgcccgagtcaccgcaggaacgggaagaagcgagtcagagagaagaggatggcggcgtcgaggaggccgacgacgacgaggaagctcccactcacctcccgttcgcgccatcttccgaggtgcgtggccctcttccttatgtctactgctcacatcccagtcccaccacttctgatgtcgccttggagtctccgcctcactgccattccttcgagcagttggcgtcttggaaggaagtgtttggctggttgtctgctgccctgctgatgctagatctcatgcttgtgattttctgtagctgcttgatgacacgacaacagttgatcccagctacactatctcccttatacggcagctactaccccagggttccaatgtggagaaagagttcaggtaagcgacgtgtttagaggttgaaattgtatgttagcaaacgagatgactccatgatactaaacagtgtgaagcaatgtgccccggacgagaaggatgcaaattctggtaatggggaatcagccgcacctgattataaggatccatgggaagagtgtggttgcattctgtgggaccttgcagctagtaaaccacaagcagaactgatggtgtgttatcagtatcttcttactctattttacaatgtagattgctatgctatagtgctatacccagctttctagctcatatatgctttctttgcaaaagaaaaggtgtagaaaaaaacaaagaccttgcactaagatttcaatataagtatcgtatggctgtttgggattttaatatataatgttgtattgttgttagatcgttgcacaaaacttgagaaatcaaatgtccttttaagtaacgtagctacttcagactccttttctttgccccaagggaatgatgaggtgagttcatattacctcttaatactcattagtggaggtagatgaagtccttgggtgtgagctaagtccatgtgttctacaaatttagcagatgctcttgcgagctatataaattataaataccaggagaatatgctttaaagttggaactattttgtccaaaagaaaagttgaaactctacaaaatgaaaatacttatattttcagaaaatgctggtattgaccaacatttgaataacaagagttgcaccttgtccaatagatagctggtactgttgaaagttatccaccatacattattcttccacatcaatctagttgaatggttttaataaatattctactcatgcatacatctagccatttttatagtaataatattcaatttttaaaactgcag

SEQ ID NO: 24053 - DNA, 2142 bp, Zea mays
gttccccttctgcagcgccctcgaaactcgaaagcgtcctgtagttcaagctccgccggccaatactcaggtactcgctaatctccgccggtcacgtcgcaatggcgccaggcgctccgcgagagtatgccctcgaggggggcgaagcggcgcaggacgaagcgcccgagtcaccgcaggaacgggaagaagcgagtcagagagaagaggatggcggcgtcgaggaggccgacgacgacgaggaagctcccactcacctcccgttcgcgccatcttccgagctgcttgatgacacgacaacagttgatcccagctacactatctcccttatacggcagctactaccccagggttccaatgtggagaaagagttcagtgtgaagcaatgtgccccggacgagaaggatgcaaattctggtaatggggaatcagcgcaacctgattataaggatccatgggaagagtgtggttgcattctgtgggaccttgcagctagtaaaccacaagcagaactgatgatgaacaatcttgtgcttgaagtgcttttggcaaatctccatgtgactcaatcctctagagtaaaggaaatctgtcttggaatcctgggaaacctagcctgtcatgaatctctagtaaatgttatcagcctgcacaatggtttgactgctacggttatggatcagctatttctagacgactctgcttgcctttctgaagtattcaggtttttggctgctgttttacgtaccagtgtgtctgtttcttgggctgaagctcttttacctgatgaaattctttcacgtgttctgtggatagttggaaacactctgaactctacattgcttgagaaggttatagactttctgtcaactatcatcgataatcaagatgtgaccaccattcttcttcagccattgataaaagtgggtttgatcaaccatactatcagtttgttagcaagtgagattgagaagctatcaaatgagggtaaattagacaggtcagattcccttgatttgatccttaatttcgttgaagaattatctgccatagacagctgttcaggagttatgtcagaaagtaatcagctgattcaagtgcttgaaagcatagttaagttacctgataaatttgaggttacaacctattgtgcttctgtggttatcgtattagcaaatattttggcagatggaaagcatattgtgcctaggctctctcatgatttacccttcatggagggcctctttgacattcttgcactggtctctgatgataaccaagcccggaacgctctctggtgtatcttaccatgtttgctggcacaagcacaacagatggatatgaactcttcatctctcgagcagtttgtatctctattgcttggcaggttcacacacattaaagatgatcttgaaagccacagagttgacaaaaaagagttgacagctgaggacgcttacttgaagcatggcgtatccgcatctctcagggcgatctgctgtgtcatggagaggtggatcgtggagaagtcctccctgggcgaagacgaagacgacgccccaccgactgaaagcaccgttgaagatgctagacatcttctgaactactgccagaattatgacctgtagcttgcttactacaactttagtggacatagctgacctgtgagtgtgcggttgcaacccgcggctgcctaaccgtagaaagtcgtttaaatactaatgttgctgtagaggacaacactgctacggagtactcagttgccatagaggacaacaggctctatatgtcaatttgcatttctgttgcctccagcgtgagatataggggttatattttgcagctcccatagtcccatatggtcatatggatgctgataaatggatgaacggtggcaaaaaaaaaaaaaaaaaactcaaaggggggcccggaacccaattccccaaaagggacccgatacattcccggggccgccgtttaacaggtcggactgggaaaccggggggtacccaaataaacccctggaaaaatccccctttcccaggtgtgggaaaacgaaaaggccccaccgattccccttccaaagttggccacctgaatgggaagggaaattgaagcgttaaatttggaaaatcccgaaaa

SEQ ID NO: 24054 - DNA, 1212 bp, Zea mays
ttttttttttttttttttattgtcattatttgattgatgtcttccaactggtgaatgaacagtacatacagacataattgctccagaaatctctttgagattggatggatgctctttaattatgagcaacgtttttacaatgaataagatgcgaatacatcaagttaatatcattatttgatgtcatccaacttatgaatgaataaatagtgcaagaggttgacgaccctgcttgacgacaaggcgagtctgaagaaattcctagtcatggctacttgttgatgatacatcgatacaggccgggatgtgattgtgaaatgtgtctcagaattcagggcgatgagcgcctctctgttagcttctccctcctgtacttgttgaaatctgctgcaagtcctgtgtccatgtcctgcttcatctgctccgccatctgcctcagcaccgtctcgccgacgcctctgatgatgctcgccgggaccaaggcgagcaccggcgggaggtcgaagccgacggtcatctcgacgtggcccttgaggctcttcctcccctcccgctgccgctgcgggtacatgaggcctcggacggtgagggccaggtgcgacggcatggcgttgctgtccagaccattcagcttgtagtctgtcacttccatgaggaggaggctggtggcgtggacggggacgttgggcgggtactccttcccgccggacttgctgacgaagcgcatgacgatgaccggcgacgccgacaggaacaggaaccggatgggcaggagctgcacgctccattcttcgtcgttgatcttccttctcttgcgctggtccggaaacaccgctccgacgatcctgggactgttccgcaggtactcatcgatggacgccccttgcgtttcgctcatcgggatgtcggtgctgaacttgtgggagaaggtgaagaggtccctggggttgaccttccccctcgatccgccattcgagggcgtcttgagagcgcacgcagcggtgagcgacgacggccttgatcttgagcttgatcggagtgggtgcgtgctactgctccctcctgatgatccagcacccctacacactggatggactgcgggacggcatggaggaaggcgtagcattgacgacgacgacgacgacatgtctaacctgctgcaaatgcaacggcaatttcccggagtctgtggcgttccttccccccggccgg

SEQ ID NO: 24055 - DNA, 1075 bp, Zea mays
aattcggcacgaggctcgctcctgtctattacgccgccgcgaccgcgcctcgccgcctcgcaccgccgggcggtcgtggccgcggccgcgtcgccccgtcccccgccgacaccggagggcgacggcgacgagcaggaggtggagagggcgatggggatggacggtggcatccccgggacctcgggggagtttctgcgccgcgtctcctcccgcgcttacggcatgcggcgccacctcatggagtcgctcgactccctcgcctacgacgtactggagacaaacccatggagagaagattccaagccagtctatgtgctagccacaagcgataaccacctatggacaatgaaaactcgcaggagccgcaatgaagtcgaaagggaacttggaaagcttttctcaaacggagggggttctggagttggaactaaatcgaagtactctggcaccaagtttaacatggttgtcgaagatatcagagagggagtactggtatttgaggatgaggatgatgctgtaaaatactgcaaccttctgcagggcggtggccaagggtgcgagggaattgcggagatagaagcatcatcagttttcagcatgtgccgtaaaatgaaagcccttgctgttcttttccgccgcggaaagactcctccattgcctcaaagcctcgagcgcgacttgagggcgagaaagaggtcactggaggactagtgctgtctgtttacgctgcatagaagtgttaattgtactcatctagctgttggaagcatgggccctaggccttgtatacatcatagtagtacatagcagtccctagctgaactggaaccgagcctgacagaaaacacagacataattgctcgaggccagaaatctctttgaaattggatggatgttcttgtaattatgagcaacatgtttacaatgaataaaatgcgatacatcaagttaaaaaaaataaaaataaaaaaaaaattaaaccataaaaaaaaaaaaaaatttaaaatattataaaaataataaattcccaaaaactaaaatatcattttttcaagggggggccgttttgaaggat

SEQ ID NO: 24056 - DNA, 2956 bp, Zea mays
ttttttttttttttttccgaactatccgactcgtgcaaaatcatcaaaaaccgggtttgctgaaactagacgctgacatggcatgctggagcctccctaagatagctctctcactaaaatatagtagattgatttttttcttgtgtttaagaggaggatgttccactaatttataggcgagtagaactcacacaaaaagaagtagcgaagagtgacaataaagaagctatttaagttgtttctcttccattatcaattatcaatgtgatactaataaatagaccttagctcataaactccaacgatatatttgccagagaattaagtaaaccaaaatgctgtccacattctattccttattgcatcggacatataacatgcagttcattattcagagcgccatcgtcatgctgaaaccagaaagctgatcaaacatcacagcgagcaaatgtagtccaccagaccgtcgagagccaaactaattcctcctccttctgcaacgcactgcttcgcctgcgccttaagaagccgagccctctcccttggcccctgtggccccagctcgccggccatcagctttctagccgccttcgccatggctgtcctctcaagcggcttcccgacctcgtacccgatgccccactggtgcgtcacatacctcgcgttcactatctgctcggcgaagcacggctgcacgagcatgggcaccccttcggatatggcctccaccatggatttccacccgcagtgcgtccagaacccacccaccgccgggtgcgccaggacctccctctgcggtgcccacgccacgatcttgcccctgtgcctcaccgtctcgcggagctcctccgggaccggcggcacctcctcatccgcgccgcggacggagccgcggcggaggacccacaggaacggcacgccgctgccggccagcgcccacgccgtctcctcgaacacggcgcggtcgacgcgcgccacgcttcccatgctgacgtacagaacggagcgcggcgggcgcgcgtccagccacgccaagcaggtggggtccggcgcgtcctggtaccccgcggccgccgccgccgcggggtccggcgacgccaggtgcagcggccccacggcgaagaccgggcggccggacagctcgcgccggatcttggccagcgccgcgccctcgatgccctcgaacgtgttcagcaccacgcccgacgacgaggcccgcacggcctcggcgttgcgggtgatgaaacggagcaccgtctcgtcgtcgctgccgtccacgcggatcaggtcccgcacgcgcaggggctccaggcccggcaccacctcgtccagccgctcttctgcatgcaagacaagaaaaaacgagtaaccggtcggtgccgtgccggtggcacaagatcgtcacgcggagaaggggaggagaagagggtggtggatcgagtgcctttgatggggaggtaaccgtcggcgcggaggcgcggggtggcgagcatgctgagtaaggtggcggcgccgtcggcgcgcagcacgagcgcggggacagcgacacgcgtggccgcgcccagcatcttgtaccactgcccgtcgaccaccacgcaggcgacctcgcgcgggccaccggttgttgtaccgcgcgccagcagctccccggcgagggccgcctggaacggcgcctcgcagacggcgttgagctgcatcatctgctctaccatgtcggggttggcgacgacctcggcggggagggactcgcggatggacacgaaggtgatgtccgggtggagtgcggggtcgggcgcgttgaagtcggtgtggagcatggtgacgcccaggccccgcgcacggaggagcttcccgagctggagcatctggttaatgtggctccagaacgggaaggggaacatcacgacgcggaggccggagggagcacgtccgtcgtcgccggccatcggtgctgggtggtgctggtgtggtggattcaggctgtggatgctgcctgcgctgcgcctgcctgaggattgaaaaagatttttcgattaggatgttctaggtaatggtctcgtgccagcctgacgagacacgaggcatgtgaagaggaggttgcttgtgccttgtgtgctgtcgacctgtcgttaccttgcaaagtaaacagaaagggagtcgcaccaaaactctctgcaaactgcataggcaacgcatttgtcttgtttggatttgttacggcgacatgacaagcgagaacgctcggtaacgaacagaaagattctccgaacgttctcctactctcctacccaggcccaggagaacaagaggctatcctacctagcccatgaacatgacggcagcaggagcaagcccactaagagagtgtttaaatacactaaagctaatgaatactgtggaaattttaatcctttttaatattatttctagaataaatactatggaaattttatttttgaaactagctcatttagccacactaagagggtgtttaaatgcactaaagctaatgatcatttagctaaaatttgctagctaacaaatagagaagaacttgattcatgaactagcccttaggaaggaaataagaaaatatatccacttaccaagtagcccttagttgatttttttattttctatgctaaaggctagtttatggctaagagcatcttcacccctggccagagatctctagatggagacaaacaaggaattgtgtggaaaaaggaaatagggtcgaagaaggaacataaacgaaaaaattaaggtcgattcgaagaagggacgaagacgaagaagaaaccgagacaaaaaagaaactttatttttttatttatactgaaaaatatgtactactcttattgtatttaataaagtgtcttaactttaagaagaaaaaaggaactacctatacatttagtcatatgttccattagaaaggacttatacatttgtg

SEQ ID NO: 24057 - DNA, 1709 bp, Zea mays
tttttttttttttttggggcgccgccccccccctctttttttttttttttttttttttaaaccaaaatgctgtccacattctattccttattgcatcggacatataacatgcagttcattattcagagcgtcatcgtcatgctgaaaccagaaagctgatcaaacatcagagcgagcaaatgtagtccaccagaccgtcgagagccaaactaattcctcctccttctgcaacgcactgcttcgcctgcgccttaagaagccgagccctctcccttggcccctgtggccccagctcgccggccatcagctttctagccgccttcgccatggctgtcctctcaagcggcttcccgacctcgtacccgatgccccactggtgcgtcacatacctcgcgttcactatctgctcggcgaagcacggctgcacgagcatgggcaccccttcggatatggcctccaccatggatttccacccgcagtgcgtccagaacccacccaccgccgggtgcgccaggacctccctctgcggtgcccacgccacgatcttgcccctgtgcctcaccgtctcgcggagctcctccgggaccggcggcacatcctcctcatccgcgtccgcgccgcggacggagccgcggcggaggacccacaggaacggcacgccgctgccggccagcgcccacgccgtctcctcgaacacggcgcggtcgacgcgcgccacgctgcccatgctgacgtacagaacggagcgcggcgggcgcgcgtccagccacgccaagcaggtggggtccggcgcgtcctggtacccggcggccgccgccgccgcggggtccggcgacgccaggtgcagcggccccacggcgaagaccgggcggccggacagctcgcgccggatcttggccagcgccgcgccctcgatgccctcgaacgtgttcagcaccacgcccgacgacgaggcctgcacggcctcggcgttgcgggtgatgaaacggagcaccgtctcgtcgtcgctgccgtccacgcggatcaggtcccgcacgcgcaggggctccaggcccggcaccacctcgtccagccgctcttctttgatggggaggtagccgtcggcgcggaggcgcggggtggcgagcatgctgagaaacgtggcggcgccgtcggcgcgcagcacgagcgcggggacagcgacacgcgtggccgcgcccagcatcttgtaccactgcccgtcgaccaccacgcaggcgacctcgcgcgggccaccggttgttgtaccgcgcgccagcagctccccggcgagggccgcctggaacggcgcctcgcagacggcgttgagctgcatcatctgctctaccatgtcggggttggcgacgacctcggcggggagggactcgcggatggacacgaaggtgatgtccgggtggagtgcggggtcgggcgcgttgaagtcggtgtggagcatggtgacgcccaggccccgcgcacggaggagcttcccgagctggagcatctggttaatgtggctccagaacgggaaggggaacatcacgacgcggaggccggagggagcacgtccgtcgtcgccggccatcggtgctgggtggtgctggtgtggtggattcaggctgtggacgctgcctgcgctcctcctgccgcaggattgaaaaagatgggggtgtcggctgaagacactgctacattggcatgcaacgtcgtgc

SEQ ID NO: 24058 - DNA, 5169 bp, Zea mays
ttttttttttttttttttttttgaccgttcgattatcatatttatggtagaggagcctttacacgctctgttggagagagcctctcgctaagcattagcattcagtgttaccccagtaaaggtctgtttgtgaacaaatggaagggagaagattcgagggttataatttcttactatttaaaaatatataataagagattttagaccaatcaatctcctaaatgtcggacgaacgagcgcggcggccattggtttcacttgcaggcgtgcagctgcttgcttttatcagagctcggtgtgcaggacggcgtcgtccttcccctgctcctcgtcgtcgtcgtcgtggtggtggtggccatcaggcgtgccgccgcaggtgctgctacggaggcagtcggcggcgggctggacgcggccgtagtcgaggccgacggcgcagttgcacaccgtctgcacctcgccgtcatcgtcggcgcggcgcaggttgatgttgctgagaacgatgccggtgcacggcacggcgtcgctgcaggcgaaccggatggcctcggcgcggcgcgacgtgccgctgatgttgcggtaggacacgtcggacacggccacggcggaggtctggttggcgcaggcgccgcctccgccgccgtccctctgccggcgggtcacgtcgcagtagaactggtcgatgacgatggggtggtcgacgccgtccacggccacgtcggcgaagcgcacgccgcggacgtacccggccccgccctgccacgtcttgatccgcaccccgttctgcgcgcggctgatccgcgccctgtccagcgccacgtccgccacagccgcgaacgcgccgcccttgccgaggctcccgatgctgcaagcgtcgtacgccgtcgccatggccataagtgaagcgcacagctcgcgttgcgaccgcgtcgcgtgaacagggtcgaggaatggaaggggaagagctagctgagcgcctgagctcacctgatgccgtgcccgggcccgcagtcgatgtcccgcatcttgacgccgaagctgccgttgacgatggagatgcagtcgtcgccggtgccgacgcggcagctctggatggtgaccgccgtggactcggccacgtggatgccgtccgtgttggggctgtcctcgggcgcgtcgatgcgcagcccggcgacgcgcacgccgcgtgagcgtgacaccgtcacgtgcatctgctgcgcgttctgcacgcggaggccccgcacgcgcacgccccggcacgagtcgatcgtcacggccctcggggccggcctgcacggctgcacgcacgcgaccggcgccgggcgagagagcggcgtgtgtgtcagtcagtcgtcaacggagcggtaccaattaaggagcagagcagtagtgtgggtgtgatcgaggcagagaaggcaaatgcaccggcggcgtacgtacgttggacctgttgatcttgcaggagctggcccaccacttggagccggagccgtcgatgacgccgccgccctggatgcgcgcgccggcgaggcccgagaagagcagccacagccgggggctccgcgggtcccactccgacggctcctcgggcgccacgaccgtgccctggatctgcaccatgcatccaaccaccgccgttctttacaatgcatatgcatgtgctacggctacggctcaggcattgagttgaactgaagcaacacgagtcacctggatgatcatcctcctgtccttgcagggacccacgaactggatggcgccgaccttgtagcgacggccggcgggcaccaggaacaccgcgttgtccagcgagcacgccgtcttccacgcgctcgcgaacgcctgataatcaagtgacgactgacgatgagagccagtcaagcagtcgccgccatggccatacattgcgtaattgcgttgcgttgccggcgtcatcggcatcaaccaaccacattgaggcagtctgtcaacccatccagacagacaatgcgagccacccacgcatatatatacacccatcatttcgtatctgtgagtgtcgatggccgaccggcaacgcgcacgcacctgggtgtcgtcggcgacgccgtcgcccgccgcgccgaagctgtcgacgttcaccacgttcctgcacgcgcccttccgctgcaccacgacggcgtggtcgtcctcctcctccccctcctcctcgtcgttgttgtcgtcgtcctcctcctcctcctcccactcccacctgaagaagcggtcttcttcgtccacggcttcaccacccctagccgaatccgccgacgaccacagcctcagaacctgctccgcccccgcctcaccgccggcaccactgccaccgcgctcgcccgcggccgcgaccagcaccaccagcgccaagagcagcgcgcacctcctcgccgccggcgccgcacccatcgcacgacaacgtacgtacggcccgacacggcgaacgcgtatgtatgtatgtacgtatgcctttgctcgcaagctccaggactgcaggctatatagatctagctagctctggcaggggagagcgggtttcggatgggagatgatgagtaccgtacgtgtgaggtggtggagacggatcgagtaggaggaagaaagaagagcagcagcagccagcaggaggaggaagaagaagaagccaggggaggaggaggacttgaagtgcaagtgaatgataaaaaaaacgagcgtgcgacagcgggaggtgtggtttatgctttactcatcctctgaaaaaagaaaaaccaaagggaagagccgcagctgcagcgtacagggcccctcccctattttgctctcctttttcccccttggcatacgtacattccccatcatttttcgtggcgtccatttgtgccgccgggacatggatgtatctgccggtacatgcgtaattatttcttgcaaggcaatgctaacagtgagtagtagtacgtagtaggtagacgaggcaacgggacgctatgacaggccgagcatgctgtgcgcatgctacatacacgcatcctttcaggattatcctcgtggcttctttcacgatgcaggcgtatgtcgtcgttccattacgagaatacgccgtgcggcatgcgcccggcgcggcccatgattgcgcgtccaccatgtgcctccattgccattgccgggtgcttggtgcctgcaactcagatccggccggccaccatttcttcttcttcttcacgtctgttctttctgacacaattccttccagatattttaaaaaaaaaaaaacaattttcctgcttggcacgcagcacgtaccttgcactcttcattttcggaaaccgacaaaaaaataaactaaggccgtgatctcttcagcctaagctgtatgtcgggcgcgcctaaacgattttttttttaaaaaaaaaatgttgctttgttacgctttaatgccaacagagcgagggccaaccttttcactagaaaaaaaaaagatttgcaatacgcaaacctgatcgtctcctttaccatctgaagaaatgccaactcaaggaaaagcacgctgacatgtacaccatctagtactagttactgtgtatacctccgccccgccaacttcgatcgatagcataggtccttgtcaggacatattgatctcctcctttaccatctgaagaagaaatcccaagtcaaggaaaaagtatgctgacatgtacaccatctactagtcactgtgtatacccccgccctgccccgccgatgatgattttggtcgacacgacgtccttgcatagcataggtccttgtcaggacatgttgatctccacgctgccgctcttggggaaccggcagacggggcacacgtcggagaccttgtcgcagtcggcgcacaggcagaggtggcggcacgccatcaccagcaccgacgcctccttcctgccgcaacacctgcaggcccccagcccgacggtagccgtgcccctgagaccacccagggcgtctcctccggcgtcggggctttggctggaggctacatcctcgctgtcgcccatgccttctctcgcgaggttggtgttctgcgccaccaattgcatcagcttgttcttcagggtgttcacgaccgactggttgtacatggccgctgactgccacgactgcacctccatggcgacctgcctcatctgctcgttcagctccttgctcttcctgttcaccgcctccacctccagttccttgtcccgcagcttcttccccaccgcctgattgacgctcgccaggaacgagaccatccaccgatggttcgcctccttcatccgcttgcagatttggtctgcctggagtctcaagtagaagttaatctctttgctttccttgtccagttcagccatgaaaccatcgacacaggacatcgtggcaggcaacgaggccatgctaccgctgccagatgtgatggacgaattgcgctcatcgtcctcgtaagacagccttagaccagtcgatacagcacccggattgccaacacgtgctaaccggccagcactctgttggtgatagtcgctcaatggcacctgaagcttcagcaagttctcattccctgcgccgatgtttgaagtacttgcttggttcataacaggaaggtgggtgtttccagtgtaatttatataaccagcaggaccaaccgtggggaccgcggcgcttccgaacagctgcagcgccgtggagttggcgctgaacaggaactggctttggttctggttctggttctggttctggttctggttcggatcctgcatggtgatggcggtggcggtggcggcgccggagaggtaggcgggcgccaagttgccgccacccatccggatcgcttccccgtccatcccactcctctcccaagaagaagccgaccgcagcagatcagacgccgaggcgccgcagccgacgccctccgatcgggggcaggaatccgcgccgttcgacgagaagccgaacccgcgacgatccgatcgcgcgctgcccggaaccgtcgccggactggggttgggttggattggactggggagcccggcggtgaaggtgcggcgttgggaattccgcgatttattgccggttcttgtgcgcgtgagctcggccgcctcaagtgcccgatgaagaaaaagttcaccccggccggcctcgaggtacccaatg

SEQ ID NO: 24059 - DNA, 1485 bp, Zea mays
ttttttttttttttagctacaacatttcccaggccaggtaaccctcatctagaacaaacaatgtcaacatttctcagccaactagggagcattcaagcccaagttggctgcttccattcgtacccacacaagatctattagacttgaacacatctggatcgactttttttttttttgtttcatcatgtataatttagcttccattcaaattctgagcatccttttcgtttcaaatatgcataaccagcatgctctccacacactgctgactgaacaagcacgacacacacacacacacacagctcgcgtggaaagggacacttccattcacatgggcttccacacgctgagcacctcctggaacatgtcgtgcatgagctcgcggtccgcgtggtggaagaagccgtgcatctcgtccctcacgtcatagatcttcccgaacacgaacaggtaggtgaggcaccctttcttcagccgctccagccggtacagccacgccacgtggagccgctccagcacgttgcccgagcctatgtcctccagcaggctctcctcgcagcagtccttgatgtcgccgatcccgtacttgtccgccgccgccagcagcggcagccggtgcttccagaactgcccctgctcgatcgtcccgtacacgaaacccagcagcgccgagcacgactccacgcacatgtcgccgatgtccaccgtcgacgactccttctccctcaggtcgtgcacgaacatgctcttgaacacgggggagcacgccgccagcaccgccttgtgcgccttcagcaccccgtccgtcgtgttgatggtcacgtccgcgtggatggagtccgccagcatgtgcgacaggcagcccagggcgctcttgctcgcgatcttctgcaccatgccttcgtttggccacaccgatgacgattccgtagcattgttcgtggctatcctcaggtctagaaactcaacatcaatcgtaaaacgcccatggggcatcgcatcgacttgccatacaaaatcatcgctggtacgcagaagatgctcgtgcacaggggagacgcaggagcgtcgcggcgggccggcccaggagacgcggagcaggaagcgcgcgagagggggctgctccttggccacccggccgggctccgggaagaggcgcacaacgatggagcggctcttctccaccgacaggtaccagttccagatgccgagcttaaaggggtccgaccggcggtaggagcaggggccgaaggtatcgatgcgccactgcgccagccgggagatggtctccacgcgggagtccggcccgcacgcacctccgggcccgccgccgctcatcgccggccacgagcagcagccactccagtccagggtgtggaggatttgacgacacaggcgaggagtcacctccacaaaaattgttccttttttccgttctatttgtgcaaaaactatttacgataagaatgtaaccgtcacttgatt

SEQ ID NO: 24060 - DNA, 1665 bp, Zea mays
tgttgattttacaggatcacctattcacccccttccctctctctagggtctcccaccactacaccattttgttgagttgtgtaggtagaagagaactcatgcttgataccctcctcaagaaatcctttaatttgtgagttcttgaactccgttccattatcgcttctattttttttatttttaatccgaacccattgtaagcccgtcgtaagaatctttttagtgtcttttaggtttgagatttttttctgcaaaaagaatacctaagtgaagcgagacggcttactcgcaaacgaaactaatttttttatgagttatacacaaaacaaatagtctatttaccaatggtctagcaggcaagacggcttactcgcaaaccaaactaattttttaatgagttatccacaaaacaaatagtctatttaccggtttggtttgcatccctacgcagatttgcgaacaatggatgacggaagtggtttgccaaaccatattactcatcatctcctgcatttcggaccggccatctggatgcatctctcttgcctggcataaaaagctttggcccaatgcttcttgagatacgcgcgtgacacatctcgcttttgagttgagagctcacattgtattctcttttactgctcaacaggcagctcactgatgctaacagttttttttctttcacgaccgtgcttgccgaagcacgtacttgaagtcccttcagggtaaattacacaacgggcaaaaaagagtgttttttttgagaacaattctgaacaagacgtcggatattacaaacgatctcgacaggtgcaggtctgtgagtagttcagtattcgcaacctctctgcaggggtgattaacatacatagggcacgcactaacacttgacggccccaaaaagggttaacctgcagagtgtggactttacaacgctgcatcagcagactagtacatcttcgcgtgtacatcttgagtccttctgagcacataccctagttgccccttacaaaacatcacaaagccaacaaaaagaaaccaacagaaagagggaaggaaaaaaaaaacctgctggaagggaccaagacgaccatcgggcaaccaccggtccctaggaacgtcgtgcaacgaaaaaatccagggctcagggaggccggcgccagtggcagcccccctggagaacaatagtcaggctcctcctaacattgcttgcgatcgcctgcctgtctgacacccgcgcgctactggcccttgctggcgagccgccgcttgtaccgcttcagcacggaggccaggttctccttccccttggggaaggcgacgtcgcccgccgccgtgccgctcctgcccttgcggcctgagaccgcagcctccacgtccttgatcatctccagaaccacgcctgcggtcgtgaaggcgccccggatcggtgtggggaccgggcccatggctgttagcccactgtggggtgggctattgcgcactctggtgtctttctgaaggcaggtgcatattgtcagagcaccccgaggcttggagaacgcagggtccaagatcccctgcacaaacacaaaatgaatcactgttaagtgaacagcacaaatccttcattctcgttttctataatatgataccgttttagaacgtttctgaatcacgcaaaaa

SEQ ID NO: 24061 - DNA, 1485 bp, Zea mays
aaaaaaaagtgtgtgttcttttctggacaagacgtcggatattacaaacgatctcgacaggtgcaagtttgtgagtattcgcaacctctctgcagggagggggtgattaacatacatagggcacgcactaacacttgacggccccaaaaagggttaacctgcagagtgtggactttacaacgctgcatctccttcgcgtgtacatcttgagtccttctgagcacataccctagttgccccttacaaaacatcacaacgccaacaaaaagaaaccaacagaaagagggaaggaaaaaaaaaacctgctggaagggaccaagacgaccatcgggcaaccaccggtccctaggaacgtcgtgcaacgaaaaaatccagggctcagggaggcctgcgccagcagcagccccccctggagaacaatagtcaggctcctcctaacattgcttgcgatcgcccgcccgtctgacaccggcgcgctactgtcccttgctggcgagccgccgcttgtaccgcttcagcacggaggccaggttctccttccccttggggaaggcgacgtcgcccgccgccgtgccgctcctgcccttgcggcctgagaccgcagcctccacgtccttgatcatctccagaaccacgcctgcggtcgtgaaggcgccccggatcggtgtggggaccgggcccatggctgttagcccactgtggggtgggctattgcgcactctggtgtctttctgaaggcaggtgcatatggtcagagcaccccgaggcttggagaacgcagggtccaagatcccctgaagacggttaaggacataggtatacttgccccaaagttctggcctgctttccaccagagacatgtccagcactcggcggacacaccagacaccgaaactaacgacgagtgacgcgcgccaaacacagtcctccccgcagttgggaagcgtgcgcatgtactggatgccggccggatcggaagaatgttgctggagatcaccaccatgaagcagcagttgattctcggcagtcccttgcatcaatagcttctcggctgcagcgactcggtcgattagatcttcatcacaaccaccattttgcttgaacagccaccctgatccctctagcttaaggagcttcatgatgcagagcctgagggactgaagaagcttcgtctcagattccttgtaagagaaatcatccttggccacaccacctgatctgcctggaagattgaagtcacctttactgagctctgcacttgacatgccgaacaattgctcaaatggttgcttagcccaaagggatctagcacttggtctcatgcttgactgcgccgagaagatatcactctggagcttaggaggtgaaagctcgtcaaatgctaatggagccgcgggcctggctgttgagcttgcatattgagatctttctgccgccagcctgctgaggtatgactgtggtccaatggcagcacccaactttgct

SEQ ID NO: 24062 - DNA, 4052 bp, Zea mays
ctttttacttgatttcacagctactttcagctttttttgtgctagataatttcataaatacggaaaaatcctgggccagtccttatgttttctatattgtaatgccacttcagattattgtccacccctaattgtaagcaagtattaaaaacaggacattatcgattgcaaaaaaaaatttgccctgccaaaaaaaaaagttaaactagttcaggaccataacaactcacctgaagacggttaaggacataggtatacttgccccaaagttctggcctgctttccaccagagacatgtccagcactcggcggacacaccagacaccgaaactaacgacgagtgacgcgcgccaaacacagtcctccccgcagttgggaagcgtgcgcatgtactggatgccagcctgatcggaagaatgttgctggagatcaccaccatgaagcagcagttgattctcggcagtcccttgcatcaatagcttctcggctgcagcgactcggtcgattagatcttcatcacaaccaccattttgcttgaacagccaccctgatccctctagcttaaggagcttcatgatgcagagcctgagggactgaagaagcttcgtctcagattccttataagagaaatcatccttggccacgccacctgatctgcctggaagattgaagtcacctttactgagctctgcacttgacatgccgaacaattgctcaaatggttgcttagcccaaagggatctagcacttggtctcatgcttgactgcgccgagaagatatcactctggagcttaggaggtgaaagctcgtcaaatgctaatggagccgcgggcctggctgttgagcttgcatattgagatctttctgccgccagcctgctgaggtatgactgtggtccaatggcagcacccaactttgcttcattcaagagtgcagctctacttgcagcgattattccagacatatcaggtgagctgtggtacttttttgagtaagcaggtgaaccagcgttttcattcccatcaacgctggaaggatcataatacgatctttcaggcatcattgagcctacgcgggatgttgcaggaagctgtgtagtagtaccacccagtgaagcaagcaggttatgattacgagcatgcatcatggaatcagcatagtttggcacagcagacacagatgattttggaagccgttgtgggtccagcggcatgctagagtaaaggcttgggctggcattcatctgtttcaggtaagatgtgagctggtatccatgaattgttgcaggttggtagaactgattgttgtctgaataagatgaactaaaatttgagtttaatcttgcactctgctcaagtaggctattgcttgagctctgcagctgtgtatttggtagctgcataccctgagaccagcttgacaatcccatgccaggtcccctctgaagcccatatgcaagttccaaattcgacgtttcattcttaggggacatcatgtccactgagcttgacaaaaaagctgccccccgcattgagtctctcaccagtgggctcttaagtatttcagcagcttgtttatccgttcttacagatgtgctaggtgttctaaggtctatcccaagcaagataccaaactttttggtgctagcttcttgagtgagcttaccatggtaatcaaacagatgcccccagaactcatcaagagtagcagctagctgtctccttgctgcacggcccaaaccagataaccttgagagactaccactgccatttcctgcatctgagccctttcccctgctgaaagtaagggatggcggaccgtcatcagacacatatggggtgctatcaacaattgacttctcagactccaaagtacggatatcttccttatccttgcccgagacaacatctgtttctactaaaacatctctttcagtcgtgatcctagagaccacattttctactgtgctttcctccatcacagtagaagtaggaaccttctccaaaggctccggccagttgactgcaacaactgattttgactcctcgcgagtaaacgacggggaggagcaggtttcaggagcagtggatgcataagcagtagattgttgagagtcgtgatcagattctacagcagtgtcagaagtatcaatatagtccaaggccagttccggatggctgtcaggcacatccctgggagaagggacaacatctgatctttgatcttcctcatatgtaacattgtccaccttaacatcttctctttcttgagaagtattcaagagttctctctgagaatgcacagaccattcatgggattcagcttcatgacttccagatctcaatggtgtaacagccaggtacagtgaaaaagccacagatataagtgcaactaaaactaaaacagtatatgggagcaccacagggcttccagtatatcctttcagattgttcatccagccactgtcgccaaatagcatttctgccacaaatatgatatttgaaaatagcataaggagaaatgcaagaaaaaccagtatctccagatgcaaagacactctatggcctcccattattgatcttgatgaagcaacacgaaaaagtgggacgactgaagatggaagaagcatggcctgaataatctggcatataattaataattggtatatcccttcagctcctgcaactttcgcccagtacagagtaggaactatggcaaaaaccttcagtaggagacgatgtccagaaagaggaaggtttataccgaataaatggtgtgaaatcacttggctaccgatagcagatgtcagcgagatgatgtggctggagaagagaagaaccactaaaaatatagttggtgccagagggtttacaaatatctgcgaagtactcaaaagttcagttttctatagcggagcaggatatcttcctaaataaaaatattcggcagaaacttagcacagagaataaacaactaggaaatttagctgcttacctgattcattagctctacaacatcttggaaggtaatgagaagagtattagtagattccgctgctgcagagttcattagaacatagttcaccataaagattccagtaaaaatgaacaatattgaaaaaaggtggtcgtgaaataaggctccatgcccgcctgcagatgactttttctgaccctgcaaatacaatgtttcttgattaaaaaacacgcagaaactgatgacaattcagtgaaaacaaacgactgcaaagtacgcaaactgtcactacttgcattttttgcacatgtcaatattttccaatgaacatgatgtgaaaagttagaaatggtacaattttgatgttttgtgatatgctacaaacccaaacataagacacaaaatttcatgaactaaacaaaaaattccaaaagctgagcacaatgtgtacagataaacaaagtgtggatcctgcggtggaaacttgtatgaagttatccaaacaattgaaacgcgattaattacatcttgttttatttcgatgtggtgtacccacaaatcatcaaaataataaaggaaataaatataattttcaaattgtatccaatattcaactggcatgaacagaagttcaaatataatgatctcgctcactcttaggactttacaaactccatacaacaagctaaaattgaaataaatgtaaatgtatggtttgaagtatttctggcaaggcgttgcccactaaattttaagtccaagggcactaatcaaacaatttacctggacaactgatgaatgaatgtagaagttgtgtgccattatgtttgcaccaagaagcgccatcagagagtaagcactctcacccactgatcttggggaatattacattcatcgtgagaggaatttgtggctggctaaccaataagccaagcacataactaagaagtgcaaatcctgctatgcaggcatttattgtcccttccatcttctttccctagagcagacataaagggtaagtaactagcaaacataaagtcacattagtgtatcagcatctgttcaagtatctttc

SEQ ID NO: 24063 - DNA, 7890 bp, Zea mays
  misc_feature (187)..(187): n is a, c, g, or t
ttttttttttttttttgtctacaaaacacacatattattaattccacacaatacataataatgtgtcctagcattacacataatatcaagtttaaggcttccacaaaatctgcatgttcaagcaaaatccgctgacatacttagacgacatttcattgtttgatgtagttcaagcaaaagaaccgtnccaagcctatctactaactgccctcacactcctggttacacatagatcgcagttcattgttcaatgtggttcaagcaaaagaaccctccaagcctacctaccaactgccctcacactcctaggaacttttcactgacgaaattgcgagcccagattaacttgtggtcgaatggcaacttgttgaaggctctagcaatgtgagggtgcgccaccagataattgaaatacagagatatgtgggtctgctcaaaacctgcaaagtttagcaaattgtcaaaaacaatatatgctggtaagtggtaactagagttacaaccagatttagtggctgcattgtgtaggtactatcaaagatcaatagagcattgcaactgcatcataagattcaacagaagatagtaaaggggaagataaagcttctgtggttcagaccaaagaagctgctgttttgtatggcacatggttatacaaggttagcaaagaaggtgctattttgcatgctgcttgtatggttcggacagcaacctatgtccaaaatacatttcaggtttcataaaccaccatgcaaaacaggtttcaggttacattatacacaacatctttctttttaccaaaaatcaccaaaagcatagacaacatagaaaacaggtttcaggtttccacaaaccaccaaaagcaacatacacaacatagaaaacaggattcatgtttcaacatacaaacagagcacacacctggaaggtttagcaaattgtcaaaaagatcatctggtacatcagtgtcccatgtggcaaccttctcaatagcattggatagcttatccgcgacacttttgaatgcagcaatcaactcctcttcactgtcacgtttttttgccttcttgttgctcttgcttgcagaagatgttgcgacattatcatcacaagcgaactgccttttagtgaaagcacgtgccgtcacctcttcattttcagtttcatcatcttcacctagacctgcactggaatcctttgcaaacttacatgtggccatggtatttccaaatattgtttgcatctcatcaaagtgttcaaaaggcttgtttaaacaatcagcatcgcttttgtcatcctacagttggataggaaacaataatagtcagcaaacaactcatatgtcctaccataacttatatacttacagaagaaagaaactttcagaaagaggaaatgttaaattcagaaatgagtggcactagtccccctgtgatcaactatagataactatggagtatggaccaacaacacaataactacatgaaaagctcaagtgatggctgcagcgacagcaaaacctgttgcctctcgtcagcacgctgtcacagctcaattcactcaggaactactacctctagcagcacaatctgatagcaagcctgacggtatccagtaacaatctcagtattcaccacctgcgactgctatacatctatcatagattgtttgcttagataagtttttacaggttacaacacatcaagaagcgtgaaaacatgctggtccaaacagccaaaaagataagaccaggcaacaaatctaaagcagccccttttataaaggactgaggaaaagataggaactgacagaaccatcggcatgaagtggtgagtataaacatattgcaggtagaggatgttccaatggtaccttaacataaccattatagtgctcttcatccagagtaataacaaaattatcttcatcccagcctgtaccactcacatgcaatggtgcataggtaatctgtgcgctccttgcatttcgttttctttttctagacgcaataatcacggccatcattgacagtaagttatgtgcagcagcaacacaaactgcaaccttggtcctcttatccatctacatttaagcatcaaatacaaaaaaaacatatggcacatcataatgaatctggaatcacatcattatgctatgtattcacaagtacatataagttcattgtttgtggaaataatctcaagcaagcaacaatcgaactgatctgtatatatgcaatgtgttagggaatctgtaccttgcaacttgagcaaacaaatccgatttgaaaggaaaggctggaggaggcttgactccctttgagggcggatctgttcattggatgagaatgtgagacaacatatacaaaacgatgtttctactgtgaagcaacaaataatagataataatgaaacttcgaaaatgcaagtcgtatctctcgaaaggccacgtttgttcctttgaaacattctgtttcaaaagaattgcgtgatgattttttaatacttgcagacaagttgttgacgaacctcaggtgacaaaaaatctgtttcaagcaacaaagatgaaagcagccaaaggccctaaaatttttgtggggtttctaaaagtgatagtaatcgtgctggagacatactaaaagctactatgcaatgtagacttgagtagagagagatatttttatttaaatgagccacaagaagcttggcacatgtgcaaaaatacttatggttctagaaaagaaaaagaaacatgtagctctgctccaacacatcagctgcagtttatagatttgagtagagagagatatttttgttcattggatgaaactgttttagaaaacattttataaagcaacttttcatagtagaacaggtagagggagctagtaggatacgctactctttttatcacggcatttaaatttcaagagcaagaattcactcaataatgccctaaaacgtttggagaggaatccaggaccccttccagatcgtgactatctcatctcagctgatcatcagccatcatgatcatggctgttcctatagaaagaagtaagaaaaaaaattaaaatctagctgaaggcatctcctgctgatgcatccatattccttacataactccagcagcccactgcccaacagatccaaagcggaggttcagaccatcgcctttccatctgttctcccctgttttcgtgaaaaaagactgaggctatctcctttcggaaaaaaaaaagactgaggctatctccagcagatcccatctacagttcagcgttacacggtctaagggagacactctctgccttctgtccctgctctagcctctagcaactattccttaaacccacggagggtccaggtccaactccgagaaaggcagccagccagcgagaaggctcggccgcacgtgcctcgcggcgtccacccaccgcgccgccaggctcagcgccacgaccactgcgccgggcgcaggattcagtgaggcacagggagcatgatgaggagagcagagggaaaggaagtcgtggactcaccgagattcccaggggatggatggccggggccaccgacccccgcggctgggtagactcgccggcggcggacacgggatgaaggaatggatgtttggtttactgggactaatttttagttattttagtttttatttggttataatttctaaattattaaatacgttaaaatatgagataaaataaagaatcccctgaatgggctcgtttgtgtagcccggcaacacgagccaatttggcggatggggttcgtttgtgtcggggtttcctacggcccaccttaaaataccatccttcgccttccgtgactgaaattctgtgtactagacctacagttgttccattgccagattcagccacacatctgaaaaaacaaaaacaaaaaacgggcttactgataaccatgtagctagcgaccatgctatccgtaataataatagttttatttattgagcgccattcgggaagcacgcggtgatgacgccagcaaggcttcccccgcgccagcgagatcacacaagaaccaagaccaattcctgttgttcgcttggataagaacggaagaaacagaggactcggtcctcttcacggaagagtgctgttgctgcatgctgcccatgcatgcacgccattaattcgtggcttctgccttatatttattcttcccatgggcatggcctccagagagagacaaaacgcgatctgaaaaatccacatcaatctccagctgctggccgtaggcggtatagcatacagtccagacagtcagatagagaggcacctcatcagtcgtgcattattgccctcttgtacgtacacggcagttttaagtgagttttcttatccctgtgctatctgtaaatacatactttgtactgatatgttattacactatagatgaaagacttatgtatatgcttcgtcgtaatttaaagttctttttttggtgagttcgttcgattttttttttttttttgtagattgaaaaaatatggccgagaacgagggtaggttccgctggggattcgaatctggacacttttttttgcaggagctgcgttcaattgcttgacgacgggctaataacccagaggcagccctccttacatgacgaggctctggaatacttgtcgcaaaaattttctacggtgaattcaacagtttcaaaaaagactctgatgaacaaatggaactgtatgaaacagcgggatctctggtgcgccctgtttcgtatccactcgtcaaatatgggagagttgaaaagccgcaggatgtacataaaaaagacaaaggtattctcttgcacgtatctctttgattaaatctaattaattgtattgttcaagtattagtatattctaattatatatatgtttgtttgtttcatttttctagaaatgtgcgaacgtatttaagcatatgataaatgaaccacctaagaatttggatctacttaaaagattgttccacgacgaagatcaagggacaccgccatcatccccgccacacccatcgttcgagccacagtcatcgttcatgccagagtcgtcgtccccgccacagtcgtcatcattcatgccagggtcgtcgtccccgccacagtcgtcagtgtcatcctcgtaactttcctttattttatggatagggtatgcatgtatatcctaccacatttagggacgaatgttgatacccgaattgttaggacaagtttaataatatttttaaattatatatatgtatgaaatttgatgtcaatcttttatcaagcacattattacagataagaaaagaatttgcataaattgttttatgcattgtttcctccttgcaacaaaagcggagggggcaatgtataggtgatcctccaccactcgcttcaccaggcgtagtaattctgtgtgcgcatatgatatgaaacagggaaattctaaagtttgcaagactgacaattgccctcgtacttgtaaaatacttttttcggtggtttcacctgaattaattatttcgtaataaaccaataaaagatatgagctgcatagagaagaaacttgtaaaggaacagaattgttcgattatgcttacctatactagcactattgccctccatattatcatatgggtcaaagcactggtactggtactggaagcgcttcttcacgccggcgtttcctatggcccacgtcgaaataccatccggccgtggcggtcatgtttggattgcctcgaattgaataacaaaccttagacataaaaaattacccgtgggagaaaaaaaattatatcccatccctgaatttgaaagtgtccgattggtcagccacatatccgcttttttttttttttttttttgaccatgccaaccataacagctttattgagcgccacacagttagtagaacagccattagcataggaagtgcaaccaagccctacagttgctatctacggagccatcagaaatagcgccagaactctgtacaagccaagccaagagaagtatttacatccaccaaactagcctcctactcaagtaaccagagttaacacgcactcatctagctacgcattctccctcagctgaatcccaatcacgaccagatccacagcgcatagtacgcaagggtggcgttcttcagcctgcacagcatcagcaggaagtaccgcatctgggcgaagcagacgcccaggttcagagccacggccagaacgtgtccggccgagtgaaccttcctgccagggaaggtccagaagaacgagccccacgaccagctgaggccgcaggacacgacgcacgtcagggcgaacgtcgcggccgcgtaacccaccggcatgcgcgttcctccgccaaccccgatctggacttccatgatcagtggaatcgcgacctggcaaattaccatcacgatggcaccgatggcgaacgtcacctcccggccgaactgtttcgctgagaatgcagatccaagaactccgcaggaggtcaccagaaccagcagaacgttgccgatcaccgctgggctgctcctggaactcacggcctgggacagcattggcaggaacaggatggtgacgttcacccgggctagccgcaggaagagctgcaaggccgccaggactaccacgaatgccaggtattgctcattcctcgccatggccctccagattgcgctcgtgtcatggccacttcgcatccactgcctgatgaagctgagcttcttctggggggtgtcagcaaccttcagacatgcagagtaacagatgcatcgaagcactagaccgacgtaatctcgcttgcgcccaagaaagctcgataatatctgatcattgcccagctcattattgtccacgaccagaactggttctccacggaggttagcactttgtctaaggatagattgccaaccagaaaaacggtctggaatcatagtgcagccacagagcttggtcattagagcaccaacgctggcaaagaatggcaggaagccacagcaaggaagcgagttcatagcagcacgggatatcatcgtgttcgtgtgctgtgcaacagaagttccgcccagtaaccacctacgaataagagctccatagctgatggcaatgctctgaatagcagtaccggtgctgaagaatgtacgatcgaccagcaggacaggaaggtgcgacatcttgtggatggtgtgagagccaacggtagagttgtttgatgatacaccgaacatgtccacgtacttcctgtacagagagttcagctccagcttcgccgtggcaacgctagggaagaacgccatcgcagatgactgcatattctgagcacacctgctctgctgcctggtggagagtgttccggagaataccgcaacagctagcacagatccacttgcttccctccccctctctcccttggctgcgtccttgctttacgctccgcgggccccgcggactgtcggaaacggacggcgaccacgtacccctcactcactgactccggcggcgagctcctggtctcggaggaagggccgccgccgcgccggagagcgtgctaatgagatcctcggaatggagtggaggtgaaggatccgcgggagagcggcggactgggcgagtagtagtgcgtgcgacggaaacgaggcgtcagcacttccttctcgcggtttcacctgccgttcgcctctctcgatcgatctgtgcttcagtttccttttctcacgccagaccagaataccagatggtccgccggagtccggctccgctatccctatttcttcttctcttttttctatgtacggatgtgagaggaaggaagacaagcctcgggtgctctggtgatgtgggcggggtggtggtggatagtc

SEQ ID NO: 24064 - DNA, 1069 bp, Zea mays
cgaccaaaaagcttatagccattgcccccatctcaggatttttttttttttttttaagtccacaaaacacatattattaactccacacagcacacataataatgtgtcctagccttgcacataatatcaagttcaaggcttctacaaaatccacacgtacttagcccacaattcattgttcgatgtggttcaagcaaaagagccgtccaaatctacctactaattaccctcacactctagagaacttctcactggcgaaattgcgagcccaaattaacttgtggtcgaacggcaacttgttgaaggctctagcaatgtgagggtgcgccaccaaataattgaaatacagagatatgtgggtctgctcaaaacctggaaggtttagcaaattgtcaaaaagatcatctggtacatcagtgtcccatgtggcaaccttctcaatagcattggatagcttatccgcgacacttttgaatgcagcaatcaactcctcttcactgtcacgtttttttgccttcttgttgctcttgcttgcagaagatgttgcgacattatcatcacaagcgaactgccttttagtgaaagcacgtgccgtcacctcttcattttcagtttcatcatcttcacctagacctgcactggaatcctttgcaaacttacatgtggccatggtatttccaaatattgtttgcatctcatcaaagtgttcaaaaggcttgtttaaacaatcagcatcgcttttgtcatcatgcaatggtgcataggtaatctgtgcgctccttgcatttcgttttctttttctagacgcaataatcacggccatcattgacagtaagttatgtgcagcagcaacacaaactgcaaccttggtcatcttatccatcttgcaacttgagcaaacaaatccgatttgaaaggaaaggctggaggaggcttgactccctttgagggcggatcgagattcgcaggggatggatggccggggcaccgagccccgcggctgggtagactcgccggcggcggacacgggatgaaggaatggatgtttggtttactgtgactaattttt

SEQ ID NO: 24065 - DNA, 1224 bp, Zea mays
ttttttttttttttttcaaccaaaaagcttatagccattgcccccatctcaggatatgttacaactaatattaagtccacaaaacacatattattaactccacacagcacacataataatgtgtcctagccttgcacataatatcaagttcaaggcttctacaaaatccacacgtacttagcccacaattcattgttcgatgtggttcaagcaaaagagccgcccaaatctacctactaattaccctcacactctagagaacttctcactggcgaaattgcgagcccaaattaacttgtggtcgaacggcaacttgttgaaggctctagcaatgtgagggtgcgccaccaaataattgaaatacagagatatgtgggtctgctcaaaacctggaaggtttagcaaattgtcaaaaagatcatctggtacatcagtgtcccatgtggcaaccttctcaatagcattggatagcttatccgcgacacttttgaatgcagcaatcaactcctcttcactgtcacgtttttttgccttcttgttgctcttgcttgcagaagatgttgcgacattatcatcacaagcgaactgccttttagtgaaagcacgtgccgtcacctcttcattttcagtttcatcatcttcacctagacctgcactggaatcctttgcaaacttacatgtggccatggtatttccaaatattgtttgcatctcatcaaagtgttcaaaaggcttgtttaaacaatcagcatcgcttttgtcatccttaacataaccattatagtgctcttcatccagagtaataacaaaattatcttcatcccagcctgtaccactcacatgcaatggtgcataggtaatctgtgcgctccttgcatttcgttttctttttctagacgcaataatcacggccatcattgacagtaagttatgtgcagcagcaacacaaactgcaaccttggtcctcttatccatcttgcaacttgagcaaacaaatccgatttgaaaggaaaggctggaggaggcttgactccctttgagggcggatcgagattcgcaggggatggatggccggggcaccgagccccgcggctgggtagactcgccggcggcggacacgggatgaaggaatggatgtttggtttactgtgactaatttttagttattttatttttcccggccgacgcctccgaggttttcaaatacgactaaaactctatttt

SEQ ID NO: 24066 - DNA, 1051 bp, Zea mays
  misc_feature (21)..(21): n is a, c, g, or t
  misc_feature (31)..(31): n is a, c, g, or t
gatgttatggcattatcatcncaagtggacntccttttagtgaaagcatgtgccatcacctcttcattatcaacttcatcatcttcgcctaaaagctgcactagaatcctttgcaaacttacctatggccatggtgttttccaaatattgtttgcatcttagcaaagtgctcaagaggcttatttaaacaatcaacatcattattgtgatcctacaattggattattataaatctgcattatgtgtacataagtttgaaagttgagatatgtgtaataggaagatgagagagttaccaagaagcagtaataaaggaacaacctgagtacagtgacttacgtgtacataagtctgaaatctgaaatcttactgttatgtgcacataactgaaatttgaaatcttattgtcaatgatggctatgaaatatgaaatctgcaatatgtgtactactacaggtatataccaactagcacattggagaaaaatagcaggtagcagatagcagattatataccaactactacatgcatcagattatagaaaactaaatagcagattatacacatattgcagattgaacacatatttgcaggtaggaagaaataataccttaacatagccattatagtgctcttcatccatagtaatagtaaaactatcttcatcccagcctgtaccactcacttttcttatcctatttatcttggcaaaccttcctggaccaagttttcagatgatttttaatctgctcgccattgagggtgatttggaacttttcattgatagcttttgcacaactattgtagtgaactttcttaaaaccagacgatgtcctttcgccaattgacaccacattggacaggtaggacaacatgaaagaggacattgctgatgtccaggtagcatgcccattagtgaagccttgagcttccatttctttccgcgctgaggagctcgccggccagcgggatgaaggaggcggcgctagatctgatgtggatgagaagggctcgtgaggtgccttgtcccgagaagaacgatattatccgt

SEQ ID NO: 24067 - DNA, 1485 bp, Zea mays
cccaatgaactagagtgctctataattatagttccatagatccaaataaaatttacccccccttgcagtccctgcttcctggagcgtccaacgggacttcacccccacgtgggttcagccatcaaaagaccagacacggcccggccacatccgcatatttctatgttcgacggaaaaaaaatgatcttccataccaagttaccaaaactccacacgagccggcaaaattcaattttctgaaagaccatggctgttgcagcccacgaatctgaaggaaaaatgtcacaatagaaccctcatctcagtactagccttgtactgagaaacgaggggtgtcaccgcgtgcttgtcctgaaatgcacctctttctatcctaaccactaccgaacatacgatgaacatgagccgtgtacatctgaacactgcccagcaagctgctcttggtccacagtgatctttccagacagatggcggaggaaatcagtgtgcagcgcgtgaccagccttataggcaattatatgagcaattggaaagccctggttaccattctgtgcaaacagcgagaagtcaccaataagatctaaaatcttgtggcggaagctcatcctcgaaccgcagtggtggattcagccagccaccagatatgctgcaaaccatagcattttctagtgaccctcctttgatgagtccagcagcacgcattttttcaacctcttcaaatatacagaaagttcttgcaggcgcaatcttgcttgagtatatattatcatccaggaatgtagaaacccattgacactcaatcgctggcacctttgggaaatcaatgccacaggttatgtggatttgtgggctagggaatgcagctataaagcaatcgtgtttccgtaggtaaacaggctcctgaatttcaggcgccagtttatccaacttttccccattggcatcctctgccgcacacaagccaacgccttgtactgcctctacccactcttgcgctgatccatcaagcaaaggaatctcatccccgccgctaacctcgatacggcagttgtcgacgccaagcgcctccatcgccgaaagaaggtgttccaccgtccggacccgcgtgtgggcgccatcgccccgacgaagcgtcgtgcagagctgcgacagtggctcggcgttccccacctctgccgccaccctcgcctcctcatcaccctccacgaggaaatacctaccctctccagcttgcgtcggaaacagcgtggcggtgacgcgcgctcccgagtggagccccacgcccgacctgctcaccgccgccgccagcgtttgctgcggccgccccgtcggcttccaggagaaggctgcgcgggagacggatgtgagggcccgggcggcggaggagggcatggcggcggcggggaaggcagtggaggcagaaacctgtcacgaccgagggtgtgacggtctgaagacggcgggaaagtgctcagccgagcgtgt

SEQ ID NO: 24068 - DNA, 2446 bp, Zea mays
gcacgagaccattacctagaacatcctaatcgaaaaacgcggtccatctgtcttgtgtttctccttcctcattcctcagctcgagctcctcggcggctcgccagtctgccgccgcgcacggcgcatctgttccttctgctctgcgacggcgagcctctcccctccctccgtgctcgtatcgtagcctattttcgccgccgcagcttgcccagtgctgttatcttgtgttcggcaccgcgtcaaaggctgaccctctccaggcgcctggtagatcgcccagactcaaccgggtaagccttaccgcgcacgccaccatggccgagccctcgccgcctccggtgtcgaacgctggcctccgtatcctcctgtcgaaggaccggccggctccctcccctccacccaccgccgctgtctccagccacgccgaccgcgaccgcatcatcggagttttcaggagcgcgttgtctaggaacgaacccccggaaacattttcccttcagacggttcaggaagcaattaaacctcagaaggaaaccgtgttggttctagaggagaatcagtccttggaaaatgctcttcgaactttgctgcaggagcttgtgtcatctgcggtccaatcggataaaaagattatgcagtacgggaattctttggatagcggagaaagtaactgcctgataactcgccttcttgatattgtgctttacctttgcgaaagagggcatgttgaaggtggtatggtattccagctgttagaagacctaactgaaatgtcaacaatcaaagactgcaaagatatctttgggtatattgagagccagcaagatgtattggggaagcaagaactttttggacgtggcaaactagttatgctaaggacttgcaaccaacttcttcgcagactatcgaaggcaaatgatgtggtgttctgtgggcgcattattatgtttctagcacattttttcccattatcggagcgttcagctctcaacattaaaggagttttcaatacatcaaatgtaacaaagtacgaaaaggatgctatggatggaatctctgttgacttcaacttctacaagaccctctggagtctacaggaacatttcagcaacccagctttgacttctacaaatccggcaaaatggcaaaagttctcttctaatctggcggttgtgttgaacacatttgaagctcaacctcttagcgatgatgatggaaaacttaacaatctgaacgaggaggaagatgctgctttcaatattaagtacctgactagcagtaaattaatgggtttggagttgaaggacccaagttttcgacgccacatccttgttcagtgtcttatattttttgactatctcaaggcacctgggaaaaatgacaaagaaggtccaacagggagcatgatagaggaaattaaatcttgtgaagagcatgttaagaagcttctggaaattattccccccaaagggaaggaatttctgaaaagcattgaacatattcttgagcgggagaaaaattgggtttggtggaagcgagatgggtgtctcgcatttgaaaagccgccctttgaaaagaaaccaggtcaggctggtgccagaaaacggaagccaaggtggagacttggaagcaaagagctcagccaactttggaaatgggcagaacaaaaccccaatgtcttgactgatcctgaccgtgtccgcatgccatcaattacagaatattggaaaccacttgcagaagatatggatccatctgctggaattgaagaggagtatcaccacaaaagtaatcgggtgtactgttggaaaggactacggttttcggccaggcaggacttggatggattcgcgcggttttcggactacgggatcgaaggggttgtaccttcagaactactgccacctgaagtaaatgccaagttttcttctaaacccgcagagaaggttaagcggacgagaaaggaagattcaaaaagcgtgtcagctcatcagcccagagagcatcaggttgctgcgacacccgaaaccgacggcggtgtcgacccggaagaaggcgaaggcgcggcgccaatggattccgacaacggcgcggtgggggatagccagaaacggagcccgggggaggtctctggccctgaaagcgggcagtgcgagcctgaggcggatggcgatgataacgtgaggacggaaactaccagtagggatgctcgtgccggagagatgaaatgaaacagtggcatgaagaggaaccagattttgtcgactcactcactgacattgaaagccgatcgagcgcgttttgaacagctgagatacattctcttgttggtgtgtactgtgtagtagacatcagtagccatccatttgaaggaaatgcttgccgtgacgtgctgctgccaaaaaaaaaaaaaaaaaaaacaaaaaacaagaaataaatataatat

SEQ ID NO: 24069 - DNA, 1786 bp, Zea mays
gcaaacaaaaaactcagtgttaagaacagcacgaagcaactaagagctattcatcatgttcaaaggagcatgcaagttgtatgtctgggtctgggaacacatgtaaaatcaaatagtgcttcgaacacattagggagaattgcttaataattcagaaaggtgaataaaccaaccatcagggtgatagaacttggccaatcttctgtaggcagtctttatggtctcctcgtctgcatccctacccagctctttgaagcgcatgagacacaaagaacacacattagcttcatcttcaattccaagtccgtaacacacagtgcatctgaaactacaaagtagtggtgcgtggtgcagccgcttggtactattaagctcaacttagaactgaatcatttttttttcggtgatggaactgaaacatatagaagcatggcaacagcaaatgatcaaacttgtgtaacggatcaaataattcgatagtaagctgatcagcatcatacaagttgatcaccaggattgacacacgaaaaaacagatgcatagtatagttctcgcacaaactacagagcgcataggatcgtcccaagcgtctcgtacggcgatttctccgagtcccaactcgccgcgcgcgtggacgccctcctccgaaccccgccggccgccctcgctacctcgtccaacacgaacgcgggcggaccggaattcgacggtacccggaatctcccgccgggcgacggcgcgaaccccagccgcccggctcctcgtctggcggcggcggacgtggagtagatatggaggagggaggagatggctcgaaggctgctcatcgccggcaacgcagggaagctttagggttagtgcgtggtggagccgtgaaagaagaggcggagccgcggtggagaagctgaaggtccgctggtttgtggtggaacggaggaacgcctccggttgtacacgtggaccgcttcgcttctcaaataaggcctccttttctggccgtcacagggtgtcctcctcttttacggtaagtgcatgttgctttcttgcggccccccctcgagttttttttttttttttttaggacccaatgtctatttattccagacaatctaatttcctttctaaacgctacagtatttacatttacaaatttacaggactgcacccacgtacatgtggtagaaaataaaccctacactacaattctcttctctgcattcttgcaggtagatgactgacaggtcacaaccacagggttaggttagtcctgtactgctactgtacatgaaccagaaactgatgatcagaggcatatctaaactgaagctcttgcagtgttctaacagtttggacttcaaggaagacttgtcaatagaagtcatttcttttttgtgccagcatacatggctctttcccactgcgcgacatcttcgaaccgcgagggcggtggcggtaggacctcacgctctaccaggtcccaaccgttgaatatgctatctggcacgccaccatgcttcaccaacttagcggtgtacaagaagctctggtttgagttcaggaggaggttgtctagagtgctgggcatgatggttgtgtgcatgctgtccataaaactgctgtccgacgatacggctgaacttgacttccaaatcgatctgtttagctgctgcgcttgcttttctgaccttgaagcatggttcatttcatagcagttcgaaaggcctttgatgacataacgatggagcaacttagaaaacgcctcaaaagtagaaagattggatggcac

SEQ ID NO: 24070 - DNA, 818 bp, Zea mays
ctctgccttcttgcgcataatatcctctttccgtaacacaagggtatgtctcttcagagttgtgctgtagaattccatagatgcctctttttccgccgctttttgcttcctttcttcctcagggtcaaccttggagcgtgagagacgccgtgcccgtagcgtcatttcgcgttgctgttgctcagcccaagcagccacagccatgtcaccacgttggtcaaaagctttccgcttcttcattacccactccatccatgcttgagaagccttcatcggattcacatgatgctctctatcatatgctcttctcctttcaccatcaatcaacagctcatacgctgcttggatcttaatgaaacgcgcttcagcggtttccccttcctcaagggttcccttaccatcataaacatcagggtgatagaacttggccaatcttctgtaggcagtctttatggtctcctcgtctgcatccctacccagctcaagcgtctcgtacggcgatttctccgagtcccaactcgccgcgcgcgtggacgccctcctccgaaccccgccggccgccctcgctacctcgtccaacacgaacgcgggcggaccggaattcgacggtacccggaatctcccgccgggcgacggcgcgaaccccagccgcccggctcctcgtctggcggcggcggacgtggagtagatatggaggagggaggagatggctcgaaggctgctcatcgccggcaacgcagggaagctttagggttagtgcgtggtggagccgtgaaagaagaggcggagccgccgtggagaagctgaaggtccgcccc

SEQ ID NO: 24071 - DNA, 3725 bp, Zea mays
  misc_feature (1037)..(1037): n is a, c, g, or t
  misc_feature (1178)..(1178): n is a, c, g, or t
  misc_feature (1237)..(1237): n is a, c, g, or t
atacgtaatctaccatgcacgatatgaaaaatgtgtattccattgattacaaaatattgtatcttcatttgaatatattctccgtttaaaaactattttacgttgctgaaacaaatctctgatgcaagattgaagacagcttgagtttatcaaacctcaggttagagaaacctgtggtttattggccaagctacatgttaaacatttttttggattataaaaaaaatgtatcagtatttttgtaacgcatcaagaatttaatactgttactatgttttggctataatgttgctgaaacaaatctctgatgcaagattgaagacaacttgagtttatcagacctcaggttagagaaacctatggtttattggccaagctacatgttaaacatttttttggattataaaaattatatcaatatttttgtaactcgtcaagaatttaatactgttaccatgttttggctataacattgctgaaacatatctctgatacaagattgaagacagcttgggtttatcagatctcagattagagaaacctgtggtttattggccaagctacatgttaaacaattttttttgaattataaaaaattgtatcaatatttttgtaacgcatcatgaatttaacactgttactatgttttggctataacgttgctgaaacaaatctctgatgcaagattgaagacagcttgagtttatcagacctcaggttagagaaacctgtggtttattggccaagctacatgtcaaacattttttttggattataaaaaaatgtatcaatatttttgtaacacatcaagaatttaatactgttactatgttttggctataatgttgctgaaacaaatctctgatgcaagattgaagacaacttgagtttatcagacctcaggttagagaaacctatggtttattggccaagctacatgttaaacatttttgtggattataaaaattatatcaatatttttgtaactcgtcaagaatttaacactgttaccatgttttggctataacattgctganacatatctctgatacaagattgaagacagcttgtgtttatcagatctcagattagagaaacctatggtttattggccaagctacatgttaaacatttttttggattataaaaaatcatatcaatatttttgtaactcgtcnagaatttaacactgttaccatgttttggctataacattgctgaaacatatctctgatanaagattgaagacatcttgggtttatcagatctcagattagagaaacctgtggtttattggccaagctacatgtcaaacattttttttggattataaaaaaatgtatcaatatttttgtaacgcatcaagaatttaacactgttactatgttttggctataacgttgctgaaacaaatctctgatgcaagattgaagacagcttgagtttatcagacctcaggttagagaaacctgtggtttattggccaagctacatgttaaacatttttttttggattataaaaattgtgtcaatatttttctaactcgtcaagaaggtaacactgttaccatgttttggctataacattgctgaaacatatctctgaagcaggtttgaagtctgcttgagtctatcagatctcaggttagagaaacctgtggtttgtttgccgaactacgtattaaataatttcttgggttatgaacgattaattaaagtattaaaccttgtatctattcatgctaccatatacagtttacattgcctgtgggagattacaccaccctaccgatatgtctgcaactccttttttattcttctattttctctgtcttctcagcttccggcggtgagatatcctgctcgtagatgacctgagcaaccagaccaatgaaaatcagacccagagcagcaaccttcctccactccacctctggtgttgcaaagatggcattcgcaattgtaatcccgagtatccccatcagccccaggtaaatgttcatacgagtttttgatcctgcactctcctctgcaatctctttgaccttctgtgcttccaccttggctttcacctttatttccatcttgttccgaggtttgaccttgccaaggcttttgaagaacatcccttcgtttttctccttttcgatccagtcttcgaagtcctctaacaccttatcgttcatttctatctcttgccgttgcacctcagccgtctcctcgaaggcttgcatcttgctgtcgagcctctccagtatctacctcgtcagacaccgcagttgtttgtcaaacagtgagtatcagtaagatgttcatagctattgatggcaagagatgctcacctggtcaccaacggcatcaagttctttcatggcgttctgcccaatcaggtcgaactccgagtcggcgtccttggcgaacttggtcaggtaagcagagcgctcgtccaagaagtctgtgatgcgcaccttctgcgtctgaagcatggcgatctgtgcaagaacctcctgctggtgtttgtcgccaccaagcggcgggggagtgccggattcggcatcctcagaactgctggcagaaatgaaagatctcttcctgcctagcagagcacgccggaacagagaggatctgcgcagcgaggggcatgactgaatggtgtggagagtaagcatctcctactctctgtagtcgctttgctgttgctggtgttgatttggcaaacgatttctgcctacctctcgtcgtcgccggagcccgggaaccatatcccttctgttccgttacaagaccaaattgcccttgcgtgctgggtttcctcaggtactattacgtcttgcttttgcttgccactcccactttgcatgaagtggaactttgttgtccagttggagccaccgaaaatatcgagccccacaaggtgtcacgaagtcattagtcgggccgaaatcgacgcagttgggcatcatgggctcaagtactgaaagatagctgggccgtaatgaatgaccacgtacaagtccaaggaattatatcgatcgatcatgattgaaggcgcaaagtcgtatggcacaatttttgggtttgatctcaccactcaccaatgctattatgggaatgaaatggtaagctcgcgcttattgccattcgagcctgagtttttttcccccacgaattgaaacccgaacgttgaattattgctgctgggggtggtctttctctgtttgtcgcttttgatccaggagctcccttgttcaacgcagtgatctatactatacccacatgatggcacgattaaaaaaggatcttgaccttgacgtagttccgcaaaaacaaacgcatcctataaaactcggaatcacaaaacgatgctctctgcactgcagtactacgcagcccacatgatgcgaatccttttgctgcaggcttcagcagaatcgccgggatcacatatacattctaggtgaatcccctgctgtctgtgctcgggacaccagaaacggcctgcacggtttcattgaggcccggcgccgctcaggattcaggagtagcaagcagacgaacatgcagatgcctgggactggcaagcgaccagcaagccgagccgggcgagcaacatgataggaagtactgcccatttggacagccatacacgtcgctgtcggcgccaccagggcgtcgaatgcgtgcatatgcagtgtaacacggggcagcacgaccgcaacacaagc

SEQ ID NO: 24072 - DNA, 1121 bp, Zea mays
cgcaggtttgaagttggcttgagtctatcagatctcaggttagagaaacctgtggtttgtttgccaaactacatattaaataatttcttgggttatgaacgattaattaaagtattaaaccttgtatctattcatgctaccatatacagtttacattgcccgtgggagattcacaccctaccgatatgtctgcaactccttttttattcttctattttctctgtcttctcagcttccggcggtgagatatcctgctcgtagatgacctgagcaaccagaccaatgaaaatcagacccagagcagcaaccttcctccactccacctctggtgttgcaaagatggcattcgcaattgtaatcccgagtatccccatcagccccaggtaaatgttcatacgagtttttgatcctgcactctcctctgcaatctctttgaccttctgtgcttccaccttggctttcacctttatttccatcttgttccgaggtttgaccttgccaaggcttttgaagaacattccttcgtttttctccttctcaatccagtcttcgaagtcctctaacaccttatcgttcatttctatctcttgccgttgcacctcagccgtctcctcgaaggcttgcatcttgctgtcgagcctctccagtatctggtcaccaacggcatcaagttctttcatggcgttctgcccaatcaggtcgaactccgagtcggcgtccttggcgaacttggtcaggtaagcagagcgctcgtccaagaagtctgtgatgcgcaccttctgcgtctgaagcatggcgatctgtgcaagaacctcctgctggtgtttgtcgccaccaagcggcgggggagtgccggattcggcatcctcagaactgctggcagaaatgaaagatctcttcctgcctagcagagcacgccggaacagagaggatctgcgcagcgaggggcatgactgaatggtgtggagagtaagcatctcctactctctgtagtcgctttgctgttgctggtgttgatttggcaaacgatttctgcctacctctcgtcgtcgccggagcccgggaaccatatcccttctgttccgtaacaagaccaaattcccggccggccccgagtgtac

SEQ ID NO: 24073 - DNA, 1377 bp, Zea mays
tagtaaaaccctttctttgtaagagagaacgatattatcgcgaaaactttacatctatcttgtccaacgcacgctaactgagctccgtggaattcgcactcttccccaggtccgaggcaacactagttattgataatgttagctagtggcttgacttttgtcaaaccttcagtgtatcactagtgaaactgtagctcgtgtactcgattttgttcttccttttttgcttttgtaccgattgtgactactagcaaacaaaattgcaaatagggcatctagcaacagaaacaaaacaaaaaaacaacaacttgctctcctaataagttactacagcgaagttgcgtatatcccagttctaccttgcgaatcacctcacccgccatcgcctctatccgtgaatgttgcactgctgcaagtgcgggttatcgtagttaaggtacctgttccagtagcctctgtactttgggatagaaatctccaaccagggtttgagtttcccactgtagtggatgacagaggcactctcgagttcatctcttccgatgctggagtcatgaccgagccctagaacatgccaccggtggtccagaggcagcgttcggttgtagaagacaacctgacccagtggcaggcttcctgcctcccacaacttctcacttttgcccagttgaaaccatctatgataggttgtactcaaaccctgtttgcgccattcgttcaggtcaaatatgttcatcccaaatgcaaatgcacaagcctttgggtcaagttcgttgaagacgcttggattggaaaaatcaataaggctatccaattggcggaaaccttcacttgaggtgcatgtgtcgacagcaccggttaccttacccttcatatctaggtcccataatccagacaagtcattctgtactaccacatcatggtccaagagtagaaccttgctcaaagatggaaacacttctggcaaataaaaacgcaagtggttgagtgcagaagtgtatctcggatcccgaacccccttcagcttgaatctggaactgaaatcaccaggcaaccatttcaaatcatctaggctctggatttggattactgatggagttggtgggtttgtcagaaaccacatcatcattgcaggataattcaacgcgtcagttacaatatgtaataatatccttccaggatcctttgaatgcagcaattgtagagttgacaaccacagcacttgcaagcacatcgtcagagaacatcgcataatgcgaccaacccccccgctccctgtggtctcttttagggaattcacgtttagtgggatctaacgaaaagtattctgcggtaagctgcattgctaggcagtgatggcctttgggtaatgtcctc

SEQ ID NO: 24074 - DNA, 829 bp, Zea mays
accggcttttttttttttttttttaggagaaccagaggagttctattccaggatactaagttttccttacaaaatgcataccgtctctttcggctacgctagtacttaagacagccacttacgcacgggagcacgcaggctcagacccaacaccaatatgccgactcactgcacccactctggtccttgctgacggacgttggcgcgacagacacggcgtgtgcggacaactggagctgcttccggttcgccgtttggtacgcctcggctgcctgtaggggaatccatactctcattgttgacattttcccccccttggaatcctgcttgcccccaagcaggagcaaaaggataacattgcctcaggttgtcttggtcttcccatgtggctaactcagtaggaaggttggaccactgcaccagaacctgtttcacaaagcgtttacctttagcaaagccacgagtctgcaaaatacggagtggtatgctgaactctggcagttcatccggtaaggaagaagtagcagagcccgagaaaccttttgccagcttcagttgggagacatgaacgacgggatgaatcctgctggaatttgggagttccaatcggtaggccactgaaccaaccctgttggccactcgataagggccaaagaacttgtaactgagtttttggtgggcacgtggaagcactgaagactggacgtagggttggagcttcatgtaaacccaatcgccaactgagaaggagcgttcagagcggtgtttatctgcctgttttttcatccgagtttgggcgcgaataaggtgctggtggatgagattttgc

SEQ ID NO: 24075 - DNA, 724 bp, Zea mays
  misc_feature (697)..(697): n is a, c, g, or t
gagctcactagtccccccccccccccttatttgatgagaggagtaccattcttttgctagcattcctatcttcgcatctgactaatgatgaaagattggatcaactaaagaatttgatcaacatgaggttgtacaagagtgcggatactaagattgcagcaagacgtatatctcgaggaaagattgatataaagtatcatccatctcagacagataaaaatgatggtgcatgcaccaaccaggagtgggctgcaactattatacagactcaggccagaagtcttattgcaaagaataaatattgtgagcgtaagaaggcaatatttatcctgcaaggtgctttaagggcatggtcagccatcatctcgaacaggaaccgtagttgtctaagtattgctgcctctattccctggcaagcacaaggaaacaacagatatttcatttttataatggaaaggcatcgatttgttcagatgagaaaatctgccattatgattcaactggctgtaaggatttggattagaggaagaaaaaaatttaagaacagtgattctttcaaaagctgtgagttccttgaaggtaaaactccacccaaaattagtagcattgctccttcccctcaggagcattgtagtgggggagataaaacaatagcttcgcccacagcatgcaagcactgtgagcatgtgctcacagngagagcttctgctgctgctcctattct

SEQ ID NO: 24076 - DNA, 1520 bp, Zea mays
caataagagtattcttgtgctaccaagcttttcaacgccaccgacttgctgcagtactgattcagcgagttgtcagaggatggctggctagaaagagactgttaggttcctcttcactgcgaacctacacaagactttgtgtagtcgaccaaagtcaaaagagaaaatgttatcaaagccttgagttgaacattgtgctagactctgtcataaggctacaaagatgctggaggaagttcctgctgcgtcagtctgtcaaaacatatgtgatctcaattcagtcttttgtccgtggctggttggcacggaagcaactaaaccaaactttccgttgcatcaacatcattcaaagatggtggcgaaaggttcttcaaacgaggaagcgagctgtgattgtcattcagactcgtttccgtggttgggttgcacgacaagatgctattagaactagaaactctatctgtaacatacagagatggtggagaaaggttttgttccttaaattgaggaagcaagcggcgttagttatacaggctcatttccgtggttggatagcacgacaagttgcttttagaactagaaaaagtattactataatacagtcctatgtcaaagcctaccttgtgaggaaggcttcgaagcaagaagttgcacatataagatctagactgcagaagtcatcttcacaggttgatgatagtatgcgcctgatcaacagactggtgtctgcattgtcacaactccatcgctgtcggagcatacacagcattcgtcaaacttgtgcaacattgagtactgctacagagtattccaagaaatgctgcgagaagctggtcgctgctggtgctgtagatatattgctaaagcaaatatatttgctgaaccgtgggattgctgaccaggaggtcttgaagcaagtgttccttactctcaggaacattgctcgatattcaaatcttagacaggtgttagccagcactgcagaatctgttgaaatcatcttccaggaattactgaggaacaaagcagacggattcttcatcgcgtctgatattctaaaaagcctatgtgaatccaaggaaggccgtgaaaccgtccaagcgctgagtcacctcatcaaaaggctgcgcaatctggtgcatgacctggaaaagaaggtagagcttgataagaggaatgggcgcaccggagccgtgaaggcgaccaacctgcggcggcttcgggaggccgccacactctatcatatcctcaccagtggtacttaacgcgtcggcagcatagctagaaaggctaatctgacgttttgttgtacaataatttagtctaagaaggttttcatgtaactggaggtgactacggtgcaattgtcgaaaaccttcctaggtaaccaggatcttctaagttctgttgctgcagttggttttgtgtggtaggtgtgagaatcatcggcttgatgtattggattacctcttataaagagtgaagtcgctgagttaaccgtcctaaaaaaaaaaaaaaaa

SEQ ID NO: 24077 - DNA, 1478 bp, Zea mays
  misc_feature (432)..(432): n is a, c, g, or t
gtggcggtggtcggcgctgccgtgtacgaccccctggcgcgcgccaaaatggccatcgggcgccggtgggacgcggtgggcgacctccagcgtgcactggacctgaagactctgttcctggaggccgggagtgctgagcttgggaacgcctacagggacgtcgccgaggcctatgcgggtgtgctggacttcgacaaggcgctgccattgtgttctaaggcattggggattgcggagagacggtttggtgaggactcggcagaagtggctaagctacggcggcttctcatgtctgtctatactggtttgggtcgccatgaggaggctctggctcaaattgagcttgctaaggtggtatatgagcgattgggattgaatgttgaactttctcaggctgaaattgatggggctaatatccgtatcttgttgggngagatcggaggaggcgctgaataacattaagagggtaatgcagcgggcagacaaggagagcgaggagcgtgcactagcatatgtcacaatggcaaagatattgatgtccgaggatacggttttggactcaaagcggtgcttgggagatcgctcaggggatcatagatgcaaaggattccatcgaccctggtcggtttgctgaggcatatgctgagatggcaatgttgtatgagtcgttggcaaattttgaaacgtcttcgggctcgtttgaaatggcttcgaacttgatgaagaaaacactggcaattcttgagagcgccaaggagatgcatcacatcgaaggcagcatctcagcaaggctagggtggctcctcctgtatattaaaaatgttgatgagtctgtccaatatctggagagagcggttgataaattgaagcattgctttggaccacgacactttgggttaggttttgcttatagaaatctggggcaggcctatcttgaaatgaaccaacatcaatcaggtgtggagttcttcaaacttgcacttgatattattgaacctacatttggaccgctacatgatgataccattgacacaaaacagtgcattgcaaatgcatacggactgatgaaaagctacaaacttgctatggagtttcaagaacaagtcatggatgcctacagtaggtgtggccatggtgccttggatgatttcaaggaagctgaaaggcttttagagcagatcaagatgaaggctcaaggattgcgtcatgcagtatttcctgcaaattcattgcctgattcagctctagctctagctcaacgcaacaaagacgattagttcttctgtatcagtgccaacttagatgagttaatggtaaactgttattttacaagtgatccctcaagttttttatttagggtccttttcattcttattcttatatattttatgttaccctacaatagaaatgacgagttgaccatgccagaatttctatttgagaaacaaataggctatgcttatgatgtttgtactttc

SEQ ID NO: 24078 - DNA, 2699 bp, Zea mays
  misc_feature (233)..(235): n is a, c, g, or t
cttttggaaagagggccaatcgggggcggggcctttttctgcttattacccccaactgggcgaaaaggggggaatttcctgcaaaggcgatttaaagtgggtaacgcacaagggtttttcccagtcccggacgttgtaaaaccgccggccagggaattttaaatacggctcactttaggggggatttggtaccggggccccccctcgagtttttttttttttttttttccctnnnttggttccgcggccccttctcgagttttttttttttttatttctggaaagagcctttagagcctttattatatcgtttcagaaaacactgttattgttttattgaaagggcgtttcttgtaccccgtacatggaaggatcggttatgccgtacgctgtatgattgtttctgtctcaccggctacaccaatcaagctgcttctgctagttgcctccgcagtcgctaccatgttgttaaggaactggttcaaatttacagatgcagtcgtatagactcccattgaagagtttttctgccaatcgctgattcttgaccatagcaagctttagagcatcacacttaaaacgggcattgaggttggtatgcagtgatcgccccatgccttctaaaattaacaaatctgcatcctttgcagcagcagcaagctctgagctaacctgccggaaatcaatacatggactgccgcatccattctcaacaaccattagtggcactgacactgtctcatccttgagatcatcttggatgccagccattgcatcgactatcaatccaccagcttctgcagctttccgaaggataccacagtgctttgaggcttcagctataacttctggaagttcattagcggtaacatcattcaaagccggcaacgaatttgcaacaagaactacctctgttccatggcgtaaaagctccctagctaaaggaagcattccaaggaccacatcagcacctgagttatcaacaaaaagcagtgctcttttgtatgattggtccttcctatcagtaagcattctctttttgaacatgtcaaagtcatcaatccgccaaggacgttgcatcttcttgcgactcatgcgatagatttctattatagttcccttgtgataaagttctacacaagctcgagacccccaatcaaatatatttgcagcaaggacaccttcaattagtgcaagcagcctagcttcctcattcatactatcaagttccatcagaagatccggtaaaacagccagtgaagcttcattttccctttgcttgatgctaatatatgcatcaacgaactgaaattccctcagacattcttctctcaattccaacaggttggccaaaccaaactttccataagcagctggctcctccatcaatctaaccttgccagatgagcagaaaaggcatgtgcaaatgcatcaccccgtcttttggcatcatcagtcccaccttcactagcaactgccttgtccacgaggtccggcgaatgatctgacaaaatcttgaaccagtacttgaactcatcctggtcaagatcaattgtgtttggttcatacgtctttggatcttccaacaatggaaatacatccaatgtgggtacaagatggagaacaccgacatttagcgctgcacttgcatctgaccgcaagatgtcacccttagcagtcggcctttcaaagcctcccatacctgtcgtagctggaactcccataggtacaggggctataatctgagtacccttttgcacaaacttctccatccatgatatcttctcattgagatctccaagaggtggcccgtgaatctttccaccaacatatggagcacccattgggaagcgttcaaccaaatgatgtacccttaagtcatcaagaccatgcttctcataactcataaatgcaccaagagctcctagaaagccctcatggcgcagaaacatagcttgtgcctctccttttgaccagaaatgcactgcaaaagaaattgtatccatagtgtaggcatgaccacggatgaagaatccaccaaaaaaatatcctcttgagtccataacgaagtgcattaagataggaaatctggccaatattatatgaaatcatccgtaacagagagagcgatatatcttcaggtctataatctgatagctccttgttttctgaaattatctttccaaaactagaggcaattgtagatgctgaaaggccaatcttggagtagtccagaccaccatatatgtctcctacaagcatgtccatggtgctattgtctccacgctggctcaactctagcaactcatcaaaacttttgcacttcgtcattagcctccccaatccccagtacgtaccaccaccaacatttgtcccacttactcgctgaaatttcccatgcccatcaaccttgattatactaacaccagatccgacattaacaagaaggaagggaaacaagtcattctgatcaatctgaacatattgcttctggccatccatgtgtgtaaaagcttcatgacgtatagccttaagcaaaaagtttgctccagccacaagacagtccatttcatcttccttttcaaggctgactcccaatctttccttgaagacatctgcatacttgaatgctccaccacctgttgccttaattacaaggggggggggggggggggggtgagctgtctctctctctcttc

SEQ ID NO: 24079 - DNA, 1215 bp, Zea mays
  misc_feature (46)..(46): n is a, c, g, or t
  misc_feature (1029)..(1033): n is a, c, g, or t
  misc_feature (1081)..(1085): n is a, c, g, or t
  misc_feature (1193)..(1197): n is a, c, g, or t
tagtggatcaactggtgtatgctgaagaaaaaatgcctcacatccnctcttgttttacatgtctcgtgactactgtgtcgtttattgatttattatagttgcccacatgcgaagactaataactgattcttagcatttgagtgatggcattgtcccggcagtgtctgaacaatttatggattgattcgagcatggcacaagaatgacaggatctttccaagattggttcgagtatgttactttcgccatggtaggctgctaactagttctggcttaaacacgaactccagttgctggctcaaacttttcccttcaatatttctggaaagagcctttagagcctttattatatcgtttcagaaaacactgttattgttttattgaaagggcgtttcttgtaccccgtacatggaaggatcggttatgccgtacgctgtatgattgtttctgtctcaccggctacaccaatcaagctgcttctgctagttgcctccgcagtcgctaccatgttgttaaggaactggttcaaatttacagatgcagtcgtatagactcccattgaagagtttttctgccaatcgctgattcttgaccatagcaagctttagagcatcacacttaaaacgggcattgaggttggtatgcagtgatcgccccatgccttctaaaattaacaaatctgcatcctttgcagcagcagcaagctctgagctaacctgccggaaatcaatacatggactgccgcatccattctcaacaaccattagtggcactgacactgtctcatccttgagatcatcttggatgccagccattgcatcgactatcaatccaccagcttctgcagctttccgaaggataccacagtgctttgaggcttcagctataacttctggaagttcattagcggtaacatcattcaaagccggcaacgaatttgcaacaagaactacctctgttccatggcgtaaaagctccctagctaaaggaagcattccaaggaccacatcagcacctgagttatcaacnnnnngcagtgctcttttgtatgattggtccttcctatcagtaagcattctcnnnnngaacatgtcaaagtcatcaatccgccaaggacgttgcatcttccctcgtgccgagcgatagatttctattatagttcccttgtgataaagttctaccaagctcgagannnnnaatcaaatatatttgcag

SEQ ID NO: 24080 - DNA, 1002 bp, Zea mays
gctggcgggacttatccgtgcaattcattccagtccagcgatccaatccaaagaagcctcctgctgtccacctcattccccatccgtccccgtgggaagcggggcaaagcgacgtacgctaccctttgcgtgcgcgtagcatttaaccaagcaactcccaatccccactcctccggtcctcccccaccatttcttccctctcgccttcccctccgccggcaatcccacgtccaatcagccgccgctccagccttccatccatccatcccgtagctgctctctattacgccagcgatcgagagaccaagaggagcaggagcgatggcgaggagctcgttcaagctggagcaccccttcgaaaggaggcaagctgaggctaaccgcatcagggagaagtaccccgatagaattcctgtcattgttgagaaggccgagaggagtgacatcccagacatcgacaagaaaaagtaccttgtccccgccgacctcacagtgggacagtttgtgtacgtggtgcggaagcgcatcaagctcagcgccgagaaggcgatcttcatcttcgtgaagaacaccctcccaccaacagctgccctgatgtctgccatctacgaggagaacaaggacgaggacgggttcctctacatgacctacagcggcgagaacacctttgggctgctatgagtggcgccacgccgccgtggatcgacgtcggacaatgcccctcctcctgtaaatacttaaaaaaaaataggcgtctcaagaatccgtgtacataataatctggcatgtcttgcatcaaaagcaactcgttgcgtccactgtctgttgaaactattgaagcgtactaaacatttaaagcaactcgaagaaaaaaaagtcagctctgggttgcttcagaagttctgtcacctgctgcgtcctccgtgagcttgtcgatgtggcaaagtaacacagggtgcctgtggtcatttcacccgttttggtacgagcatgttgctggct

SEQ ID NO: 24081 - DNA, 820 bp, Zea mays
cattgggaccctcgaggcccgcccgcccgccgggcaggtacccccgcctcccccaccatttcttccctctcgccttcccctccgccggcaatcccacgtccaatcagccgccgctccagccttccatccatccatcccgtagctgctctctattccgccagcgatcgagagaccaagaggagcaggagcgatggcgaggagctcgttcaagctggagcaccccttcgaaaggaggcaagctgaggctaaccgcatcagggagaagtaccccgatagaattcctgtcattgttgagaaggccgagaggagtgacatcccagacatcgacaagaaaaagtaccttgtccccgccgacctcacagtgggacagtttgtgtacgtggtgcggaagcgcatcaagctcagcgccgagaaggcgatcttcatcttcgtgaagaacaccctcccaccaacagctgccctgatgtctgccatctacgaggagaacaaggacgaggacgggttcctctacatgacctacagcggcgagaacacctttgggctgctatgagtggcgccgcaccgcgccgccgtggatcgacgtcggacaatgcccctcctcctgtaaatacttaaaaaaataggcgtctcaagaatccgtgtacataataatctggcatgtcttgcatcaaagcaactcgttgcgtccactgtctgttgaaactattgaagcgtactaaacatttaagcaactcgttgcgtccactgtcagctctgggttgcttcagaaggtctgtcacatgcaaaaaaacaaaacaaaaaaaaaaagcggcctccggcc

SEQ ID NO: 24082 - DNA, 848 bp, Zea mays
attgggtacctcaaggaaaccaagtctcgtcccacctatccccgtgggattgtgtagtgggaaggggtacgttagcgtttgcgtgcgcgtagcaactccccacgcaaagccgccgccgttccctctcgtcttccccagttcccctacgccggtaatcccacgtcctatcagccgccgatccagccttgcttccatccatccatccatccatctcgtcgcttctctctgttccgcgtgcgatcgagtagatcaaaaggaggaggaggatggcgaggagttcgttcaagttggagcaccccttcgaaaggaggcaagctgaggctaaccgcatcagggagaaataccctgacagaatccctgtcattgttgagaaggccgagaggagtgacatcccagacattgacaagaaaaagtaccttgttcctgccgacctcacagtcggacagtttgtgtatgtggtacggaagcggatcaagctcagcgctgagaaggcaatcttcatcttcgtaaagaacaccctcccaccaacagctgctctgatgtccgccatctacgaggagaacaaggacgaggacggcttcctctacatgacgtacagcggcgagaacaccttcgggctgttctgagtgggagccgctatggatccacattgggcaatgcctcctgtaaatactaaacatgcatcacaagaatctgtgtccatagcataatctggtctgtctgtcattacgcaacttgacgtgcaatgctaaacacatttaagtaataatatatactactctgctttgggatgcttcaaaaaaaaaaaaaaaaaaagcggccaaccttgttcctgcccgggcggccgc

SEQ ID NO: 24083 - DNA, 840 bp, Zea mays
ccggccgggattcgtcccaccgatccccgtgggccggcgtagtgggagggggtacgttagcgtttgcgtgcgcgtagcaactccccacgcaaagccgccgccgttccctctcgtcttccccagttcccctacgccggtaatcccacgtcctatcagccgccgatccagccttgcttccatccatccatccatccatccatccatctcgtcgcttctctctgttccgcgtgcgatcgagtagatcaaaaggaggaggaggatggcgaggagttcgttcaagttggagcaccccttcgaaaggaggcaagctgaggctaaccgcatcagggagaaataccctgacagaatccctgtcattgttgagaaggccgagaggagtgacatcccagacattgacaagaaaaagtaccttgttcctgccgacctcacagtcggacagtttgtgtatgtggtacggaagcggatcaagctaagcgctgagaaggcaatcttcatcttcgtaaagaacaccctcccaccaacagctgctctgatgtctgccatctacgaggagaacaaggacgaggacggcttcctctacatgacgtacagcggcgagaacaccttcgggctgttctgagtgggcgccgctatggatccacattgggcaatgcctcctgtaaatactaaacatgcatcacaagaatctgtgtccataacgtaatctggtctgtctgtctgtctgtctgtctgtcattacgcaacttgacgtgcaatgctaaacacatttaagtaataatatatactactctgctttgggatgcttcgaaaaaaaaaaaaaaaaaggcccctacggccccc

SEQ ID NO: 24084 - DNA, 1747 bp, Zea mays
ttttaaattccttttttttttttttttttttttttttgttttttttaggacacaaacgatactgacacaataggttaaaattaccagttgatacttgatacagaaacacctacagattttacacagctggagacaatagcatttcctcatctgagacaaagtccagcctttttgcaacacatcattgagtccaaaatgtcaccataactaaggttgtgatatccactaaaatagctagactaatcacttggccaccccttcaaatagatgttggatgcgttcctgaacatcctctggggtgtatttgatgaacaagtctcgggcagcttcaggagatgatctcaatctcccaattaagcctctatatgcaggcataacagaatccactatcgctgacttaacatctgctcgtagctgctcatctgcaatcacccaatctgactgcaccgcgcaaatctcctccaggtagctgttgaacatctgcatcttctgaagcatggattttgcagtgatactgccaacgccaggacctccggtctgcagcactgatatgacttttgcccaggccccacgctggtactccacactccacctgcgcaccctgctcattatctgcttcatccattcatcaccaagcaaaaccccaagctcactgtcattgaccttgtgaataatgtatttcccattattcatcaagaatatggaagcaagtggtggatccctgtatatctttgatttggtctccaaatttttgtgaagcacatccatgatccaagctatgtgcacagctagcgacgaagtagggcgatcagggtcgacagcaatagccgctgtgccaacagcacccaagtcaccttccatcacctcttccaatgtttgccgtgaaccacaagcagcacggagatagttcatgacataccgagtgataggatgtataccaccaccaggcacagcaacacgggctgggtcacggcggatgagattttccagctccatgaatatacccttgattgaggagccaagagtgttgcatacagctgatacctcagcacgtagagctgcagagtagggatcagagaagacaggatcgaggtcagaaaggaggtctcgtactgcttcatacatgtcaataacacggaagagccgttctggcgcgcggctggcagcagcaactgcatctccgaatgaaataagctgaagcgcctgggtgcgcacggcagcaacaaaggcaaggtcgccgtacggagcaaggccttcgaagacacgatcacagaggcggcgctcgctggggattaggatgcgaaacaccatcttgaaggctgggatccagcgagcaatgtcaaactcgagctcctcccatggtaaggagtggacctcgtcgaccgtacgggaacggatgccaaggcgagcgacgctctcgtcgatgaaaccgcggcgtgcggccgcgtatgcctcggcgcactcgcggccaaagccagcgtccaccatccgccgggcaatctggtgaacatcagagaccgagcccggcggaagagcatctataacgatgtcgaagtccgagaccggcctcgcgattgggattggctcgtcgccaaagccgtcatccgcgtcgtactcctcctccgccggcttcttcgccgcgggcttcttctcggccttgggcgccatcgatgcggggcgacttggagttcgggtttggaggcgggatggattgggaggaaatgcgagcagacgagttaccgtagtt

SEQ ID NO: 24085 - DNA, 1055 bp, Zea mays
ggcgggagcgaggaggtcggcaatcgattacgtgcgccagagaagctaaatctcggcaccgctctgccttcaagctcggttgccaacacaggagccccggaaaggcctgacaccggcgcaaccgacgacgacgattcggaagatagtggcagtgatggtgacatgcctgcgccggagctggaggaggagcatgaaaaccagcaggcttttaatgctgcacccggggagcagcagcaaagctatgatgctggagctgggggcgcggggggatatgaaacatatgcgtgggatccaaaccactatgcgcaacacggtgcttatggttgggatcctagtgccagtgcgaattatgaggatggaacacagtatgccgcatatgaaagagggcaaagtgcagggtatgttcatgcgcatggaggggagcatgccagtggatatgaccatgttgcggcagtgccatatggagtagattatactgctggaggttatggtcatgaggtagcagcgacattgccaccggtgcatgaaccgatactgccaccagagatgggtaggagtggagggaagagaggtagaaatgatacgccggtccagattttagaagtaaatcaagcagagctgatgaagaacagaccaaagcaggataagtctaagctcacggggttggccttcggtcctagttatcagcctgccccttcagcaaaaggaaagccatccaagttgcataaaaggaaacatcagattggttctctgtactttgacatgaagtcaaaggagatggagcttgcggagaggcgttctaagggcattcttacgaaagcagaaactcaagcaaaatatggctggtgaggagggatgtaaaagaactcaagatacctgtgtgggaggctgggagctgtagaattgagatgcgtgaatttttgttgcacattttgttgtaagagttacggactttgtaagttcaatcctgaacaaatagagaacaaatagttcaataacgagtcaatatttttaaacttgtgttacccattaagaatcacgctcacattcaattg

SEQ ID NO: 24086 - DNA, 1739 bp, Zea mays
gcatcggcccacccagccgcggccggcggcccacgccacgactcggcctcgtacggtcgggcccacgaccccgacccgagctgctctggcgccgtcttcctgttcccccgttacctttcctcccccggcgaccgaagccgccgcccagccacgccatggactctctcctcgccagctacgcctcttccgacgacgacgctgatgaggccccacctgctcctcctcctgctcattcccccgccatcgccacttcctccggtggcggcgcaggcgggtttttctcctcgctcccgcaacccaagtccgcccccgcaccgctcttctcctccctcccggcgcccaaatccacccccacgccgctcttctcctctctctcggcgcccaaatcctcccccgcccctaaccccaccttctcctctatcccgccgcccaagtcttccggaggaaaccctaagcgcgtcgtccagtatcgcccgcagccgatccggcagcccacaggcgacagctccgacgacgacgaggacgatcccaagaagcgccgcgcgagcaacaacgaggcgcgcttgccgcccgtgtctgctggctcgggtcccgtgtcctcgttcctcccgcctccgaagcactcgctcgggctcggcgccggctctggcgcgggagcgaggaggtcggcaatcgatacggctgcgccggagaagccaaatctcggcaccgctctgccttcaagctcggttgccaacacaggagccccggaaaggcctgacaccggcgcaaccgacgacgacgattcggaggatagtggcagtgagggtgacatgcctgcgccggagctggaggatgagcatgaaaaccagcaggcttttaatgccgcaaccggggagcagcagcaaagctatgatgctggagccgggagcactagtggatatgaaacatatgcgtgggatccaaaccactatgcgcaacacggtgcttatggttgggatcctagtgccagtgcgaattatgaggatggaacacagtatgccgcatatgaaagagggcaaagtgcagggtatgttcacgcgcatggaggggagcatgccagtggatatgaccatgttgcggcagttccatatggagtagattatactgctggaggttatggtcatgaggtagcagcgacattgccactggtgcatgaaccgatactgccaccagagatgggtaggagtggagggaagagaggtagaaatgatacgccggtccagattttagaagtaaatcaagcagagctgatgaagaacagaccaaagcaggataagtctaagctcacggggttggccttcggtcctagttatcagcctgccccttcagcaaaaggaaagccatccaagttgcataaaaggaaacatcagattggttctctgtactttgacatgaagtcaaaggagatggagcttgcggagaggcgttctaagggcattcttacgaaagcagaaactcaagcaaaatatggctggtgaggagggatgtaaaagaactcaggatacctgtgtgggagctgtagaattgtgatgcgtgaatttttgttgcacattttgttgtaagagttacagactttgtaagttcaatcctgaacaaatagagaacaaatagttcaataatgagtcaatatttttaaaaaaaaaaaaaaaaatgcggcccacgctcacattcaattgatgtgatctctgccaaaaaaaaaaaaaaaaaaaaaaaaaaaa

SEQ ID NO: 24087 - DNA, 1904 bp, Zea mays
  misc_feature (1858)..(1897): n is a, c, g, or t
tgggtggcgtactgaaattaaaattaaatttgcatttcggattccatatcttatttgctcgaacctgagaacatcgtatagtattggcaccgttttcatcccggccgggccggcgcgcgtcgccggcttctacgtttcttctccggcgaccgaagccaccgccccagcctcgccatgtggactctctcctcgccacctacgcctcttctgacgacgacgctgactccgacgaggccccgtccaccgcccccgccgcctcctccggtggccgcgccggcggactcttctcgctcccgcagcccaagtcagcccccgccctgctcttctcctccctcccggcgcccaaatccacccccgagccgctcttctcctctctctcggcgcccaaatccgccaacgcccccaccttctcctccatcccggcgcccaagacttccggaggaaaccctaagcgcgtcgtccagtaccgcccgcagccgatcctgcagtccgcaggcgacagctccgacgacgacgaggacgacgccaagaagcgccgcgccagcaacaacgaggcgagcttgccgcacgtgtctgctggcttggggcccgtgtcctcgttcctcccgccgccgaagcactcgctcgggctcggctccggctctggcgctggagccaggaggtcggcaatcgatacggctgcgccggagaagccaaatctcagcaacgccgtgccttcaagctcggttaccaatacaggagccccggaaaggcccagcactggcgcgtccgatgacgacgattcggaggatagcggcagtgagggcgacatgcctgcgccagagctggaggaggaacatcaggagcagccgagttttaatgctgcagctgcagagcagcagcaaggccatgatgctggagctgggagcactagtggatatggaacctatgcatgggatccaaactactatgcccaatacggtgcgaattatggctgggatcctagtgccagtgcaagttatgaggatggaacacagtatgccgcatatgaagaaggccaaagtggagggtatgctcattcgcacggaggagagcatggcagtggatacgagcatgttgcggcagtgccatatggggtagattatactggagggtatggtcatgaggtagcagcaacggcgttgccaccggtgcaagaaccagtactgccaccagagatgggtaggattggagggaagagaggtaggaatgatatgccggcccagattttagaggtaaatcaagcagagctgatgaagaacagaccgaagcaggataagtccaagctcactgggctggcctttggtcctagttatcagcctgccccttcagcaaaaggaaagccatcgaagttgcataaaaggaaacaccagattggttctctgtacttcgacatgaagtcgaaggagatggagcttgcagagaggcgctccaaaggcatccttacgaaagcagaaactcaagcaaaatatggctggtgagcatgtaagaaaaactcaggatacctatatgggatctgttgaattgaattggccgaggttttgttgcaactgttatggactttgtaaacccaatgcagaacagatagttcgatgatcagtcgattaatgagccaacacttgtgttaacccagctttccttttttctacttctactctcaacttgtattgtgatgttggtatgaatagtagtaaaagaatgctggtagtgtactagtatgtcactgtccatcccaatggcgataggaagtgttgtaaaaaaactgaagaggccagtgttataaaaaaacgcggaaatgctgcgtacaaaaaaaaaaaaaaaaaaaaaaaaaaaaaaaaannnnnnnnnnnnnnnnnnnnnnnnnnnnnnnnnnnnnnnngtgatta

SEQ ID NO: 24088 - DNA, 899 bp, Zea mays
gcagtttaatttgaggctggcttcaccattttgtattttgtcatgtcaccatgcatgcacggtagtttcacatttccaattttcattcgaccgctcacgcattacccaggtaatagtaatactaacccatgcaccactactacgtaactacgatttcctttctacaatctgctgccggtgaagtgcatgtgcctaatggagaaggctcagggtctccagcggcttgacggcggcatcgatcctccaatgggccaccgccgcaggcggcacagcaggtgccagaggctgcacgaacttgcagttggggcaggacggggaggacttgcacagcatgactaggagatggcagttggcgcacggcacggccaccatgctgcctccagagaacaaagtgccagcgggtttccttggctcgtcctcgtcgtcggaagcagcggcagcagcaccgttggcggcacagttgtcgatggcggcagccgtggagatgttgaggtccaggttcacgctctgcacctggggtctgacccagctcttcttcagcgtcttccggttgaggtaatacatcctcccagattggaggtcgaggcactgctcccagtcgagaggcagtgggtcgttgagctggagctccaggctcgcgggcggctgctgaggctcctcccagctggcggtgtagtgcttcctcttcttccgggaggttccgtcagactcggacgaggagctcttggcggccaggtcaccggcggcgaagcccggccacacagggccgagcgacagctccggctgcagctccattgtcttgtgcaagctcaggcaccgggcggcctcctgctggagcttcttcaccctgaggtactcggtgttcatggtcgcgtggcttgccgctcgcacctgcgcgt

SEQ ID NO: 24089 - DNA, 1671 bp, Zea mays
gcacgagaccattacctagaacatcctaatcgaaaaacgcagccgtgtgccgtacaccgtgcacgcacgccgctcctcgcctccctgcaccatggacgccggcgagtgctccacctccaaaccccctcagccctctgccgcctccccgtcctcccccaccgtatgggctaggctggtgcccgccgattccgcgtgcccgacggtggaggtggccgaagacgactccgtggtctgctccctcgttgcgccgccctgcggcggggaggaggtcgcgtggtgcgagatcaggcggaatgccggggacgcgtcgtccgccactattcggaaccttagctcggatgcaattattgttgatggaagaattgtcgaacaagaatgcgtagacatcaaaccaggcagtgagattgtctctggaccccagaaagaagggcatttaatatatacatttgaaattacagaggcagaggatcaaaaaaaaaaaatgtcaagattgttctagatatcgagaatgcaaaatgcagcatatgcctgaatttgtggcatgatgttgttactgttgctccatgcctgcacaacttctgcaatggatgtttctcagagtggttaaggaggtcttcatctaattcacgtgataaaagccagagcgctgcatgcccacaatgtaggacaacagttcaatcagttggaaggaatcacttcctgcataatattgaagaggctatattgcaagctttttcctcactacagagatctgatgaggagattgcgttgttagagtcgtatgcttcagttaagtcgaatatggttttgggtcaacagaaaaaccaatcaaggaaaagacgtttttcacgttctagtgatgataccgacaattcagatctaccatgtcctcaatgccgtaatgaatttggtggatttagatgcagcccaggatctgtgcacttgcaatgcagtggatgtggaggaatgatgccagccagatctaacatcagtataccacaaaaatgcttggggtgtgataaagcgttttgtggggcttattggtattcgcaaggtgtgagttcaagtcattgcaatctgatctgcaaccaggatactttgaagagtatttatcagcgacatatctctgcacttcctgacacaattcatgggggcaatccatatgaaaaagatattacagaaagatgtatacagcaatcaggcaaaacattgcaagttgtaatctcagagtggatatcaaaatttgacaacatggaaattgatcgttcaaggttgcaattgaataatgtggatgcaattacttccaggacatatatctgcaaccattgctacagcaagtttgttgatttcctgctctactggttccgtgtatcattgccccaaaatcttcttccacgtgatgctgcggagagggagagctgctggtacggtttcatgtgccgcacccagcaccatcggcctgaccacgccaagaagctgaaccacgtgtgtcgcccgacaagaggcaaccagccctagtgagacttgactgtttctgtcaccattgtcatcaccatccattgtatgtgtgtgtcatcaaaatggtcaggaagtgtggcgcgtccatgtttggaaccctttttggtttgatcctggctggacctgacaaggaaattaaaaaaaaaaaaaaaa

SEQ ID NO: 24090 - DNA, 1803 bp, Zea mays
ccggccggagagccctcttcttgccccctacgcagccgcgtgtgccactgtgccgtacaccgtgcacgcacaccgctcctcgcctccctgcaccatggacgccggcgagtgctccacctccaaacctcctcagccctctgccgcctccccgtcctcccccaccgtatgggctaggctggtgcccgccgattctgcgtgcccgacggtggaggtggccgaagacgactccgtggtctgctccctcgttgcgccgccctgcggcggggaggaggtcgcgtggtgcgagatcaggcggaatgccggggacgcgtcgttcgccactattcggaaccttagcttggatgcaattattgttgatggaagaattgtcaaacaagaatgcgtaggcatcaaaccaggcagtgagattgtctctggaccccagaaagaagggcatttaatatatacatttgaaattacagaggcagaggatcatgaaaaaaagaatgtcaagattgttctagatatcgagaatgcaaaatgcagcatatgcctgaatttgtcgcatgatgttgttactgttgctccatgcctgcacaacttctgcaatggatgtttctcagagtggttaaggaggtcttcatctaattcacgtgataaaagccagagcgctgcatgcccacaatgtaggacaacagttcaatcagttggaaggaatcacttcctgcataatattgaagaggctatattgcaagctttttcctcactacagaggtctgatgaggagattgcgttgttagagtcatatgcttcagttaagtcgaatatggttttgggtcaacagaaaaaccaatcaaggaaaagacgtttttcacgttctagtgatgataccgacaattcggatctaccatgtcctcaatgccgtaatgaatttggtggatttagatgcagcccaggatctgtgcacttgcaatgcagtggatgtggaggaatgatgccagccagatctaacatcagtataccacaaaaatgcttggggtgtgataaagcgttttgtggggcttattggtattcgcaaggtgtgagttcaagtcattgcaatctgatctgcaaccaggatactttgaagagtatttctcagcgacatatctctgcacttcctgacacaattcatgggggcaatccatatgaaaaagatattacagaaagatgtatacagcaatcaggcaaaacattgcaagttgtaatctcagagtggatatcaaaatttgacaacatggaaattgatcgttcaaggttgcaattgaataatgtggatgcaattacttccaggacatatatctgcaaccattgctacagcaagtttgttgatttcctgctctactggttccgtgtatcattgccccaaaatcttcttccacgagatgctgcggagagggagagctgctggtacggcttcatgtgccgcacccagcaccatcggcctgaccacgccaagaagctgaaccacgtgtgtcgcccgacaagaggcaaccagccctagcctccggcacaaagtagaaccacatgtaacgatgtcacgtgagacttgactgtttctgtgaccattgtcatcaccatccattgtatgtgtgtgtcatcaaaatggtcaggaagtgtggcgtccatgtttggaaccctttttggtttgatcctggctggacctgacaaggaaattatattgctgctggtgccggaaccgccgctctgtcggcaggtcgggggggatggttgaattgaatgaaaataccccaggctagtttcacaaaaaaaaaaaaaaaaaaa

SEQ ID NO: 24091 - DNA, 1304 bp, Zea mays
ttttttttttttttttgaaattccaacatgtgtgcttatattaatcaggccgcaaagccttatgcaggacacagcttagcaaagggctaaacgttacagatcagaaccaaactaccatccagaagccaaataaaatgtgcgaattgcagtttcccttcgtttgacatccctaaactagtagtaaaatctggattgatcagcataaacctttgagaatacaaaattctgtcattccaagatcagagtgatttgcaaacacttcggctcaaaaaaaagcgtgaatgatgactagaaaacatatactagtaagcacaaccaaatactgctccaaagaggtcgtcactgaatagctaaattaaacggttctcctggtccaatttctgcaactcgagggggaaaagaactggcaccgtgaggcagtgccgcagtgccgatcacttaatttgcttttgtcaactctggatctcttttaatgtgatcaagtatgaggagcctggggccaggcgggatcttcacatctctgagagcactgtccgtaagaaggggcaaggtttgatcagttaggagacccttcttgaagttcttctcatagttctgaaggcctaacttttgcagcatgcttcttccacgagaatagtatgtatctccactctgtggctgtgaaaatttttgagagatcatgaaaaaaccaccttgaaatacagcaaaaccaacaccagttgtaattgcattagctactggatttggggtccccattccactcacgatggagaatagagccccagaaccaaaagctgctgccatgctgccctggacatcctccactcctcttatccttctcatgacacaagatatgccagcattcgcaccagtcatgaccgcaaagtttcgtgcttgcaccaggggtccacccgctaaagcctgcgcttgcttgaaggaggccaagacctttgggtcggtccccggcggcggcggcggcacagggagcgcggccccgccgtcgggcgcaagcgtgcccatgagcccgccgagcgcggcgccctgcacggcgccgaccgccgtgaccacggcggcctcgacgtgggtgggctgcttcgctagccacgcccgcacgccggcctccagcgacctgacgcggtcggtccactccgccagtgggttggtcatgcccatgccccgcgctgctgccacctgcgacgatgaggatgccatcaccgtcagcggccgccgcttctggcccgccttttccatctagccgaccaagaactctcgccgcctctcctcggtgcttcgcgtcgcttgtg

SEQ ID NO: 24092 - DNA, 2138 bp, Zea mays
tatcaatttatttttttaaaattttaatatatattccataccttgttacataggttcagagcttaacaaaggtgcatcacaggaatctagtgtccttgattggttactgctgggaaaaagatcatttggcactggtttatgagtacatgtctcagggcagtctttttgatcatctgagaggtttgtctatggaaagtctattgagtattgatttaggcataaccagctacgttgccgttttcaaattgcttttgaaatatccatgcatggtttggatctgagaaactatcttgactgacttatatatagattctggtatcgggaaaaaaggcctttttgggggtacctatcttcctacttaagtgcctaatccttcctgacagaatggttgcgaaatatttgtcagaatcctgcttgtatcgtcaatccatcttaacatttcacatttgggatggggtgactggatgctgtgagctacaagtctataaccaattaccttaaaaccccaccacttgcctacactttatttttttgacttaatgacttcagctaatgtgtatgttaaaggatcggttttactttggttattaacttattaactatatattgcaattccgttatagaagatcataacagaactaggaaaaggaaaatttccataaaatttactgaaactgacacgtcaagctgttaaactgttctgttatgctaaaacattgaaggtaaaaatggtgtttcccaagccttgaattggaggaaacgtgtgcaagtagtgcttgaagctgcacaaggtatgccgcaataaaagcccatgaaaaaaaaaactggagttaagcaaatccttcatatgatcatttactgttattctcttcttttttggaatttcctgtgatatataaaggcctggattatctgcacaagggttgcagtttgccaatagtccaccgtgatgtgaagaccaacaacattctcctgggtcaaaatctgcaagctaaaatagcagattttggactttccaagacatatttgagcgatacacaaactcacatatcagtcactccagctggcacagctggttacatggaccctgagtatgtcttatctttccgtgtgtattatatttaacattttggtatttttttcatgtagcttatttttggatgagtgctaaatgaaagagtaaaactcgccttaatacaggcaacatagtttccttttttccgtttgtattctattaacattttggtatttttggatgagtgctaaaatgtgttttgcgagtgcgcatgtagcgaagcttgagtttgagtgaggcgtcgttgccagctgctggtgcctggtatgaagtgcttctcttgtgacttcttgtcgctgtttcttcaggtactacctgaccggaaggctcagtgagagcagcgacgtgttcagcttcggagttgttctgcttgaggtagccacaggcgagtccccgacagtgccaggccaaggtcacatcattcagcgcgttaaacagaagattgccactggcaacgttggctcgatcgctgattcgcgacttggaagcgcctacgacatcagctccatgtcgaaggtaatcgacaccgctgtgatgtgcacggcggactctactgctcagaggccaacgatggccacagttgtgatacagctgaaggagagcctggcgttggaggaaactcgtgaaaagggcagtagcaacagggtgagccgagggagtgatgtagaagctatggcgtccacacttggtccattcgcaagatgaagctgtgcctgtacctggattcagttcatggttgacgctcgtgaactccttgtcatgtgaagacaactagtagcgtataattgtgggctgttttgaaccagcaattgcttgtgtgtgtatggactttgacaaagatttggtgtgagcttgcagcttctccagaatccagatgtcatgctctgtatgtatctttgacaaagatttcccgtgtctatatataactgcatggtactaataacataaaggattgactttgtttgaagcgagggatcgagaaattgagcgtgagccgtcccattccaccgtgcacagccctattcaatttccaacagctttccttagatattccattgccacc

SEQ ID NO: 24093 - DNA, 1911 bp, Zea mays
ctgcatagaattttttttcccaataaacgctagcattttttttttttttttgctaacaaaccggcactattatgccgattgccgaccgtccgtaaaagtcagtttagtgtccaggtttagcgtacaaaaggttttttcgttctctttctctacacctcaatcatattgtatcgccattcacagcacggtaaaagtcacgtctactgatctacatggcagcagcattattgtcgtgagacatcctcttcttgtacacgtaaacgcgcgagacgatgatgaaagcagccaactccacggcgcagagcccggcgagcagccagtagaagtagtcgaggtgcgcgcgattgaggttgttggagaaccagctcgctccgctcttcttggtggcaccgtcgatggcggagatgatgaagctgctgaacaagtgtcctacgccgaagatgctgagaaagaaggccagcccgaggctgcgcagcgcgtcggggacctggtcgtagaagaactcctgcaggccgatcatggcgaacacgtcggagagcccgaacagcacgtactgcgggaccatccaccacaggctcatcggcagcgccgccttgggctggtccacgagaccggcgtccctcgccacggcgagccgccgcatctccaccagcgccgccacgaccatggcaaccagggccaggacgagccccgtgccgatccgctgcagcatggtgataccggacgagaggcgcgtaagccgccgcgcaaggggcacgaacgcgcggtcgtagaccgggatgaaggccatgatggtcacactgatgaacgtctgcagcgccgccggcggcacgcgcagagtcgagccgacccgccggtccagcgtcgcggcctgcttcgtgaagaacgtggacgactgcgagaagatgacggcgtagatgatgcacgtcgcccagatggggaacaggcgcagcacgcctttcacttcttcacggtgcccggcgtcgtcgctcgcaagagtgccgtcatgttgtctcgatttggagcctttgatgagcgcaacgaaagctgtggcgaggcgagcaaatgggctcgattcagtagacgtgtagtagcggtaattcctggtaccgagcaagaacatgaggagcgcgaagagcatgacgaggcaggggacgccgaagccgaggccccagccgacgttgtcctggatgtagctggacaccagggtggtgacggcggtgccggagcacatgccgaagtaccaccagttgaagaaggagctcctggacgcggactccttggggtcgttctggtcgaactggtccgcgccgaacgcctgcgcgcagggcttgtgcccggcctccgcgagcgccaccaggtacagggagacgtagaagacgcccacttgcacggggggcggggagcaggccagcggtctggaggcggaggcgtagctgctgcagccgtcgtggtggaacgccgggagcgcggagacggtcagcatgcccatgctcacgacgaagaggagggaggcgaggacgatggtgcggtaccgcccgagccaggcgtcggccacacacgccatcagcagcggcagcatggtcgccaccccgctccacgcgttgatcgcagccgccgcgcccgcggtggattccccgagcggccccgtcaggtagctgatcaggttcgccgacaccccgtggtacgcgaacctctccgctatctccaccccgaggacgaacatcgcggcggaccatcggccggtgccggaccgggacgcggggcgcccgcggaagtccaccgcgccggcgacggcgccgtcggagcagggcaggaggagagtgttggcgtccattgccgcgccccccctgcgccacagctacgcgcgtgtgtgtgtctggtccgcggccggcctcgaggtacccaatg

SEQ ID NO: 24094 - DNA, 2281 bp, Zea mays
  misc_feature (2256)..(2256): n is a, c, g, or t
cgacgggagttaaataaagcccgtgggctggaattgagccgacgggagttatctaattcccgtcggcccgagctcgggccgacgggaattaaaatggccgacgggaatcttcctaattcctgtagtgtaaataatccatcttaaataagttgttagttaaacaaacaacacagattatcaagtagattatgataacccataagtagatcaataggtgcttatataatttataagatggattatataatcctagaaggaaataaacaagaatttaatggcttaatcttcatgcctaaaacgtcgtgatctaaaaattcgcaaaaaaaaaggtacaaaagggtcacgaaactcgtcttgctgttaaattttgaatgaaataatgaactattaatgccatgggaatatatcatgggctggcactggcagcttaccaaggcttgtaaggttgtgtttctttcctcatagattatataagttaaattatgattcctagattatataagttgaattacgataaaatgatagaaagataaaacatcactatatgattataaataagtcaaaataagctaatattggtagcatattttctagcttatttgtggttaaaataagctaatattggtagcttactttccaccataatctaacttatataatctaagagggaaataaacatggcctaagtagagaattatacgagttttcatgctcagtgaatgtttgcatctcaagcacacaggatttataatgacaatgcatgtataagtcaatataatcgcgcacagtttcaagacgactagatactaggttatcatttttctgttctacaaaagctggtgcctatcattctgatccatcagggaagcgttcaagggcattctgtttcccgttaacataaaattcaatcactgctttcatgcgatccgacttatctggatggtagttcaaatgcacaaccaccggcttcaaattccgcagataagcatctttcctcaccgtcttgaagagaactttactgttcatgaagaggtagatatccatggttcttttggatgcatgaagaccttcataaccaggatgtgagggaaaaaacagctcctcattgaaaactgcttggtcccatgatttgggctcgtgagaaaggcgataagcaaccctgtcaagaagctcaatcgaaggaatcgtcggccttatgaagaagaatccagaattataaacccatatgcgcattgtatgtgcatatcttgcccagcccattgaaggctcatcgaacacatcgttgaatccataagctgtcatgttgttgtggccatcactcattgattctacgtcagaatctctgtaaagataatcaaatggattttggaagaaaatgatatcaatatcagagagcagaacactgtatccgagctgcaaaaactccctcaatatgcggaacttgagtccagaaacagcgtggtttccgcctgtcttgccaatattgtcgatgccatcatctggatcgcgtcggtaaactgggacatcattggacttgcagaagttctctatgctgtcatccaatgcaactactaaataatttgaaatcccagctcgttttatgttagtgaaccacatctcaagcatctctttcacattagaatttgccaatgcaactatcagttctttcttcacagcaacctgttccaatatgttggccaatctgggattgatggataaatcaggagtaactgttggatttgttctcagagctttcactgtaccaaatggaccagccttatacagggcctcatttttcccttgtccggccaattgaagcttcattgacaattcattgatctgcttcttgaattcagcatttttcctttccaacaataccagacgtgactttagtttggcaacttcccgagatgtatcacaggcaactgattcaacccgtcgcggccaatggatggcggagtcaggggcacggtggaagaggccgtctgggtagagaaacgcgcacaggcagccgagcgcgacgccgaccacgaccgccgcggcgatgcgggaccctcgggacagcggtggccccgccccgccaccgcgcatcaggggcgactcgcgccggccggccatctcccacggcgaggcctctgtccgccgcgccgcgggaacgagatcctcggttcctttctcgtctccccggggagaagtttgggcgaagtcgtgagcgtgacggtgacgctcgatgttttgtcgtcgtgcttgaaaatncccggcccggccggccctcgaggta

SEQ ID NO: 24095 - DNA, 1559 bp, Zea mays
gttttttttttttttttttaatgcaaacaatcttattcgcgcaatgaatgacccgtaaacagtggcatcactaaccagagaagttacagaaatccaggcccacttcctttacaatcgatgacccgcaacaacgccatcagtacagagaccggacgcctcatttactgaaaccacagaagctccttccatcgtgcaaaaccagaagatatactggcataacactgctatggaaaaatctgaacagtacgtgctaatggctaatattaagaccttccatctcgttcaccacatcatcagctaacctggcccgcagagatccaaggcaattttcgaatccttcaagggctgcaaaggtgctctcaggtgcgccaccgaggttccctatttccttgcgcatcccgttgatgccattgtacagtctttttatagcgagctccatctcagacgagtcttgtggtgggtatacagaagccccaagatcgttgacctggtctgcgatctccttgcagtggctcagcaatttctccattggctcaactctgtcctcattagcaccatctttgtctttgttaccagagctcctgagcaaaccagtaatgaaacgaattgcctctttcactacaaccaaggaatcagataccacgttaataaccaacttggcaacagcaacctcttcttcagtgaactcatcctcgtcgtcgtcatcatcatctaaatcaagatcagacctctcatctctatcagaacaactcgttgtgtcgacaacaccattggaagacttctcagcagtactatcaccagaaccaccaatagggagctcattcatttctcggagaacatctttcagacacacacctatcctggtcatggctcgtcctatggcaatgcagtttgatgcaggcaccttcttgagagcagcacaagcttcccatacagttcctgtgacctggggtatagttgtgttgcggtcagagctgcgagattcataagcagagacagcatgcttgaacaatgagaagctagagtcaaccacgtcttttgcagacccaaagatggacttgtgtagagtaggcccagcaccgaccatgcttccgtggcaaaccaaaagaaatccctgtaggatgttgaaataagcaacgatgttctctttgagggtctctacatcaggcaagtcaccgctccagagcattccagcgacggtggcctgcctggagacctggtcgccgagcttaacgacctcagaccactccgtccgctccaaggcccccggagccgactccgccatcatctggaaggtgtcgctaatggtctggagatgcgactccaggaagcgggacagctcgccgccgcccgctgctttcttcgctcgtcctactttcttcgacatggcgagggcccttgtggtgcgtcgcgttggggctgggaagatgagggcggcgcgagcggcgcggaggatccgaccgggacaggaggcggcagcggcggcgcggggtttatgcgcggttagggctggagcatctggacgatgacgtcggagttgcgcgagccgtataaggaac

SEQ ID NO: 24096 - DNA, 1486 bp, Zea mays
gggaataaaagggctggttgtcgttgtttttcttttcaagatatcatatcatatattatgatctgtagctttaagctgcgacattacaaacaatatactcaataacatacacaatgtcacgtcttcaaaatccagtgaaagaacggacaacaaatttaaacaatatattggaatctaaaatgtatctcttttcctgtgaagtacaaacagcgctaccttctcagcattctgaatgatggcatgtcttgaatgcgagaaatacctccgatagtaagctcttgctctaactgaccccgtgtagacttcagaacctcattgaattccatataactcgctcgccttgcaagccattgagaatcaagcacctgaaatgctacacagaaaaggttatcgaaagccacaccgtcatcatcgagtagttgaacaaagtgaacaccagcttttgttctcatttttcctgactgtaaatccagcatttgaactaacatataggatatgtttacgccgcctactgcaaaaggatactcccattcagctctcttaccatctgctttatgcagtagcctgtgaaaggaatctgggtaatttctggcaaaatatattagattctccaaggacatgaacccagctgctctaaaatctgtggatggatcggagttctgccagcccatctccttccagagatctgacttcagaggaggaagttgtctgttagggtaagccaacttccaaagttctttcagggcatcctgatgcttgacagaggagcagtcatatggcacatctatcctttgtctcaacaatcttaacctttcttcctgtaatggactgaggttaactggaagtgtctgtccattttgtgaacttttggaagcagaagagcaaccaaagagtcttgctagcaaatatccaaattcagaaagaacatttactatgtttcttgcagattgagcaacaaaagctgctaaaagatgtgtccaacgaagacactcctgtgccgtcccatcccagaaacctgaccgtgtaataggctcatatgtcttggatttctcttcctgaggagtgtttcctagaagaggttctgttacaggatctgacagtgctgtatccatttgtttttcccctgttgtatcagtctcagcgctgataggccttctttttatagcttttgaggccatcctagccggttgtatgaatcatgcctcgccgatcgagagaccgaagcggatttggggcccgatttccagtctccgcgcttcctcttcccctccttccgcgtgaggtggcgaggtccgaggagggagatgacagaggaggctgggcgtcagcgattcagagatcccgcacctgcactgcactgcaccgcacgacatctgctgcgctcacggcattttttttcttcttctggggtgtttgtacaaatatgttgcgagacacgttcttggcttcgacgagggaggcgagcactgcacgagcccggccggcc

SEQ ID NO: 24097 - DNA, 1510 bp, Zea mays
ttttttttttttttgtgataataacccaacatttttttatttagccggtgcctcctcagctaagcacctggtactgctttgcacaatgtacgctgaaccccttttcagtttttcaatgaatacctttacagcagaaagacaaacaagaagtcttgaatgccagggaatgattggatgtatgctaaatcaaacgggctaattttccggcagttatgagaatttcattctcaagtcacggctccaaatcattgagaacggacgccttggattaagattgccaacatacagatctctacaatgtgatcttgagaacctatgaaagcattttaaaaaaaaaactatggaagggcgtcgtttattgcaacaaattcttccctgcttgatttagagacagaaaataccgcttctgacagatttttcatgactggttgcgactaagcatattctggaaagaaatgtacaagtctctgtgttctgttccaaaaatctcttctgcttttgacagggtgtcctcccgtgattgtttttgagcattgaactccttgatgttggccaaaaacgctccaaattgctcataagaaagtcttgcccgtgcttgtcggaagaattccttcccatctatacgtggccgccctgtgaatgagtggcgttgaggagaggtaggtgctgaatactgatgacttgatgatccttgccatgacgaaaatgtcaattggccctcagatcgagcttttgtaggagaagtcggaccagagaagaagttgggagagggtgggccagttgaataagctcggggagaaccactagaagacgaaatcataggtgttgagccaggagttaattttggaggcacatatggtttgattgagaactggtatcctccaccatggatggattcagttattgtagatctgatggaggtatctgaagaagtgttactgctacaaacttcatctttccaatacgggactcgagctgtcaaattatcttctccgttgtgatcttgactggtttcagacagttgcaatagattatcttcacttaacgatttcatcagttgtttcttaaaagcctccaacttcgccaaattcctggtcagctttttggtcgtcgcggcgagcgagtccctttccttcgctagcttcgcgttctcgtcgagagcggcggccaggcgcgcgtcggagtcggcgaggcgggcacggagctcggcctcggcgtggtcgcggtcggctaggtcacggcggaggcgcgcagcgtcggcctcgaggcgggagacgcgggaggtgatggccatggaggtgatcttgcgcgccacgtccagttgctcgtacgggtcggtggggatcacggccaggatctcgtcgggaaggtgaaagtctacgcccggcgcggccgccgacgcctcgtacctcgccatcgccggcgacggggcacgggcgggtacctacctgggtgggtcacttcttggtggcgctggcgctggtccccggcgtcggggaagaataggagt

SEQ ID NO: 24098 - DNA, 1591 bp, Zea mays
tttttggaagaaaaagctctataaaaaatcacaatcacagtttatcgaacatctcaatacaacgaatgcaccgtgatcatatatccattccgtgtacccttggcagttagaagaacggcaaagggcagttttatacagctttctacaaagggaactagggaaggcaccttaatagctcaagagatctgcatccggatttacagcagaaagacaagcaggaagccttgaatttcagggaatgagtgaatgtatgctatgcgatttccgcttttaagtcacagctccaaattattgagaaggaacacctcgaattaaggtggcctatatacatatctctacaatgtgatctttgagaacctacggaaggacatcgtttattccaacagaatctaccctgcttgattttgagagaaaatactacttctgacaaattttcatgattagtttcggttaagcatattctggaaagaaatgtacagatcattgtgttctgttccaaaaatctcttctgcttttgacagggtgtcctcccgtgattgtttctgagcattgaactccttgatattggccaaaaatgctccaaattgctcatacgaaagtcttgtccgtgcttgtcggaagaattccttcccatctatacgtggccgccctgtgaatgagtggcgttggggaggagaggtaggtgctgaatactgatgacttgatgatccttgccatgatgaaaatgccaattggccctcagatcgagcttttgcaggtgaagtcggaccagataagaacttgggagagggtgggccagttgaataagctcggggagaaccactagaggacgaaatcatagttgttgagccaggagttaattttggaggcatatatggtgtgatcgagaactggtatcctccgtcatggacggattcagtaattgtagatctgctggaggcatctgaagaagtgttactgctcgaaacttcatctttccaaaatgggactcgagctgtcaaatcttctgcgttgtgatcttgactggtttcagacagttgcaatagattatcttcacttaatgatttcatcaattgtttcttaaaagcctccaacttcgccaaattcctggtcagctttttgaccgtcgccgcgagcgagtccctttccttcgccagcttcgcgttctcgtcgagagcggcggcaggcgcgcgtcggagtcggcgaggcaggcgcggaggtcggcctcggcgcggtcacggtcggcgaggtcacggcggaggcgcgcagcgtcggcctcgaggcgggagacgcgggaggcgatggccatggaggtgatcttgcgcgccacgtccagctgctcgtacgggtcggtggggatcacggccaggatctcgtcgggaaggtggaagtcgacgcccggcgcggccgcggccgccgcctcgttcctcgccatctccgccgccgggggacgggcgggtggctggcctgggtggatcaactcttggtggcgctgccgaagtggtccccggcatcggggaagaaatgaagaataggagtggaaattaaaatattttaaaaaaattctttacggacgcggacatgtggtttt

SEQ ID NO: 24099 - DNA, 2442 bp, Zea mays
  misc_feature (34)..(34): n is a, c, g, or t
ccttgatgaggagattaggttaggggacaggagncagagagggaggaagcgtttacaggacgggaaagaagtcgtcagaggatcagacagtggtccggccggtcacaaaccccaaatctgacagcgagacagacactactagattcgttcagctgtacaacaccaattgcaacttttttttttttttttgttagagcaaggcaaacctgcatgcattaggtatacgaagcactctcttatggcattagacagagagagagagagagagagagagaggatatcaagccaaaaacttggaagaaacatacatgtaccagacatactagataaaatgtacagacgaggtgactgacaaacgcatacacgactagagtcatggatgatgatggatctcggacgatacgtactaagcagtgacagaaattacaagctagcatgcacaaggtactacttactaactagtagtagatgagagagattcccgtttgtcaacttaatctgcagcatgtgttttgtcccactagtcccaaccaagcagtcccaggctcccagctcccaacgccaaccaagatgacgagggctcgtcttggccgccggagcgagctgcagctacctcctcctcatggcttgcccttgtgctgtgtgtagatgtagtcgaggtgcgcgttctggagcagccgtctctgcatgcaaccgtcgtcctcgtcgtcgtccgcctcgcacgccactgcaccctcctccacctccgccgccatcatctgcagaatagcagatatatagcatgcatggaatggaagaaatgagctttgatttgtatacatagtccacggggcaaaggcacagggctcaggctagatgctatgtgcgaattcagtagtttttccccccttctcacacctcatctccggagatggacagctcgtcgccgttgcccacgccaccttcctgcagcgccaggccgccgtatgcagcggcagcggcagccgtgacgccagtttctgcagacgacatggccagttcagagacgttaggacgagcagctaaggtgtacgcaacgctggtacgaaggacgatcgatcagcaaagaggttagagccgagtagtgaagacgtatatatgtacctcggtgaaccaactgagctgggacaggagaaggcggcaggaggcgagccgctgctgagtagtggaagaaacagacgaggaggaggagcagggcagcagccgcgagcggcaagggcatgctgcagctgcgccgcctcatctctgccgccgtgccgggccggttgatgaactgctgaaaactagtgctgctgctgcgctagctgtcgaaggacgagagagagagaggggggctgtgtacgagttggatggagttcgtagtgagcgagcgagtgctggatggctgatgattgatgcctcagttggtggcctgcctcgaggtacccactgatggtgccggctgccgtatttataatgcgaaagctgccaccacctagcctgcgagtcgtcacgcgcgcgcgtagatatttggagtttgaatacttttttttctgaatagaacgtatcgttcggccaaattcgtcgaccactccagcagacttcctcgctgtatccgtatttaatttagcacgactaacaacactatacaatgagaccgtacatccgtctccttttcgagcagacttcacatcctactctatatctctatttttttttcatgaaggagtgagacatcaaatggatgggggagtctaaacgtgcaacacacattttacacggccttatacgaattctattggagttggtcttgataaaatggggatatacggccacatacggaggctattggagttggtcttgataaaacatggaaaagacctctgcctgagttggggttggatgtctctgatcctaaattctttttgatctttctaagtcagtgtttcgattgagcttcttattaatataataatatggtgcagtctttctcttaccgaccgagttatttcagtttaatgaaacatgaatatcctaacatgcaatagaaatatcccagctttataaacatgttccggttctttcttcaatataaaaaacattcaaccacaattgtcccaagatgactatcactaccggaattcggctttttgtcgagtgctcggcgctttgtcgagtgctttctatcggacactcagcaaagtcctgttctcggtaacgaccgcgtttaccgagagcaggactctcggcacagaaatacattcggcaaagaaatctttgccgggtgcagaacactcggcgaatgacggcgctcggcaaagggtcatcagcagccgtccatagctgacggtcgttatctttgccgagcgccaagctttggtactcagcaaataagcttctttgccgagtgtttttcatcggacactcggcacagtgcgcttgccg

SEQ ID NO: 24100 - DNA, 948 bp, Zea mays
tccaccgcggtggcggccgcccttttttttttttttttttttttttttttggaagaaacatacatgtaccagacatactagataaaatgtacagacgaggtgactgacaaacgcatacacgactagagtcatggatgatgatggatctcggacgatacgtactaagcagtgacagaaattacaagctagcatgcacaaggtactacttactaactagtagtagatgagagagattcccgtttgtcaacttaatctgcagcatgtgttttgtcccactagtcccaaccaagcagtcccaggctcccagctcccaacgccaaccaagatgacgagggctcgtcttggccgccggagcgagctgcagctacctcctcctcatggcttgcccttgtgctgtgtgtagatgtagtcgaggtgcgcgttctggagcagccgtctctgcatgcaaccgtcgtcctcgtcgtcgtccgcctcgcacgccactgcaccctcctccacctccgccgccatcatctcatctccggagatggacagctcgtcgccgttgcccacgccaccttcctgcagcgccaggccgccgtatgcagcggcagcggcagccgtgacgccagtttctcggtgaaccaactgagctgggacaggagaaggcggcaggaggcgagccgctgctgagtagtggaagaaacagacgaggaggaggagcagggcagcagccgcgagcggcaagggcatgctgcagctgcgccgcctcatctctgccgccgtgccgggccggttgatgaactgctgaaaactagtgctgctgctgcgctagctgtcgaaggacgagagagagagaggggggctgtgtacgagttggatggagttcgtagtgagcgagcgagtgctggatggctgatgattgatgcctcagttggtgccttggtccggccccgcccggccccgagg

SEQ ID NO: 24101 - DNA, 942 bp, Zea mays
  misc_feature (46)..(80): n is a, c, g, or t
  misc_feature (89)..(93): n is a, c, g, or t
ggcaaacctgcatgcattaggtatacgaagcactctcttatggcannnnnnnnnnnnnnnnnnnnnnnnnnnnnnnnnnnatcaagccnnnnncttggaagaaacatacatgtaccagacatactagataaaatgtacagacgaggtgactgacaaacgcatacacgactagagtcatggatgatgatggatctcggacgatacgtactaagcagtgacagaaattacaagctagcatgcacaaggtactacttactaactagtagtagatgagagagattcccgtttgtcaacttaatctgcagcatgtgttttgtcccactagtcccaaccaagcagtcccaggctcccagctcccaacgccaaccaagatgacgagggctcgtcttggccgccggagcgagctgcagctacctcctcctcatggcttgcccttgtgctgtgtgtagatgtagtcgaggtgcgcgttctggagcagccgtctctgcatgcaaccgtcgtcctcgtcgtcgtccgcctcgcacgccactgcaccctcctccacctccgccgccatcatctcatctccggagatggacagctcgtcgccgttgcccacgccaccttcctgcagcgccaggccgccgacgccagtttctcggtgaaccaactgagctgggacaggagaaggcggcaggaggcgagccgctgctgagtagtggaagaaacagacgaggaggaggagcagggcagcagccgcgagcggcaagggcatgctgcagctgcgccgcctcatctctgccgccgtgccgggccggttgatgaactgctgaaaactagtgctgctgctgcgctagctgtcgaaggacgaaagagagagaggggggctgtgtacgagttggatggagttcgtagtgagcgagcgagtgctggatggctgatgatggatgcctcagttggttc

SEQ ID NO: 24102 - DNA, 1053 bp, Zea mays
atccaatgatgtgttttacttcatctgagcaaaaaaaaaatttatcaacataaggacacaaaaataattcgaacctgcaaccctggcaacagataaacccacgcgcaagttccaacagaacaactactcatacagcaccgaactcagtcaaggtaaagtttcacattgatcccgttatcgatcagcgactgaacaaccgccctgatcttcccctcgaacttgtcccgttccctcggcgtgtacgtgcaggtgtacacgtcggcctccttcgccctctcggccaggaaccgcccgacggccaggcaggccggcacgtcggacctcgacctgagcgccgccttgatgtccttggagttggtcccggcgaccgcgacctgcctgcaggtcgaccggtgcgtgagggacgccgagacgaagcgcttggagatgaacacgtccagcgtgaacggctccatgtgggcgatggtgcgctgcttgaacgagatgtgcttgtgggggttcttggacctcttctccttcttgtacgtgtatggcctactgttgtcctcgtccacgaagtcctccacgccgaagaagctcctggaagaactccagacctgcccactgtgaaattgactccagcaagttagtacagctggtgctgaatttcctgcatgtagcatatgtgctcctctcttccatgactggctcaagatgcacttcagcatgtttacctcaagtcctcaaccacttgcagtgctcaataaataccaagagaatgatttgaaggtagatgctaatcaatctcacacaaaaccataacctctattcctcttccctggacgaaccaactttcttgcactctgagtctgagaaataatttaccatctgctgcagcaggccgtcaccgtgctggggagtggggaccgagagggggcaccagccgccagtcgccggtggcgcggcgccaaaccgtcgccccgtgtgatgtgctcttgttagggttcctcgatggcgtccgtacgtgctgcgtgcgagtccggcggctcccggccggcctcgaggtacccaatg

SEQ ID NO: 24103 - DNA, 1007 bp, Zea mays
gggtatccaatgatgtgttttccttcatttgagcaaattaatttttttatcaacataaggacacaaaataattcgaacctgcaaccctggcaacagataaacccacgcgcaagttccaacagaactactactcatacagcaccaaactcagtcaaggtaaagtttcacattgatcccgttatcgatcagcgactgaacaaccgccctgatcttcccctcgaacttgtcccgttccctcggcgtgtacgtgcaggtgtacacgtcggcctccttcgccctctcggccaggaaccgcccgacggccaggcaggccggcacgtcggacctcgacctgagcgccgccttgatgtccttggagttggtcccggcgaccgcgacctgcctgcaggtcgaccggtgcgtgagggacgccgagacgaagcgcttggagatgaacacgtccagcgtgaacggctccatgtgggcgatggtgcgctgcttgaacgagatgtgcttgtgggggttcttggacctcttctccttcttgtacgtgtatggcctactgttgtcctcgtccacgaaatcctccacgccgaagaagctcctggaagaactccagacctgcccactgtgaaattgactccagcaagttagtacagctggtgctgaatttcctgcatgtagcatatgtgctcctctcttccatgactggctcaagatgcacttcagcatgtttacctcaagtcctcaaccgcttgcagtgctcaataaataccaagggaatgatttgaaggcagatgctaatcaatctcacacaaaaccataacctctattcctcttcactggacgaaccaactttcttgcactctgagtctgagaaataatttaccatctgctgcaccagccgccagtcgccggtggcgcggcgccaaaccgtcgccccgtgtgacgtgctcttgttagggttcctcgatggcgtccgtgcgtgctgtgtggccgtgcggcctgagttcactggccccggccgg

SEQ ID NO: 24104 - DNA, 794 bp, Zea mays
ttgtcgaagggttccaaaggtaatacaaagcccccagcgcataagtcacagtattccgcactgggctcgataagcattgtataaccaatgggattcccaccacactgagtaatgattaagccatttgcaggatcaacacaggagttacatattccaccaatgccgaactcgataagcctttcattaggctctgtaatgcagtccaagaataactccagaacattcagctggcgcatgaaggcataattaaaagggtcataagcaaaatttgccaggttagcaactatcttctccttagattcttcatccgtggcgttctggaactgggtcacgagatcctgaaggtactggtctcgcggagtgccagaacggccggtgcgctcgacctggcgctgcgcattcgtaaacatgaatctccacacaaattccgcgctgctgcgatttatttcctggcagagctgaggtagcaagaatgccagcaccgccgccgccgctcacacaaaagcataacctctattcctcttccctggacgaaccaacttttttgcactctgagtctgaaaaataatttaccatctgatgcagcaggccgtcgccgtgctggggagtggggaccgagagggggcaccagccgccagtcgccggtggcgcgccgccgtcgctccgtgtgctgtgctctggttagggttcctcgatggcgtccgtgcgtgctgcgcaggaatccggcggctggcgctatgctgctgagctgctctcgtctcaaaaccgtgcatgggccctgcgtcccggccagg

SEQ ID NO: 24105 - DNA, 1278 bp, Zea mays
ttgggaccctcgaggccggccgggtcgccactcttaatccacagggccgcgcaagcgctctggcttcttccagtccagtccaccatccgcgccatggcgatggcgttcgcggctgcctccgcctggagcctcagtcttacagccttctccctcccgctgccccagtctctgcgcccgaaacctagccaactcctccatggcgcgaccagctcgttcccgcggccacgccgatgcgggtggggcgccgtggtgcgctgcgcgaagcgcacggggaagcagcggtacccgtcggagaagaagcggttgaacaggcgaaaacaggagttgctacgccaggccgccccggaggaggggagcaaggggcgggagtccgggtactggcggctctcgaagctcgctgttcccgcccgcgacgacccaggcaaggacttcaccggcatctccctgccgctactccaggccatcgccaaagccatcaagttcccggttccttctatgctccctgacgaggctttcactgtcatccgcaagtcatttgacgcacgaaaggttttgaaagaacctcaattcacttatattgttgatatggatgttaagaagattcttaatattgagccaagggcatgggattttattgctcggttggagcccaaacttggagttgtggaatacatgaccgaagagaagttagcagttgatctggtcagcatgctaaatgttagtagcaaaggttccaataatgtactaggaattagagacactcatagtggcatgatttatcgtcaacaaaagaagcccagagtggcagttataggaagtggaccatctggcttgtttgcttcccttgtgctaggtgaacttggtgcagaagttaccttattggagcgtggtcagcctgttgaacagagaggtcgtgacattggtgcactagcagttagacgaattctacaaccagagagcaacttttgctttggcgagggtggtgcaggtacgtggagtgatgggaagctgatgaccaggataggaaaaaacactgatggtgttcaggctgtgagaatcttcctgacctacatcgatctgttcccataaaactttactctcatagtctcatatatcattttcttagtagtacactattttttcacggtgtccaggcgtgagaaaattcctactgtacctcagcggctcaacctcaaacattgttttgtgtaatagctcacattcatgttccaattgttcaagagttcatgacttttttttggaaaaaaaaaaaaaaaa

SEQ ID NO: 24106 - DNA, 1798 bp, Zea mays
ggacgttgttggagagaaatgagatatagtttttttttttttttagaggaaactgtaaaggacatatatagaggatgaatatagaggacgttgttaagagttgcaccacgaagtaaaaagaaaaaaaaaacttggtcaatcacagtacagtggctctaagatcttcttttgaagtcaagtacagctgacatcttctgcaacatgttcccaaacaaaccaagacgaggtctctgcacccgagacatcagccactggtagtcctccagcgccttacctgacaggggttccagaaactcgcacctctccaggatctcgggcggaggcactcccctgacaaggttcgtgtccagcttcggcttcctcttgttcttgtcttgagggacctctggcacagggctctcgaggtggagcggagatgctccggggatgacgtcttggcggaagggtaggctccttgcgctctgcaggcagaagtcgaaccactggtgaaccagtggagacgggcctctggctcggctcccgatttggtcagtctgaaatctcgtcgcgcatggtattgcccatagatcagcccataggctgctgcctgacttgggaacaaccaccgcgacattagacattcgctttgcagcagggatcacgtcgctgctccaacccactgcgacccatacatctccaacactaaacgacttcagatagttcatgctgtcgaatagttggacctgcttctgtagttgcgtaaagctgtttaggactgctgctctaccaccattgacgtccatttccatatcaactgtgttatatgatgagcccagatgcttcagaacagcaccaatcacctctctaggagaatcgaccattgaaatcctcccggcaagctcgggcctccacaaatcctcccaatcctgtattggcttcaaattatgtcttttgaacttgtctttcttgtaagcaatgaccatggtgccccatctgtatggaactccccatattgtaccattaggatctgcttctccgttctggttcctgcacaaatggaccttccatctgtcactcaggctatgaaaccaatcctgttcttcagcattcttgataggctctagcaatcccttgcggatggcatagccgagccaagagtccccaagggaaacaacatcagctgccattgcagacttcggctgaacttgacccttgtccatacattgtgacatctcagagaagatcccatcaagattagcacggagctcaggactgaatttgagtctcttcccctgagcttcgacgaaatccttaatccaagatggagggaaggagccgcggagcgccacgacccggaggggcaccgagagcgcgtaggtcttggtcttccacttctgcagcgcagcctcccactcctggtcctcctcctcctcctcctgcgtcgcctcaaccaccgcagcggcccccggagggggcgggagcgcgagggctcgggcacggttggggaagagaaaaaggagcgagcacacggtcagctggagcaccagcgccgccaccgtgttaggcaccggcaccaggccaggcgcgtcggcttggctgcccgatggacgcctcgaaggcactgcggcgagctgcttcggcttgcgacgctgtacgcggagtcggaggcgggaggtgggcaggtagtgggtagggtagttggggatgagaccgcgtaggcaagggtggtggaactgggcgatgaggagatggagcggctgtccctccattgccgctgcccggttccctttcggaagctccgtccgggcagtggccttct

SEQ ID NO: 24107 - DNA, 533 bp, Zea mays
  misc_feature (1)..(1): n is a, c, g, or t
  misc_feature (6)..(6): n is a, c, g, or t
naaagnctttttttttttttttttagagacgaatgtcataaattttattatataatgataatgtcttacaaaaataaccgataataataaaatagatcagaaacactatctccacggcgccatagttgactgggagacgacggcctagatttcgtcgaactcgtcgtagtagtcctcctctggtggtacctgctcttcaccttctgcgagctcctgtaagaatctccaacttgggttgcttcgggttcctcggtcacttgctcgtcgggatggagacgggattgggcggtccacgcgcggagcggatcaacagcgagagaagaaactccgatgagcaatttccgtcgtccctgttgtccccaaaccccagcggctctgcgtacaggtccctcacgtactggcgaacttcctcagccaccatatggctcccgagcggcggtgtaggcgggcggcgacggtggcggccggtgcttctctctctcgtactctcggcggtgtatgacccgcgaggctctcggtgagtatagtcctag

SEQ ID NO: 24108 - DNA, 1135 bp, Zea mays
  misc_feature (989)..(991): n is a, c, g, or t
  misc_feature (1126)..(1130): n is a, c, g, or t
gaggtcgacggtatcgattttttttttttttttttttagtgatcataaatgggctaatacataaaccagcaatagtggctcatagtttatagttctttacaggatgaatatttacataaatgcactaaatacaagaaattttgcatacaaacttgatccaaatgtttacaaaccatgcttgaacaaatatacaaacccgttgtgggcaggaatcattttagctttgtacacttgtacagcaacaatagcttcaatagagattgttgtaagtgtagagtgttgctgcgatggaaactatgcaaatcacaagggatgggagaagagtgacattcagaaggaggtccgtgccgagataaccggctgcagtaatcgtggcatctgcaactacacgggccaacgtcccggcctctgtcgaaaggagtccaccattgtaggtccctcgggaaagcctcgatgacattactcgtgagagcaaggacagattcactccttcaagcacctcagcaaacacaaatgtgatgagagctgaaaggacatattgcgggatggagtagtgaggtgtgaaacaaaagctcatgattataccgatgagaaccatgacttcagatgccaacaaaatttgcctatcctcgaataaatttgtaatgtagcttccaacaaaggcatttactggaagaaccgttaatccaagaatcgctagaaagatagccacggcacttgtagaccagctaaaatagtatgtggtgacaacactcgattctgatagtagtatttccattgcgtacttgagcatgaagtatatcagtagctgggccttcacagatggagttagcaatctgtatgctgaagcctcgtgccgagttcgttcatgagagctttctgactctacttcagtatcatcattaacttctgagttctcatcctgccttcgttctataccttgaagcaatggttcagctagacctgcctgccaagttagaatgtccttnnnatccagattcggatggttgttcattgaccatagttttagtgaaatgttctggctccttgaatgtaagccacagccacaataagtaaataagccaagaaatgcacatgacccatccaggcaatgtgttttaactannnnnccttt

SEQ ID NO: 24109 - DNA, 1544 bp, Zea mays
  misc_feature (584)..(584): n is a, c, g, or t
  misc_feature (601)..(601): n is a, c, g, or t
  misc_feature (611)..(611): n is a, c, g, or t
  misc_feature (619)..(619): n is a, c, g, or t
cccaaggccctcaacctgtcatcgcagaaactccccccgctctcttcatctgccacggcctcgccaccacctccgcccgacggggacgataagccggaccccatcaagctcgctttcgcccgcgctgccgcatacaagaaggggagggacagtcacagcccgagcccgagcccggcgccggccccgcctcccacgccgccgccacagtcttcaccaccgtcgcagccgcaggcttcggtcagtgagcccggcagtaaggaggcttttaagcgggcgttggagtaccgaaacggcaacggggccggagcgggcgcggctggtggtgactccccgctgctgggaggctcgccggattttggtcagaatgccctaattagtgaagaagtctcgtttggcaagagaggagggtacgagtttgatgaggctgattttttgggtctcgacttctttgagaaaaaacgttctaaaggtctaccacctgggctggctccagcttttgagcctttacgagatgacgattttcctgaggtggacataatagttggagaccccagcgaatttgccaagtctcctcgccgaactgnaaatccaaccggtgagnacaacggggnagtcaggnggaagcatctcaatcgactactaaaccaaatgaagctgacaaggctgggatagcacccccttcaactgttattgagactgaagaagatgaagatgtttatagacccacagttagatcatggggaatgtttccgaggccacaaaatatttcaaaggcgtatggcggtggaagaaatatacgccttggtggagagactcaaagtgcagaagaaaaggcagccaaagataagcgcaccaaagagctaatagctgcatataggaatcgacagaacatggtaatcgatgcaaagacaaaagcagagtgcatcaaggccttgagggaaggtgatgagatgatgaatactggaaggcttaaacaagcattaccttattatgaaaaagtgatggacgctgtggactttaagactgaacttcatggaagggctgctctgcaatggtccatctgtcttgattcactctgcaggtccaaggaagcaatgagcatgtatagcaaacttaaaaaccacccgaatagtgagatcagcaagaaagcaaacatgttcgtgttcagctttcaggcaatggatttcatgaaggtgagcagcattccagtgcccaaaagcacaggctacgagacgtacttcaccaaatttggcagcaagaagaattactacgcgagcttagaagagccggaggtgggaatcgagcagatcgtcccgtacatcatctttcttgtttcgccgatatttttagttgcttttgttgcactgagaaaatccttccagctatgaacagaaatcatggacgagttgctgaggttttaataccgtataggagcacatagcttggcaatagaagattattattatgattttttttgttttcatcaaaagagcaaattatggcccctagctgagctagggactaatttttaatcccttttcttt

SEQ ID NO: 24110 - DNA, 949 bp, Zea mays
ttttttttttttttttctggtcaactaaggatttcaaattatactccaccaaaggattccattccgcaggttacaaaaacaagtgttcaactaagaatctaagacccgcagctactaaaacccttttagcctcaataaagaagcgcggtgtaaatcatcttttcctcttgccatgcatctttgattccctctttgggttaccgcttggtggtgacttggacgcaattgccgagctccacagtgctctctcgacatctgagggtgtgaaactttcttctcctatgctcagttccttcgcttttgcctgcaatttatcagcaaatgcaaggtactgcttcagagtgtactcctttgaattgcccaaggctcgtcagacatgaacggtgcgacatcaggtgcatacgcagcgagcacggcggacgcagtggcgggtccgactcccttgagcacggtaagctcggtgatggcccttctgaggtcgggcaaagccgcgaacgccttgcgcgacgccgactccaccacggcgtcgtccaagcccttgacgaaatccatcagcctcggtctccacttgccgcgagagagcttccactggaggaggcgcaccagctcgggcttggcgaggaaaggatccgggtcacggcagcgcaggagcgcgggcaggtcgtggcggtaaaaggagtccacggccacgaggtcgggtttgtctagggccgcgagacggcggtcgtacgcggccagcgctgcgcgccacgccgccgcgtcgccgctcgcgaagcccaccgtctcggccatcgttagcgcggtgcgttgcacgaggaaccggcgacggcgaccgtcgacaaatgtggggagcaaagcaaccagcaactgcgactgcgactgcgactgcaagtgaactgtgaacccggcggctatttctcatcgactcggcagagcggaacaccagaac

SEQ ID NO: 24111 - DNA, 1102 bp, Zea mays
ctagaagtactctcgagtttttttttttttttttttttggtgttcaaaaagaccggcacatattttcagcaatagcaacaacgggtgcattagtcttgaaatacacatgcacgatgcatccgagctcatgtagcgagggtcactggtaggcatgtaggaaataaagtgttttggtcaactaaggatttcaaattatactccaccaaaggattccattccgcaggttacaaaaacaagtgttcaactaagaatctaagacccgcagctactaaaacccttttagcctcaataaagaagcgcggtgtaaatcatcttttcctcttgccatgcatctttgattccctctttgggttaccgcttggtggtgacttggacgcaattgccgagctccacagtgctctctcgacatctgagggtgtgaaactttcttctcctatgctcagttccttcgcttttgcctgcaatttatcagcaaatgcaaggtactgcttcagagtgtactcctttgaattgcccaaggctgctaccatcgcctcgtcagacatgaacggtgcgacatcaggtgcatacgcagcgagcacggcggacgcagtggcgggtccgactcccttgagcacggtaagctcggtgatggcccttctgaggtcgggcaaagccgcgaacgccttgcgcgacgccgactccaccacggcgtcgtccaagcccttgacgaaatccatcagcctcggtctccacttgccgcgagagagcttccactggaggaggcgcaccagttcgggcttggcgaggaaggggtccgggtcacggcagcgcaggagggcgggcaggtcgtggcggtagaaggagtccacggccacgaggtcgggtttgtctagggccgcgagacggcggtcgtacgcggccagcgctgcgcgccacgccgccgcgtcgccgctcgcgaagcccaccgtctcggccatcgttagcgcggtgcgttgcacgaggaaccggctacggcgaccgtcgacaaatgtggggagcaaccagcaactgcgactgcaagtgaacccggcggctatttctcatcgattcgactcggcagagcggaacactagaacaggtc

SEQ ID NO: 24112 - DNA, 1342 bp, Zea mays
cggtgtcggattataggggggaagcgacgaactcaagatcccccaaggtgaatttcccaaatttccacagcgggagtgaggatagcgatgagaacaggaaaaatgatggcaaggttggtaaaacgaataaaaatactgatgaaagttgggatagtgactgagataaagtaatgatgatatgtgatgcatgaaggtcagcatcaatggttgtcaagtccaagttctttcattggtggtgttgctcatgtactgtccaatggaaatctcgaggagctagaagaataagcatggtttccataggaacaactgtttgaacttttactgcaagttttcggacgtcttctattccagttgtgttatagtaacctgaaaagctgttggagggcaagttgtcaagggtgtgctagcctcatcaaagccagaatgctgcatgacttgcacaagccgaggacaaagtaacagattacagatgtggtcagagttcactatcgaggtttctgaaggtctcagaaatgtgaaatcgtcactctgcgatcacatttatttctcatcttattcttttagttttgatgtgaagagaacatgcacatagatttatctcaaggccatgtgtaccttgtcttgttttggttaaattgtccgatacacgttcttcagagcctcctctacggtgtgaaactttaactctgttttagtgtcgtgtatgccatcaccgtgctcattgttctcttagtttagtcgatcgaaacgatgatcgaaaatttagactctgaaaagtaaaagaagtccttaaattaaaaaaatgatctaagcgctcatattaattgaagctccgtttggataactgtgcgcttgactttaatctgtactgacttctactgcttctataatatttttgtctatgggttgtagctgcagccggccaaatagccgactttaatctgaagcgaatgtgtggaatttgatattacatatttttccaaaatttagatacaagcttatctcaaatttatagaataaggaataaaaataattttatgtatcactaggttatttggttgcattcaagatggatttcaatgtgtccatcgcaccccaactgcctttacacaatgctcataatccccttcctgttacctcgttgatccggagagcattttttcatggcaaatatcagaagcaccattctgctcacatttattaacttgtacggcattcaccttgtttactggccgggattcaacagtaaaatccagatctattagtataacgctagtacaaaatagatctagaaaatttcataacaattaacatacaaaaagtaaacaaacaatagatttat

SEQ ID NO: 24113 - DNA, 1109 bp, Zea mays
ctggacactccccttgcgttgtgaaggcaacggtccgcataatagctgttgccatttggtgcggcccatgttctcgcccaacgagaaacctgagcccattgccatttccggccggggactctcgtctcgctgtatcgttcggtctcccacccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgatcgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccagtggcaggagctttgccttgcattcaagtagggggaaacataatgcttgattagaattgatatatccgggctgcaaaacgagctattgctggcttgccacaaaacatgaagcagttatctggacatggtgtgtttgatgtcgtgtgcgttacgtgcattagctaactggacaggccttgcaatgtaagacaaggaaagcttccttgatttgctgctggagcagtggccacgcgccctgggtgcgcggggactccatgagcagctgcacaaatttcgtttcagctttaaatatctcctttttctgcaagttttctggttgtaaaagatgatggtggcaataatatggtacttgagctcacaggatgcacatttcttgtaacctgtattccaaagctttatctacctgaaaccatagttactgtttaagaataaccaaaggtttgcaaaaaaaaaaaaaaaaaaaaaaaaaaaaaaagtactctgcgttgttaccactgct

SEQ ID NO: 24114 - DNA, 4256 bp, Zea mays
  misc_feature (822)..(822): n is a, c, g, or t
  misc_feature (824)..(824): n is a, c, g, or t
  misc_feature (2122)..(2122): n is a, c, g, or t
tgtgcttaaagcttataaatttcagatttgcctattcaccccctctaggcgactttcaaaagtgaatcatattacatgaatatgatatctatcgaatgtgatatatggaatatatgacaaaggtggagtcttggagtattttgatttttcggtcatatacatataggcctgagtcagacatcaaatagctcatcccttgcgataaaaaggagtagtagaacagagaacaaaggggagaagaaagacctagtagtataaaaaatggctgggtcactagggtaatccaagctagagacacgttatattgtccatgtttaatttgttctagagggggagaataggtagaactcctttggatagacataaaagagatttagggaccatatgttagaactctcactagaaccaagagagaagggagagctaacaatgcatgatggttagtctataatgcaccttgtaatctttcttctttgtgttcatcaatcaccacatacaagaggattaaggtattacacgcaacacggtatgaacctctttaaactgactgcatactgattctctgttgtgtcgagacaacacatcatcaacttatatccctgctctctctcaaatcttttatttttacttttaggaagattttagctctctcaatgtcctcggtcccaaacaaaaccttggtatcatgttgttgttgtacaacgacattaataaaaatagtttattgttccaaaatttaaagcggccaaccgatatacaaaattgatatagttggaatggacaaccggttactcaagcggcctgctatgcactttgcgaaantnggggccaacatagaaaaatcagggtccgtttgtttcagccctagattcttatgaatctgatcttagctgtgagctgacaactgtgtcaaaaataaaatttgtttggttaaaacaactataaattataattctataagagtatgacaatttctaacatgaatgatggaaatttgaaaaatttggtgtagaaggtaattctgaatcgaactagagaaatatgtaaatttaaaatatatttcattattgtacctgtttaactaggattctatatttttaattgtgaatctaatttagaaagctgaaaccaaccgcatgtcagtcggtatggtattggtataggtgtatattcgggccacccggcctggcccaaacccgaaaaggcacgacatgattgaatttcgggctgggctggcccataattattacaggctttaccgggctggtccatggggttagtcctcagcttatgacccgacgcgttattggttaaacataccgggctcattttgggcggcctgaaatcaaattcttgcccaaaaatcacatcgatcctaaaattcatatcaaagcccaaaattcacatcaaaacccaaaattcacaacaaagcccgaaattcaaaacacatataccatttagtagacattaacatttcaaatcttatgattaaaaaaatcaaagagcacgaaaccaatagctggttgaacgtcatctctatgattaagcatgtggctagctaaattggagcagatgatttcatgattaaaagtggatgaccaaatgaatatgggccttttcgtgtttgttaaatgagctatttcgtgcctccttaaatggatcgtgctcgtgcccgcccgtgagccacgacctcgctcaaacacggctcgatgcataatttcggcctggtccgacccgaaattatttcgggacgtgccatggttgggtcatgcttcgggccaacctataaggtcgcgggtatagaatcttaatcatacccgtacccgtgcgaccgtgcgagtaattttaccctttagattacccatacccgctagaaaaagtctaaaatgctaatgtgtcaatcactaaaaatatcaaacaaacacataaaaatagttcaacttaaaatacaacaaaccatttgattacatatcttgataggtaaaaccacaataatcgtagaagtatttttattacctaagacgactttaattacatggtaaatattgatatcatgcatgtaaattttatccacgggtacacaggtatgggttacccgcctacccgaccattagtatacccngtttcgactactcattgttggcttgttcgtttacaccaatccaactatggatttgcatggattagaactaaatcaatgccataatgcatgttctaaaataatctaagtctatttttaaaaaattatttggttaaacccatcatggattatattttaagggtttgaaaattttttaaactatgaaagacatggattctatctataactcactaggtatggaacaaatacacgacgatattgacgagtttatattataatctatgaatcaaaagaataactagttttgagagatatatgaattaaatgatgtatttaatcttaccatagaattaagtgtggggcgtggatttaacaaatccagaactggattaaattcacggtagaattctatctcgccacccggattggtgtatatcataccgcttctgcgcctccgtgccgacctcttttctgtgacggaattggatcctccatgccaaggcatgggctgagccaactggacactccccttgcgttgtgaaggcaacggtccgcataatagctgttgccatttggtgcggcccatgttctcccccaacagaaacctgagcccattgccatttccagcgtctcgtctcgctgtatcgttcggtcttccccccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgatcgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccaggtgggtggtgtctcctcttagatctgatgtggcagctagggtttcagctatgttgcttgctaccctgtggtcatgctttccgattttctagtggcaggagctttgccttgcattcaagtagggggaaacataatgcttgattagaattgatatatccgggctgcaaaacgagctattgctggcttgccacaaaacatgaagcagttatctggacatggtgtgtttgatgtcgtgtgcgttacgtgcattagctaactggacaggcctgcaatgtaagacaaggtaccatttcatcagaatcaaacactccacataatttgacatgatcaaggcattagtaattagatgcccatatctttatggcttgcattattgtctcatagagggacgtttctctattattgtttgtaatttggtatctccgttttttaatgcttgaaatgcaatttcttcaggtgtagggtttcacaatagagtagttattttcttcatgaatgtttcactttactgtgtactgagaaacctctattattggggcttatgtttgtgattttagattcgagaccggttgtgataaaaaaaattagcttatggcatttatggatgacagatattaccatacctttcagtattagacaatatctcaaacctaagaggctaagactactttgctttactcgtaaaactcacgccccttgagccactccctcattctgtagaggcactttctaagtagcaaacttgtgtgagctcaaattttgctcttccatgttgtgcaagaagttcaaacaatatatgttttcttaaaatttgagttattcaaatatattgagacgaggtgtgttgatacttccctacaaataaatgtgtttctgtttgctgaggagttcattttgagtcttcatcagctatgttacagtatcaagagtctcaaaacttatatgtcagtatgctgattcttatctaccaacgatgattcttcatatagaggtcagcttccttgatgaatagtccatcacctgtctaccgcaatc

SEQ ID NO: 24115 - DNA, 881 bp, Zea mays
attgggtacctcgaggccggccgggcgcctgccccccggccgggccggccggtctcgcccaacagaaacctgagcccattgccatttacagcgtctcgtctcgctgtatcgttcggtcttccacccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgatcgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccaggaaagcttactgatttgatgctggttaatttgccaggcatccttgttgtgcttggactccatgagcagctgcacaaatttcgtttcagctttcaaatatctcctttttctgcaagttttctggttgtaaaagatgatggtggcaataatatggtacttgagctcacaggatgcacatttcttgtaacctgtattccaaaactttatctacctgaaaccatagttactgtttaagaataaccaaaggttttctaatgtgcacatcatctccaacttaaccaaaaaaaaaaaaaaaaa

SEQ ID NO: 24116 - DNA, 835 bp, Zea mays
actcctaaggccgctcgggcccctccgccacttccagcgtcttgtctcgctgtaccggccgatctccccattctcccctcttcgccggtcccaccaccgcgccgatcctgatggcctccgccgcctcatcggccgtcggcgctggcaaatcgctgttccaggggctccgcaggttcctcaagaagccgtgggagatcacaggcccctgcgcctctcccgagtaccgcagcgcgctgcctggcgcgctcgagtaccgcgtcaagtgcccggccaccgtgcgcgacgaccgcgacaaggccatcgtgcccacatccgatccggagacagtctacgatatcaagtacttcacccgcgaccgccgccggagccgcccgcccgtgcggcgcaccctactccgcaagcccgatctcgagagctacatggccaccaagcagttcgaccccaccaatgacttccccgtaccatacgtcaacaccaccgtcgaggaggatgacaacactgtcggcggtggctaccagaagtgactcaggaaagcttgctggttaatttggtaggtatcctttgattggacttcatcagaagcggcactattttcattccagctattaaatatccccttttcttttgttcctagtggaagttttttggatgtaaaagatgacggtgtcaaataatatggcacctgtggagctcacaggatgcacatatcttgtaaattgtattctaaaactgtctacctgataccattgttactgtttaatgcaaaatttaaggtttctattccaaaaaaaaaaaaaaaaaaagaaaccggggcgcaaaaaactcgaggaggggc

SEQ ID NO: 24117 - DNA, 882 bp, Zea mays
  misc_feature (871)..(872): n is a, c, g, or t
  misc_feature (877)..(877): n is a, c, g, or t
ctcgaggccggccgcccaacagaaacctgagcccattgccatttacagcgtctcgtctcgctgtatcgttcggtcttccacccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgatcgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccaggcatccttgttgtgcttggactccatgagcagctgcacaaatttcgtttcagctttcaaatatctcctttttctgcaagttttctggttgtaaaagatgatggtggcaataatatggtacttgagctcacaggatgcacatttcttgtaacctgtattccaaaactttatctacctgaaaccatagttactgtttaagaataaccaaaggttttctaatgtgcacatcatctccaacttaaccagttatgatgttttgacaaaagggcgaaaacacttcgtctgtacttctgtacgattagaacattatgtgcttgtgtgttcattaannaaaanaaaaa

SEQ ID NO: 24118 - DNA, 2979 bp, Zea mays
tatattagtcgacctgcagtcccctcaaattctcatggtctcggtttgtcgcctccccgcttctccacctcccgtctcgtctgcaactgcaactccacctcggccgtcggccttctcatcctcgtcaccaccggccacggccggcctccaccaccgcctgcccaccgctcgctactcttgtctgtctcccctccccccaagtggaagaagaatcgggctgttgctcactcagagctctctcagtgaggcgtgcctcactagtcactagccttgctgttatgccttccccgccgctcgccagagtccaccgccaccggacaggaagcaccacctagttcctgaccctgatgcccatggcaccggaccaccccttcgatggcttcgtcgccgcagcccgtggcgccgtagcccaccttcacctccccgtcatccacatccctggatccaattccagtccccatcccaactccaagcagcacaagggactcgaggtcgactgcctgctccacctccacgtcctcgtcaccaacttcctccacaagcccctcaagtcattcgccaggtgcttcaggcccaagcgacggacagacacacactccccgccgctccaccaggagcccagcaatggcgccaccccgcaaaagcaactggagttcctgctctgcattgcgttcgacgccttcgcccacaacctccacgcgctggatgacgcctgcaagcacaaaggcgaggaatttgctgccgctacccgacagttggagcaatttgtggttctcaggaaggtaatcgatgggaagagggccgatttcgatgggttcctttccaatctgggctttgcaaaggttggggcaccgccaccgccagcaagcatcgtgggtggtgcgtcccctgtcccagcaccagcaccagtcagcaatcaggaggatggtgccgtgattggaaacggcgagggggtggacagtgctagtggtacacaacagcaggcacagaaattgcctgcccggttgcttaacattcctttgtcgaatgtggagcgtctgcggtctacgctctctgcagtttcactgacggagctcattgaattagtcccgctgctggtgagcagatcatcgacatcggcagatgcacatcctgacaagaagaagcttttctcagtgcaagatttctttagatatgcagaaattgaaggaaagcgattctttgaagagttggacagagatggtgatggccaagtcactctagaagatctcgaaattgcccccgcgtccgggcggttgccaaggaggtatgctcgagaattgttccgccgtacaagaagcaacttcttttcgaaatcaattgggtggaagcaatttttatccttgatggaacagaaggaagcaaccattctccgagcgtataccacgttgtgtttgagcaagtctggaacacttcacaaaagtcaaattttgacttctttgaaaggtgctggacttccagccaatgaagataatgccgctgccatgctacgttatctaaatgctgattcagaaggatcaatctcatatggccatttccgcaacttcatgcttctacttccttcggaacgtcttgaggatgatcctcggaacatttggtttgaagcagccaccgttgttgctgtccccccacctatagaaatatctgcaggaagtgttttgaagtctgctttagctggaggtcttgcaagtgcgctttctacctctctgctgcatcctattgattcaatgaagacacgtgtccaagcatctacactctcatttcctgagctcatttcaaagcttccacaaattgggcttcgaggattgtatcgaggttctatcccagcaattctcggccagttttcaagccatggtttgaggacaggaatctttgaagcaagcaagcttgtattaattaatgtcgctccaacacttccagagattcaaggtgcaatcaattgcatccttctgcagcacagtcctagggactgcagtccggatcccttgtgaggttcttaagcagcgtttgcaggctggaatattcaacaatgtaggggaggcgattgttggcaccatgcgacaagatggcccaaagggtttttttcgcggcactggggccacactgtgtcgcgaggttcctttctatgttgctggaatgtgcctctatgcagaagctaagaaggcagcacagcatgttttgaggagagacttggaagcatgggaaatagtggcagttggagcattgtctggaggacttgcggcaatagtaaccactccctttgacgtgatgaagactaggatgatgactgcccctccaggcacaccagtgtctatgcagatgataatcttctccatccttcgaaatgagggtccacttggactctttaagggcgcgatcccccgcttcttctggatcgctcctcttggagcaatgaattttgcaggctatgagcttgccaagaaggcgatgatcaaagatgagaacagttccagtgagtcaacaaaagagaacttgccaagaaagcagtgatcaaggatgagtgtgattctagggcgtcaatacaggacaagaaaaccatgatggataccacaggataatctaacgtttacctggttaacatctatggtgcaaagaaattgaaaccatggaacagttttttttgtgtgtgtgttcatgtagcagagaagcaacagaacatctgccttttttgatacttgaatctaattttgggttgccgcgtctttttgcccctctaggaattccattcccataggccttgagatggttgtatagtatacagtacatgagagagacagatgcacatgctggagctgttgctcttttgtttgttatttgacgatgatccatagccttcctggttaaacatgatgtaaatttgctcttgtacttaccctgatgaggacagttggctttgacccaattgttctggtgtttgaaatggactgaaaggcgacgagg

SEQ ID NO: 24119 - DNA, 2946 bp, Zea mays
  misc_feature (2931)..(2944): n is a, c, g, or t
aattcggcacgagggtttctcgcctcgccgcttctccgcctcccgtctcgtctgcaactgcaactccacctcggccctctcatcctcgtcaccaccggccacggccggcctccaccgctgcctgcccaccgctcgctacactcatctccccaaagtggaagaagaatcgggctgttgctcactcgtaccctctaagtgaggcgggcctcaccaaccttgctgctatgccttccacgacgctcgctgcagtccaccaccaccggacaggaagcaccacctagttcctgaccctgatgtccatggcacccgaccatcccttcgatgccttcgtcgccgcagctcgtggcgccataacccaccttcaccttcccgtcatccacatccctggatccaattccagtcctaaccccgactccaagcagcaccacgaacccgaggtcgactgcctgctccacctccacgtcgtcgtcaccaacttcttccacaagcccctcagatcattcgctaggtgcttcaggcccaagcgacgggcaggcaaacactccccgccgctctaccaggagcccagcaatggcgcgaccccgcagcagcaactggagctcctgctctgcattgcgttcgatgccttcgcccacaacctccacgcgctggaggacgcctgcaagcacaaaggcgaggaatttgctgtcgctacccgacagttggagcaatttgtggttttcaggaaggtaatcgatgggaagagggccgatttcgatgggttcctttcaaatctgggctttgcaaaggttgggccaccgccaccgccagcaagcatcatggggtggtgcttcccctgtcccagcaccagcaccagtcagcaatcaggaggatggtgctgtgattgggaacggcgagagggtggacattgctagtggtacacaacagcaggcacaaaaattgcctgcccggttgcttaacattcctttgtcgaatgtggagcgtctgcggtctacgctttctgcagtttcactgacggagctcattgaattagttccgcagctggtgagcagatcatcgacatcggcagatgcacatcctgacaagaagaagcttttctcagtgcaagacttcttcagatatgcggaaattgaaggaaagcgattctttgaagagttagacagagatggtgatggccaagtcactctagaagatctcgaaattgcaacgaggaagaggcggttgccaaggaggtatgctcgagaattgttcaggcgtacaagaagcaacttcttttcgaaatcaattgggtggaagcaatttttatccttgatggaacagaaggaagcaaccattctccgagcatataccacgttgtgtttgagcaagtctggaacacttcacaagaatcaaattttgacttccttgaaaggtgctggacttccagccaatgaagataatgccgctgccatgctacggtatctaaatgctgattcagaaggatcaatctcatatggccatttccgcaacttcatgcttctacttccttcagaacgccttgaggatgatcctcggtatgtctgatgtatcctgttagaagaaacctgtgattgaattggctttagggaatagtgactctgcaatcatcaccaattctgacaattatcttctctttacttacaaattcactcaggaacatttggtttgaagcagccaccgttgttgctgtatccccacctatagaaatatctacaggaagtgttttgaagtctgctttagctggaggtcttgcaagtgctctctctacctctctgctgcatcctattgattcaatgaagacacgtgtccaagcatctacactctcatttcccgagctcatttcaaagcttccacaaattggacttcgaggattgtatcgaggttctatcccagcaattctcggccagttttcaagccatggtttgaggacaggaatctttgaagcaagcaagcttgtattaattaatgtcgctccaacacttccagagattcaagtgcaatcaattgcatccttctgcagcacagtcttagggactgcagtccgtatcccttgtgaggttcttaagcagcgattgcaggctggaatattcgacaatgtaggggaggcgattgttggcaccatgcgacgagatggcccaaagggattttttcgtggcactggggccacactgtgtcgcgaggttcctttctatgttgctggaatgtgcctctatgcagaagctaagaaggcagcacagcatgttttgaggagagacttggaagcatgggaagtagtggcagttggagcattgtctggaggacttgcggcaatagtgaccactccctttgacgtgatgaagactaggatgatgactgcccctccaggcacaccagtgtctatgcagatgataatcttgtccatccttggaaacgagggtccacttgggctctttaagggcgcgatcccccgcttcttctggattgctcctcttggagcaatgaactttgcaggctatgagcttgccaagaaggcaatgataaaagatgagaaaaattccagtgagtcaacacgagagatcttgccaagaaagcagtgatcaaccatgcaacttttttattttatttttgggtccatgttgcagagaagcaacagaacatctgcctttttttgatattgggaattacattcccgtagggccttgagatggctgtatagtatacattacatgagaaaagtgctagaggacagaggcacatgctggagctgttgttcttttgctggataggacagctcacttgttttgttatccgacgatgatccatagccttccttgttaaacacgatgtaaatttgctcttgtagttaccctgaggacatttggctttcgccccggggggcctggtgttcgaaatggaatgatagagccatgacgnnnnnnnnnnnnnnta

SEQ ID NO: 24120 - DNA, 4161 bp, Zea mays
tgcccggagactgagcagtacttcgtgtgtctcggagacatgcttaaaaccgtatatcagttagagaagaacaatgcacgcatggcccttatccaacagaaaatgcatattcgatgtgggcatccatgcgatggccgatgggcgatggtcacaatcaccagagacgaaaatcgtgcagcgtgtgagttagtggtggtgtacatgcacatggaccatggatgttagtagtatgttacacttacatccaaggggttgaattgcatagctaactaaaaaaaacagacaataaagacttgttctcgtttgatgatcaaacaatcaaggggttgaaagggattatgagggtttcaatttcctaccagtctaaatcactatctcaagataaaacggacaaggcctaaatcaattattttatcaatcttttttaactacacctacaaaaaaaaagctttgtgtatcttctacaaaaaaaagtgcttatttgccgttcccgctaactatttcatcaacaccgaaaaagcaaaagcagagtctaactctaattgctaatcgtgactcgcggcagccttggtggtgagcccgaagccgaacgggaacagcgggtcgtaccgcttgtcgccgtagttcatgggcagctggtccacggacttgaaccacgtgcgcggcagcttccccgtgaacccatagtccccgaacagcacgtcggtgatgccctgcgcctccgtgccgggcagccaggccgcgacgagcgcgtccatgtagtccacgtacggctgcagcacgagcgggcggccggacacgacgagcacgacgcacctgacgagcccgcacacgtccttgatcacctcgggccccggcgacgggatggtcaggttcttgttgtcgccggccgtctcggcgtacgggggttcgcccaccgctaccaccgcgtactcgtagccttcggcgctcttggccaggtcgtccttgtccgggcgctccacgtagtccaccgacgtcttcttgtccaccgccttcttgatggcctccaggatcgtggtgccgacgccggtgaggttgttgcccctctccccctgccacttgatggtccagccgccgcactggctgcccaggtcgtgggcgtggctgccggcgacgaggatcttcttggccgtcttgggcagcggcagcatcggcttcgcctgccccttcttgctgttcttgagcagcacgagcgacttgcggacggcctcccgcgccagcgcccggtgctcctgcgcgccgagctccttggtgaggcgcgggtccgggagcgggtcctcgaagaggcccatggcgaacttgacccggaggatccggctgacggcgtcgtcgatgcgctccagcttgatctgcccctgcttcacctgcttggccaggtcggcgacgaactccgggtagtcgtaggggatcatcaccatgtcgatgccggcgtggatcgtctccttgatggagtggtagtagtgctggtgcggcgggttcgtgatgcggtccacggcctgccagtccgtgatcacgaagccctgcacacaggttgttaagtacagcaaattaaatgcactgacatgcagggacacgagtgttcgttctagctgcctgcctatcaatctgatgacaaccactacagtactgaccctgaagttcaacttgttcttgagcgtgtcggtgatgaggaacttgttctcgtgcatcttgaccccgttccagctggagtaggagatcatgacggaggatatgccgttgatgacggcgttgtcgtagggcggcatgtggatccgcatgaggtcgtggaagctcagcaccgtgttgttctcgttgatgcccctggtggtgccgccgtcgccgacgaagtgcttggcgcacccggccaccttcttggccccgccgacgaagggaacgcccttggggtgcttcgctgggacgtcgccctgcaggccggccaccatgttggaggtcatgagctgcaccagcctcgtgtcctcgctgaagctctcgtagcaccgaccccacctcgggtcacggcagacctgcatgcacaacagacccggccgatgacgatgacgacgacgatgatgatggatcggtcgttggggctccagtgacgacgtacgtaccgctacgcatggcgcgaaagtgtaggggatgccggtggccctggtctcgtgcgccgtggcctccccgacccgcttgacgaggcgggggtccctggtggcgccgaggccgacgttgtgggggaagatggtggcgttgtagacgtcgttgttgccgtgcacggcgtcgatgccgtagatgatggggatgcccagccgggtcttgagcgccgccttctgcatcctggtcaccatcttctgccacaccgacgccgacgccttctccgccggcacgctgccgccgccgctgagcacgctacctgcacgcgcaccgatcgatcgaggcacatgcatgcgcatcagtgagtgagtgagtgctatacttatatatcacggcaagacaagagacaaggattctatcactgcgcgccagccggccgatcgacgaccggcggtgatcgagtactgaccgacgaagtacttctcgatgacctcggcggtcgcgttggccctctcgatctgcgacatctgcccgatcttctcctcgagcgtcatccggccgaggaggtcctgaacgcgctcattgatgggctgcttcgcgtccttgtacttgacgtactgcgccgccgacggcaggaggaggacagcgaggaccaggcacgcggccgccgacgacaccgtcgtcatcgccgtcacagcaaccgtcgtggattcagtcggctgatctcctgcatttaggattttatattattagatcgacaagggattcatcagggctggcgcgtgtgcatatgttctgggactcaccggctgagcagagaagagagtgatggagaggagccgctaccaagtgactggattttaaagagactggcaggggacgtacgcgatcggtgcacgtcgtttccgcgctgcggttcgtagactggagacccgatccgatcgatccccgggtcatcgatcgggtgcgcgcgcgtgtaggtgtttgacacgagcgcatggctacgagtggccgcggagcctatctgaagtgaactgaacaacccaagacattagacatgttgctacaggtcaggggacggggaaagttcgttgcctagcatcgaaagatcactggaataatattgctagataccatcgaaaaaatccgtcgtgtcgtaaaatgccactgaaagataaaaaacgttaactaaatgttctgatttgtagttccaaacggactgtcacgtcgtgggcggtgcggcccgtttggaattattcattttggagaaactaaaatttacttaataaagtactctatttgggttagaatttaacattccatcacttttcacagctcagatacaagtctatctcaaattcatgtggtgcagtatagaaaatgattttatgtatcaacggaatatgtttatactttgcaacttataagatgttattcaactcatttccctatagtaaaaatgtagcacataaatattttccacatatttgctaataatagtatacaaatataatttcgtataaaaccatattagcttaattgatctttacctaaattactattattagaatgaaattcaattccaaggatccaaacggggcgcaagagtatttctaaatttcactatctaaattatcatttggagagtcatttgcatagaaagcattatctatattttttcaatcttcaacaacttgtgtatacgttatttgtattctatagagcaattcacgttttctatctttggtcagtgacaaacccgaaatagacgatagttatatttggataaccatttaaataagctgttgaagacttctttttaacaaaaaattctctatttatattatttagaaatagtatagagtctcttggagttgtacgcgtaatctatcccgactcgaaaaaacctctagatcgctgtctggggcaggcgggactcggccctgcccaagtatcccacttgcctgcacacaacttttcacagtgcgccagcgcctaatcatgtgctcactaggtccggccggcttcgccatttccatattgttggcgctg

SEQ ID NO: 24121 - DNA, 679 bp, Zea mays
taacaaagggcctggcttgtgtaaaaccaaaaggctcactctcatacatgatgacaacctgattttttttttttttttttttaaatcgaggatcattcttgattattttttctaacggacggcaaaagctttatcgtaatttttattcgacgaagaaaataaaaaaaataagacaaacgcattcttgattatagccttggcacagttgcatgtcgattgatactgcatctgtttccatatactagggcgcgcttgtaccacttctgtcttgggtggcaggaaggcgtccatggtttgagcagcttagaagatctggaagtcttctcaactgtggtcctccaagtggtctccccttcacgcgttttggctttatatcctgatcaaatatcgcctcgtgccccttgagccagatccgggtaacggccaggatcaggccggcagacaacagcatcgaccggccgaaggtcgcgccagttccaggtcttgagccatgtcatcatggcgccgcgctttaggtcattgtgatccttccggtgcaatccggccgacaaatgcaggaggtcgtagccctcgccacgatccgttgtgatcctttggagcgcaaaaattgtaggcaaacaaagcgacgtaggtacgcaaatttggcacatagtcgacagcacaacaccgtacgcgtgtc

SEQ ID NO: 24122 - DNA, 2564 bp, Zea mays
ttttttttttttttttgtggcacaagatccccattgtaaagcctaaatagcaacagaacaagatgcagatacaacttagatgcctgcctccagggttaaatatcagtataaaactatatgcatgatacataatcaagtttacaaattacaacacaacaactttaacaatctatgaacaaacaagtactacacccaaacaccacaagattctttttacagccatgctaagcagctagcgcaactatcaactgaacagagacaggcttctgcatctatcagattggttaattatagggaaaattagaactattattatagtcgttcaaaattccaaatctaataattcagtagtccatataaataaactctacagtgtgccccagccaaactgggcagacctcatgacaccgttcttccatagcaaatggaagctaagtagagatttttcccccatttgtccttcacatgctggctggggaaagcagacgttcttagagtctcctgtgtttcatcagcaggtttccttttggggatgctcaagataaacgctgcctgatcccatgtagctgcagtagccgtgatgcgaaatccattatcccatcgtcgatggataccctcacttggatacaagaagtcaagctccacaacctgcgccgaaaagccagaattccgggacatgaccactgcccaacgactgcctgctgtggccatagcagtaacataaaaaccctccttccattttttgtttatccacttgaaagggaatgagtcgcttactttgtaagattgctgggcatattgtgttcctctcgacatgaccaccagtgaactaccattgtttgcccctgctagcgcagtgatatagaagttcttctcccattgttccattatccattccttgtgaagaaaatatggagacagttcatacacttgagaagtaaatccggtgccagcatccattatcaaagcccacagatttgaacaagaggcaacggagcttataaacaaaccatcttcatttccctttgaaatgtgctgagctaacctacagtctgcaacattgtagtgatacctctgtttcataggccgccttgcattgtaaacactaatccattgggtcgcaggcattcccatccgaatcttctttttgggctgctcatcatcatcttcctccatcgtaaggcgacctctcttctggcctacctgaaatataagcttttgagcaccatctgtattgattggccttatgtctgggtttggaccaacaatgccatcaaaaagagaaatgtactttgcatagtttggttcttcatcaaactttaagttcacaacatactcaataaattgtcggaaaggttgtgggcaaaagcaacacaaagattctggagaagttgccatctttttcttgcagacaaggaaacctttattctccccctggtatccttgccaaggaaggcgaccacgcagaagaaatacaagtgtgtaggcaagagattcaaggtcatccctcctgcttccggttctccccaaatgagcatgcacgctagcataccgaacagttcctctgaagacatcaggcctctgatcatattcaacatgctctcctgtaccagtgtctttctatctggtagctaaaccaaggtcaacgagaaaaagtttcttctcttgtagggtgcctggaggtccaagcaaaaaattttcaggcttcacatctccatggacgtacccttttgagtgcatcttctccagtatggaaattgcttctatagcaatgcaagccaccatttcaacaggcatagagtgagagttattattccaaacatcccataggcttggccccaacatgtccataatcatgatataatactctcccagcttccctttgtagtgtactcttggtacgccatgaattccgctaagagtgttgtaaacttgccactcataaggagcaccatagttgcaacctttgctggttcgatgttcaaatttgattgcaacctctaaagcattcacaccgggcgtcctgtcactaacactaggagaggaaatgcgacgaccaacatatacttgcccaaaccctccctttccaagctttctgtcaagtctgtaactgggtgaattgccaatttgaaccgtctccgggagcggtgtcgtgctgccgtcgtcgcccgggccggcgccagccttctcgacgctccggaccacactatcgccgtcgtccatcccggcgcggagggaacccctccctttcccggtctctaatccagcggcggaagtctcctccttgaggcgaacgccgctttcgcttctgcggcggtggtggcgggtgctccctgcaggagccggactcgaggcggcaaggcctagagctcgaagacgagtctgagacggagaggaggaggaggctgtgttctggtcggcgacggggaggagatgagagagaacaaaatggaaagcaaaagcagaggaaacgagagcggctggaagattctggacggagatctccttcttcggttcctgccgcagacttttcgattaggatgttctaggtaatggtctcgtgc

SEQ ID NO: 24123 - DNA, 2811 bp, Zea mays
ctggctccatttcatgtcaaatacatcattataccgcaactatatattaaaaaatatggaagtggatttttctttcactcattaacttcatgccacacatgaaataaaaaacagaccaacagaaaactgtacctagttgacacatgacattagcatcatatttctaggggctaccggctacgtaaagtagagaacttgaacatttgtttgggggaaattcataaaattggagatggagccatgagttctttttgagcactgctacacgtatgacttcagtgatacactcagatacgactaggatcatttaatggctcatggtttatttgttcagacaaagaggcaataacagccatagattaacgttggtcgtactcctgtcgtacaggaaagtcctatgtgaagcatttcccgttctttttggaataacagttggataggtgtaactgcactggaaattcaattccctgatattttaagtattttctcaacacaaaaattacagtagcagaggctttcaacaatgctgattggcgaatacaatatagaaggggtctagtcattgctgaggtaaatcagtggtaggacctatgggggacaaatcagtaacactcatacagctgaagggcagcaagatgcagttcgagcctcagataaattcaaatcttatacaactaagtccttatataatttcttaactcatgggggtgtaattggtctccaagcaaaggtgccctggaaatgcaagattccggtgtaagttaagagtcctttggcagatgttacacaataaactgcaatccagtggaactgaagaaaaggggttggaaccgtaaaactaactatagttcgtgcagagagagaaggggacaattgataatattttcttcgattcgatgctctatagaacagacggtatggtgttgcatgctggatgtgtttgattggaatggcttcctgacatgacaagctgacttatgggagaggtgacccaattacagattcagagtcccttaacagttaagtttgtttttgttttcaggtttagcatgggtgctttggactaacagaaacaagatggcaatagaaaatcgccaacaaaccaagtgatgtaatgtaatcttaagttcttaacaggtgtagggttttttcagaaatggcgtccactgctgaaaggaaaaaaggcaagaacatttgacagagaagatgctgaactggctttatagcaccccaagctgttgtcttcaaacgtttgaaaaatttaggctgcttttgttctaataagctggtgagtaatgttgtatgttatgtctgtttgttttggaactcatctagggctattgtatccccagaggcccagaccccagactcgtgaaacaaacctttataatgcagagtatttctcgtctacaaataataaacttcatatttcccaaaatagcacgtcaagagaagtcacattccacactgaccctgtttggttaggctgtagctttgaaaagtagttgtaaactgtggactatggaaaaacagttgtgtgttatgggctgtgctaaaactgaaagtcgtttggttcttttgctcacaccccgtcttcttcctcgagatagatccccggctgctcacacccgaccagccaatattcgggcattcggcaaaggtggtgctccagcacggccaggaggaaaaatggtgttgtaaaaatcatacccaccaaaaactactgtttggctgtaaccttgggtggaagccaacccttacttttggttttttttaaaagccaaagcagttgaaaaggccaaccacaacaggtctagcctaacgctcgagcaatgaggtggcaaccttaagagaccaaattcatctataatcaaacccttagctagcaattaaacaagacattctcatcaagaacacctatgctacctatccatgccagcatactaagtcgatcgagtttacgcgttcgagctcaaatccgacggcagccatttgataccagcgtctagaattggtccagtccccaaacgtcgcccgacttcggaacaccgcgggagctaaggatagagaagagagatcctgaccgtctccgggagcggtgtcgtgctgccgtcgtcgcccgggccggcgccagccttctcgacgctccggaccacactatcgccgtcgtccatcccggcgcggagggaacccctccctttcccggtctctaatccagcggcggaagtctcctccttgaggcgaacgccgctttcgcttctgcggcggtggtggcgggtgctccctgcaggagccggactcgaggcggcaaggcctagagctcgaagacgagtctgagacggagaggaggaggaggctgtgttctggtcggcgacggggaggagatgagagagaacaaaatggaaagcaaaagcagaggaaacgagagccggctggaagattctggacggagatctccttcttcggttcctgccgcagacgattccttcgtcaaactcgtcgcccgcgtacgaaatagttccgcttctgttgcggagagacgtactattacggcttcgtattttgtcctaggaactgcccttcagaagttcagacgattattacaagcctgcaagtttaaccgataaaatgttgatgaagtttttatttttaaacgttaatttaaacgtggttttatcataatttcagaccataacataaaatcaaatattaaaacaaacaacataagttgaaatcataatattgtgcaaaatgacatgtttacaaccacattaccacaataacaagttcaactaatagcaagtcgacaac

SEQ ID NO: 24124 - DNA, 1942 bp, Zea mays
ttttttttttttttttatacgaaaatagtggccaaaaattaaaatcagttgttcagactgctgcagctacaatctatagagacagaatactgtataatcagtatacgaacattgctgaaactcgctctcttatcatgaaattaaccaacaacctcggtactgctggacagataaaacagtaagccttgttcggttattcccaatacacatggattagatgggattggaaaaaattaagaagtttgacttgtttgggattcaaactcatctaatctcactcaatctacatggattgagagctaaccgaacgagccctaactagttgaaagcaccgggatcctggccaagcagcctgccttgtgctggaagcagcgagcactgccattcagcaccgcgctctccatcaagaagctcaccgtcgacgccacaaccactgtgggtactgccaactggcctaaccttcacttcttttatcttgacatattccacgtaggggagtagaagatgccagcagagctgataggcaacaaagaagcaaaacagtctcagcctgccgcttccatggacgagaatcaggtccaggctgccgtcgtcgtgccgcgctttcggtgcgataacaggagaaagtaacccctgggcaggcttgcagaagtgattgcaaacaaaaatgccaagaaactccccgttcctggtaacccagtcgtctttgatcctaccgttggtctgtgtgcctctcctaaccttgccgtcatcagaaagctgttcgtgacgtttttcagccagtggtcttgattcagaacttctcccctgcagcgatgaagggagatagtccacctcaaatctgtactggggtaatgaaagaaacttcagaaggccagcaacaacgtaacggaagggaccgagctgcacgcggaacttttctgacagttgcagaacatcagctacgaaaccatagtaggaagctgtcaaaccaaaatgagtcactccagcttggatccattttacggcaaacacatctattggtgtgaaatcccccttagctaaagcgattgccgcagaaacaggatccctgatgccaagaacagtccacaccaatgaattatcagaaccagcaggtattatcccaatgggaaatcgaattgccacgtcaaaatcgtctctactaagtaatccattcaaaacctcattgacgatcccatcgccaccaacacatataataccatcagggaattttttgaggtcaacagtagaagaaagaacctttgcatgcccggcatatgctgtttcaatgacttccatcttgaagcctgaaagcttcaatgttgattgcactttctggtagaaaacatcccgagagctgcggaatccagaattaggattcaaaatgacaagcgctttacgaatagctccctgttttgtatttgattggtcttgcaaaacattgattgataaatagttgggcactcctctgcaggaggtactaaggtctgatgaacagtgtggtacgagcttcctcttctgggttaaaaagtaagcgtttcgctgaattgatttctttaatttccgaggcaaaggcatctggtctactggtgaaatttgcaagttagtggtatgagaatactgatagtagtagtttcttgaacgacatgtactgtaggtgaggcatccattgactccatcaacagcagcactacaggaaaccgggaggcggacaaggcctctagagctcatgatcgctctcggcgcgggccagctccacgagatccagtggcggcctccgtccgtgcccccgcgtctcaccgcaccgcagcagcgcaacccgccgagcccgcgggggcggggatggggttggggaggagcgtcctttctgaggcggcttcccaatcaagtcctttctcctcagctttccgagcccgcgggcccggggatgggttcccggccg

SEQ ID NO: 24125 - DNA, 2745 bp, Zea mays
gagtggttatgaatatggctttactagaaaaaaaagacaataatagtgttcatttcaatgttcaggaatctgacagatgtaacagaacaggtataagaacataccatagcctcaggaaatagatcatcttcaataaaaagtctccgagaaagcctaatctttgaaaggtgattggccaatgcattcagatccatggagagaaaaggcacctgaaagttggggagaagaactgttgtcacgtggatatgcgttgtaagccacaaccagaagaagctatagaagtgaagaatttctacatgcagagtaataagcccacactaaccaaatagaagtcttagttgcttcacatatcctattcccactgatattcagataggctaccattgtctagttaacccaaacaaattccacaaaatctacagcattaagcacaaagtgtggtacaccatgatcaattcatttttttccccaacaatctatcatctactagtacattatatatgataacattcaagataaggctgaaccttatgataggtctgtgttgcacaacacaaaacaatttacctcaaaatctggtgctaggtcgtcctctaatataaagttatcatcagcacaccaggacaagattccttcacctttaacttcgagcatagaggtagaagcctgcataaaatctagaaaaccacaaatcaatggacaatggtcttaaaagcggcaactgaagtaaaggacagtcctcaattaacacataccaaacacgtctatcatgaatattacagattatgcatatcatttgtggggctattcaacaaaggcatatgcagttacaatgagctaattcagctcgctaggaattatcaacaatataccaattcatccagtctaggagatttgagccgaactcaaatgcccgtatgaggacaacaccaaataactaaatagaatatcctagggtgtttggagtactaaaattttttcagaatcagtatgactagaatttccctaggcaccagtatctaatgcaaaattgcaaatttatatggatgatagcaccacaacttctgcctaagcgaaaatgacgatgaacttactcaatgtactaatagtggcagagcagaaggaaagtagcagccgaaacaaaagacggcggcactcactcaccaaatggcaagtcctgggaggggacacacggcgcgatgaggtctcgggccccggagggctgcgctcgggcctgctctagcaggaatccgaagtcggcacccttgctgcgcggagccacctcgcctgtccattcccccgcggccgcggagtcctccgcctcgccctcggcatcgtagcggtcccagttcgaggggaggttgcggctgcgggggccggacgaggtggcggcggcggcggcggcggctgtggcacgcttctgcctgtgcgctgccgcggcggcgggggtctggtggacgcggcggccgcgcacggtgtgcgagcgcttcgatttcgccgctgccttgggatccatcagggagaaccggaagaggggcgaccgtgcggggagagacgagacggagagggagaggtcttggcggtgcgctgttgcttctgttttttgcagttctgccctgtaatgttttacttattactattacatttgtttccctaaggtacttactttgcttgatgaatataaaattcgtcgggcccctcacgccggacaggctcttcactgtctcctccaccgccgctctcggaactgcatccgtccaaaacccttagcttcgcttcagtgtcttcacgggccgccggcggagatgcggttcacggcgtctccggtggtggagcttccggtcagcggcgcggtgttgactttcgaacaggacaacgactccttcgaggtgggcacctctgtgtggccctcgtccctggtcctcgtcaagttcgtcgagcgctgcatccgcgacccggccctcccctttgccgacgtgctccgcttcccgggaacccgggccgtggagctcgggtccgggtgcggaccggcaggacttggcctctcccgcctcggcctcaccgatctcgtcctcaccgacatcgccgccgtgctcccggcgctccgccgcaacctgcggcgcaaccgagttcacctcgcgcgcgcgccccgcctcgcccagctccactggaactgccccgcgcatctcgcgacgctagccaccccgcgccgcttcgatctcgtcgtcgccgcagacgtggtctacgtgcaggagtccgtgccgcacctcatcgcggccatggatgcgctcgccgacgccgagcgcggcgtggtgctgctcggctaccagatccggtcgcccgaggcgcaccaggtgttctgggagaccgttccggctgtcttcccggtcatcgagaaggtggcacgggagcacctcgaccctgagtacgcctacgaggaatccgatgtattcatactccgaagaagcccgcgtcagtgaggtcaggtggtgaacttttgccagcagtttactccccgatgttgtgtttattcagctcagaagttatgagcttctagtcatggtgactagtgaggatatgtaatagaaactccatggttgtttcttgatgagtcggtgcattgtgtgggttagtaaacaactctaataaaatgagatgatcagatcaagtcgtcttgctttttaaagaaaaaaaaaaaaaaaaaaccggaccactattaatatcataggcaaaggttcatgcttt

SEQ ID NO: 24126 - DNA, 1435 bp, Zea mays
ttttttttttttttttcaagaaagatctctacacggctaactggtataagcaaggtaggttcacaaaatattccgcgtttgatgttctgcttagtgctgcagccatgttccattttcttttcccttcgattccgttgtcccgggaatatggcatcttagtgctgcagccacattgaggacctttagtgcctcgaatcctaagctagataactgaatgaacaggagaatgtagtgtcgttctccaatcaaactaacggctatccatttgcactagtatgctccctcctattccgacgattttgaccgatgtgttcgagtgacccttgaggaacaaatccgtgacctgagtacaaccaaatagcttaagaatcctcaatgatggacagctgtcgacaatcagccccaaagcttcgtctgtcagttcacggcagaaggaaagatccagagcctccaatgaaacataacacttgcgagaaattgcaagcgcagtaaggtctccaacctcaacattgtttagcattagctcagtcaggcatcctccagatgcttccaaatattgagacacagcttcatcactgaatgcatttctttgaagctttagtttccttattagcctacaaccacgaagatgcatcactgctgagtcacgcagccgattcaagttgcaaaggtccaatgaagttattttttgacagtattccccaatagtcttgatggaagatgaggtaagtttcaagcaaccagcaaatgctaactccttcagatttaaaccatgtacaggaatgagccccttcacaaatttgtcacaaacagattgtattctagacattgacaaaacctctagatgcttaatcttctgtagagaaggaagaatcgtcatagcgcccacatttgtgcagtcatctatatagagttctctaagaactgaacataacttgtttgcaagaatatcgattccagatgaagtgagaagagaacactcgcacagatttagggagcataaagaaggcgcggcagagatgattgtgactaaaccattatcagaaagtcgataatttcccttcagagatattttctcaacaatggcatgcagttaggaaccttagctaaggtagttggcaatatgtagtcaggtatgcatctcccagatacatcaagctgtagatcctgcaaactttcagtgctgcatttcccaaaagttttctcaaagtcatcctcactcagccatgaacactcgctgagatgcagttctgtaggactgtcacacaatagtttattgagaagatgagtattcatcttcctggaatcacacagaatctttaacagcttgtgctttagctcctctgggacaccttcaagcgattgaatccattcagaatgttccgcaagggtatttaagcataccacttgtagtgatggagcaacttgagcttgt

SEQ ID NO: 24127 - DNA, 1263 bp, Zea mays
  misc_feature (30)..(30): n is a, c, g, or t
  misc_feature (95)..(95): n is a, c, g, or t
  misc_feature (113)..(113): n is a, c, g, or t
  misc_feature (202)..(202): n is a, c, g, or t
  misc_feature (254)..(254): n is a, c, g, or t
  misc_feature (271)..(271): n is a, c, g, or t
ttttttttttttttgaattcttcttatttnatatcagtttaatcggtattcacccattccatttcaactctccaaaaatcgatgtccaaagtagnattaaggatgtcatgatncaacgagttaacaacgtctagattcaaacgaattttcaaagaattcgttttcttttaaaaattgtgacaaggcaatgtgactgagatgnaagagcgggcattgcaggattggaaaggcaggctgccgttctgcatcagatntagggtgtggtctcccntgcctcactggttgtgatggcttctactacggcatcagaaagttctctacggtgagcagtgtagcagtgatttgctccctcgatgacacgcagcttgtggtttggtataagccttgcaaactcatacgcatcttccacgggtatgatctcgtcagctgaaccgtgaattgtaaagaacctgcactctttgctgatggaaaggctcgttgcgtgcaaatcatggctcagccgttccatcaagctctccttggttactctgtacaaaacatttcctgatttgtctttggcatcgatgtagccttccttgtttattctatccataaactctttgcctaggcgctcctcaatgcctttctccaaatgaaaccggccagagaggttaaccaccatggggacatccttgtagatagaggcatatagaacgaccacatctccacctttgctgtgaccaacaattgctgctacgtcgtacttctcctggcgaagatacaagacaacagagtgcaagtcagcagcctccttcttgtagttgccgtactggaattcaccttcactttctccatttccactaaaatcaaagcgaaacacactaatcccttgctttgttagtgcggccgcaaggtcagtgatgaggctatagtccttggagcccgtaaagccatggcagagaactacaaccttgtcagaccccatgtggtgcagcaggccgacgagtttctccccatgcgtgttcgtcatcagtaccctctgtgccggagcagggggattgggagcatcttgggatgcgagctgtccgccatggagaacgtgtgtgccgatcggggtcggatcagagactggcgttgcagacgccgccggccgcagaggtgattggtgtgcggctggcaggcgagtggagtgagcaggagggcggacaaggatccgggcaccaaccggcggcgtcggttgaccactgtgtgtccgaggggacatctcagtaattttcatttttt

SEQ ID NO: 24128 - DNA, 1326 bp, Zea mays
tttttttttttttttttttttttttttttttttttttttttttttttttttggattgaaattacatcttatttcactatcatgtctgatttgatattcaacccaattcaattttatactctccaatatcaacgtccaaacgtagcattaaggatgtcatgatacaacgagttaacaacgtctagattcaaacgatattttcaaagaactcgttttcttttaaaaattgtgataaggcaatgtgactgagatggaagagcggcattgcaggattggaaaggcaggctgccgttctgcatcagatctaggttgtggtctcccctgcctcactggatgtgatggcttctactacggcatcagaaagttctctacggtgagcagtgtagcagtgatttgctccctcgatgacacgcagcttgtggtttggtataagccttgcaaactcatacgcatcttccacgggtatgatctcgtcagctgaaccgtgaattgtaaagaacctgcactctttgctgatggaaaggctcgttgcgtgcaaatcatggctcagccgttccatcaagctctccttggttactctgtacaaaacatttcctgatttgtctttgacatcgatgtagccttccttgtttattctatccataaactctttgcctaggcgctcctcaatgcctttctccaaatgaaaccggccagagaggttaaccaccatggggacatccttgtagatagaggcatatagaacgaccacatctccacctttgctgtgaccaacaattgctgctacgtcgtacttctcctggcgaagatacaagacaacagagtgcaagtcagcagcctccttcttgtagttgccgtactggaattcaccttcactttctccatttccactaaaatcaaagcgaaacacactaatcccttgctttgttagtgcggccgcaaggtcagtgatgaggctatagtccttggagcccgtaaagccatggcagagaactacaaccttgtcagaccccatgtggtgcagcaggccgacgagtttctccccatgcgtgttcgtcaccagtaccctctgtgccggagcagggggattgggagcatcttgggatgcgagctgtccgccatggagaacgtgtgtgccgatcggggtcggatcagagactggcgttgcagacgccgccggccgcagaggtgattggtgtgcggctggcaggcgagtggagtgagcaggagggcggacaaggatccgggattccgggcacccaccggcggcgtcggttgaccactgtgtgtccgaggggacatctcagtaattttcattttgatcgtt

SEQ ID NO: 24129 - DNA, 5968 bp, Zea mays
ggccgcgggttttttttttttttttgttataacaaataaacacttttaatttggaatatagagctgtttattacaaatgaagaattgtttcggatgaatgctctatcgtgcttaggtcaattcccttgaattacatgacagctatacgactactttttacaccactgtcgggcaaggcagggagtctgaatacatatgtctgaacacatatgtatggcctggaacatacaagtgcatgaggtgctgctgtcgcacgagtacacgggattctatttgttaggcacgatctactgctttatttctgcctatgcaagtataactggtatttatcagtcgaactccagaacagtttcagcaacacgagttggtgcctcagaagaacttttcatagtcttgaggttgctggtcccaaacctccataaaacctatgtcactaagagaactgtatattggatcatccatcacagtaatgccctctgaaccgtttaggtccatcccatcttgaagttctgcttgtattgattggtagcatgacatatcagcaccaaggtaatctgaaattgcaagactatacccatcttggataccatgtagagcatcggtgttcaccggaggcgggttcatcatgctctccatgctagaatataccatctcaccttttgattttgacgcgtcacaagcaccggcttcaattggtatgtcatcttcgatatcaataacttgaactgacttatttcccaacagaaagggggcacatgtgtcagtattattcgggttgttaccaagagctgtttcaaactcaacttgttgattatcttgtaggtctactggacatccagcagtagagctttggcctaaacgagggtcacctcgcatgtcaacaacctctggactaccaaccaggttgagatcacgtattttaaatgagctagactggccaatcttttcctcttccactgtaacagcatcttctgctttgatgttaggtaataactccgaatcaactgttttccctttatcgggtggatcgatcaacaattcatcttgtggcggtgtcgcgtgggcgcccggttgtattcctttctcaacttgcaaattgaagttattctgagaagcaaatgtaggagacagttcatttgtctcattattatcctcaactttcataatgttgagggatgttcttctgttcttccatttcttcagtttcaccttgcgtttccttttcatgggatgccactgattctgccacttgattgcagatagcgctttggttattctgagaagaagcaaatgtaggacacagttcgtttgtctccttattatcctcaacttcataatgttgagggatgttcttctgttcttccttttcttcagtttcacctcgagtttccttttcatggaatgccactgattctgccacttgattgcagatagcgctttgttcagcatgttcttggtcttggccaaccagctcaactttactgccttcctcgatgctagttatggaattagtgttagcttctccatccattgccatattggatatttcttcagaagtaaccaaattgagctgttcagacacagtaatttctctttgacctggtccaacattcctgtttgcaagcactgttcgtggtcttgttggaactcttgcaaaactacaatagtttagcaaatttctagcgtcattaggcaaattgctctccataacagagacctcttccgacattgtgtcatcttcagacttctcatgcaaagtactgtcatcttcaaccttgtcattcagaacaccgctatgttcaagcctcccatctgagaccttttcacctgaggatactggcaaatgttttgtccctgcctcttcaacaccagcagaagaatcattgttgctattatcctcaccattcaatgcttgctcagctacgtctgaattagacaccacactgttctcctgcattttgtttgcctcattttcatcctccacctcttgcaaagcactagctttctgctggatattgctgttagaactagcctttgacccagtatcctccagctccgactcccccatcgcctccaccttcgatgatggcccctcccaagctacccccgacatgctactaccaacctcgtcaatcccaccaccgctttggcgctcccttttgaacccaggaggagccccatcatcatcctcatcatcataactccggatatcagaataccgcctgttcctccccctatcctttgtccaatctgaatacttattgtcagccccaaatttccttttcccccttccattatagttactaccgttgctgctactgtagtcgccaccacggttccgccgtgagcgggcgttacgaataccacgctcatcatcgatctgccgccggctattcctggcgatatggtatgctggggcttcctgtgtcaccgaaagcggcggtggaggtggaggcggtagctggccccacccaccagcgacgactgtgctgccgcgctgctgcaaggagccaggagggagcacgcccttcgccaccaggtactcggcagcgaggcggccggcttccatgagcacctcatgcttgttctgcggcagcagaggcagcgcggccgccgggaggggaggaggtggcggcgggtagaactgtttctgtccgcggctgtaggcgccgccgccgcgtgcgaacggcggcatgcggctgcggctaccggcatgctgataatgcatccgcgggggctcgtactcggatcgcggcagcggcaagctcacgcccttctgccgcgcccaatccattcccgcggtggtggaatcagatgcggcgagagcaaataaagcaaacaaaatcggagatgaggaatggataaaaataaacagagggcgtgcgaatcgaaccccaggcaggcaggacgaggtctcaggtgttgactgcggcgccggcgacgagggcgccggttgtgaccatcggagccgcgtcaaacggagtcgggttggtgtgcctgaattatataagctttgtttttatttgacagaaaataaaaggaagtttgtttgagagtgatatgtatgaacagttcgatattttctccatctatttaataatgtaaacctcgtttcaagttaaggaatctaaatttaactaagttcgtagaagatattactatgtacgttccaatctttggttaaatttattataaaaacacattacataattaatctagtatccatctgttttaaaatatagtttttagtctttttcggtctatatttatttttacgataataaatatagacatatataccaactacatttgtagaataattaataaatatatttttaatctaaaataaattatattttataacgaagtgagtaatgtttattatatatcatagatattaatatttttatatctatttggttaaaaaaattatttttatacatgtttggttaaaattaagaaactttaggataccatatttacattttttaggacgtaggatggaggtaggagtaaagaagttatcgcttcgtttgggagagctctggtgtcacgcaccttcatcgtgaatgtcaccgcatatgaggaagagagcaggagaggtccgaggaagaagagcggaagaaatggacgaatattgttctgttattcgacaactctattaccagcatctcatcgagtatttgtataacaatatatttgacacggcccacggcccattagtcaagtcatccttcggctcccgtcacccatgtattaggcctgcgcacgcgacggcccatccttccaacagcagcttcattcgttcctgcgcttgccgattggtgttcagagtgtactgaagccgatggtatgctgacattctcctccccttgagaagccgcttgacctcaagctggcgctgatggaaattggacacgtaaagcctcctcatcttcccaagtcgaaagtgctgcaccggagtctgaccacccaatcagcacctgccgaacagatttgcctccgcgaagcaccaccctacggtcgataatgtgcagaggaacctgaagatgagtggtagcatcgcgaagggttgcactcactgcctgaggacccaccgaacgcttgagctgagacacatggaccaccggatgaatggtagctgaagggggcagttgaagtttgtaagcaacagctccaatgcattggacaatgggatacggaccaaagtatttaaaactgagtttatggtttgctcgagtggccaccgatgtttgcacataaggctggagcttgagatacaccatatcgcctactttgaactcccgttcagtccgattcttatcagcttgaaacttcatcctttgttgggctctgtgaaggtgttgtcgtaccaacttcaccataagctcacgctgatctaaccaagtctgcagatcgagctgtgtcgtcgtatcagccgtagagagcccaaagtgtcgtggagacctgccatatagtacctcaaagggagacctgcccagtgaagaatgaaaactagtattataccagtactcggccagagatagccaatgaacccacttctttggacaagcgtgtgcaaagctgcgaagaaaggtttccaaacactgattaacacgctcggtctacccgtccgtttgaggatgataggaagaactcaacttcaatgtggtgcctgataatctgaagagttcctgccacagccaacttgtaaaaatcttatcacggtttgagacaatggattggggcaaaccatgcaacttgtaaaccgaatccagaaataattgagctactttcaatgctgaaaatggatgaagaagtggcacaaaatgagcatatttagagaacatgtcgactaccaccaaaatagtatcagcattgatggatttgggaagaccctcgatgaagtccaaactgattatctgccatgcagtttcaggaacaggtaatggttgaagcaatcctggatatttgcttctatcaggtttagactgctggcataccgagcaagcagccacaaactcttttatgtgggatttcatacccttccatgcaaacaattgtttaattcttctataagtcacaggaaaccctgaatgacctccaatggggctgtcatgtaaagcagtaactatttgaagttgaagattcccagtagctccaatccacaccctgcctttgtatttgataatgcctgaatgtaaggtaaaaggggctgaacccgaaacatccacagtcaaggcagcaagaagtttttgtgaataggcatcatcaacataactgtcaatgacctgatgcatccactgaggtaccactgaagtaatgctgaagcatgttggttgaggatgtggatgtcgagaaagggcatcagctgctccattgtcagctcctttcttatagacaatacgatattggagccccaaaagtttagaaaatactcgttgctgccacggtgtagtcaatttttgctcagtcagatgagaaaggcttctatggtcagaatagatcacaaactcagagtgttggagatactgacgccatttgtctactgccaacaatattgcgagatactctttttcatatgtggacagtccctgatttttaacacccaaggccttactaacaaatgctagtggatgactaccctgcaataaaactgcacctatacctttaccagaagcatcagtttcaatcgtaaaggttttggaaaaatctggtagtaccaatactggagcagaaacgagggactgtttgagaacctgaaaggcttcttcttgtacttgcgtccacacaaacaacgctccttttttcagcaaatcattaaggggtcgggcaatgacgccaaaattcctgacaaactttctataataccctgcaagacccagaaatcctcgaaggtctttgcaattagtcgaggtgggccaagaagataccgcttccactttagttgggtcagtagccacccctt

SEQ ID NO: 24130 - DNA, 3916 bp, Zea mays
tacaaataaactattctatttcggaatatagaactgtttataaatgaagacatgtttcagacgaatactatgtcgtgcttaggtcaattcctttgaattacgtggcagctatacgacaactttttacaccgctgtcgggcaaggcagggagtcaaagaactgtttcatacgaatatctgctctttgagctgccgacgcagaccctggtattacagaagggaaagtgcttcgcgtaggatgcacccgtacaaaagccccaatatgcatggcctggaacatacaagtgaaagagctgctgctggcgcacaagtatacgggtttccagtttataggcacgatcaggtgttttatttctgcctatgcaagtgtaactggtctatttatcagtcgaactccagaacagtttcagggatacgagcgcctcagaagaacttctcatagtcttgaggttgctggtcccaaacctccataaaacctgaaaccataaagaaaaacatttaaaaaacaacgcacaaggaccaaggacaattaaagaatcaaatcacatatcttatatgtcctgttcaattgttcaacacattcagagtaaaaaaaaaagggaaatgaaaaaaaatgccagcaaagccacacagtcaccaagaaacgacaatataataaaaccaaataattgtagaaagaaaaggtgaagaagcagaaaagttacctatgtcaccaagagaactgtatattgaatcatccataacagttatgccctgcaggaacaataacaaagagatgatgtaagtactccattacagatgaccgaaatgaggcaatatctgatttgaaatatttaagtctatatgtggtagctaaaaatagcaggaaagctcacctctgaaccatttaggttcatcccaccttgaagttctgtttgtattgattggtagcatgacatatcagcaccaaggtaatctgaaattgcaaggctataaccatctgggataccatgtagagcatcgttgtttgccggagggttcatcgagccctccatgctagaatataccatctcacctctgattgacagcagattgtattagtacacaaaaatgaatcagatttaacatatgtggccagatgccacaggggataaagaagcatgtccagtaaatattgtacccacagttaactaatgcatagattaacaagggcagatatggctgctccatattaccagtgcaccatgcagaaataactggcatggaccaataataattagattagattgaaagacactgatccatcctcaacactgctatgacagtttctaaaatcaaaatgcatgctagccagaaatctgtaacaaatctggtcaatgttcttaaggatataatttgattgccactacagcccaaagcccggaattaattcatgttccatacttccaattccagtagtagctatgaacaggtttcatgttttccttgaatgaaaataaatgtgaaaatgaataccatgctattgactatctgacataatggcagatttgcttccaatcagtcataaaccaactagtagcatgatagctgccgaccttgtttgccaacatcacttttttttagaaataacttgtagctaccactcataatttctattacaaaaaacctaaagttaactagtccaaaacaaatttcacatggtcatagggctctgattcccagtattttatcaacacataatatttaatgaaaacaaaacactctccatgactctatatattctttcaccaggatgaaacagcagagactcactttgactttgaagtgtcacaagcaccagcttcaattggtgagtcatcttcgatatcaataacttgaactgccttgtttgccaacagaaatggggtacatgtatcagtattatttggattgttaccaagagctgttccaaggtcaatttgttgattatcttgtaggtccactgaacatctagcagtgaagctttggcctaaacgagggtcacctcgcatgtcggcaacctctggactaccaaccaggttgagatcacgtattttaaatgagctagactggccaagcttttcctcttcttttgtaacagcatcttctgctttgatgttaggtgataactctgaatcaactgtcttccctttatcgggtggatcgatcaacacttcatcttgtggcggggtatctaaattgtaaatttgtattcctttttccacttgcaaactgaagttattctgacaagaagcaaatgtaggagacagttcattagtctcattattatcctcaacttcataatgtcgagggatgttcttctgctcttccatttcttcagtttcaccttgtgtttccttttcatggaatgccattgattccgccacttgattgcagatattactttcttcagcacattcttggtcttgaccaacgagctcgtctttactgttttcctcaacattagttatgaaattggtgttagcttctctatccattgccatctgggacatttcttcaggagtaactggaatgaccagttcggacacatcaatttcttttttagctggttcaacattcctgtttgcaagcactgatcgtggtcttgttggaactcttgcaaaattacaataatttagcaaatttccaacatcattaggcaaattgttctccataatggagacctcttctgacgttgtgtcatcttcagccttctcatgcgaagtactgccatcttcaaccttgccattcagaacaccactatcttcaggcctcccatctgagaccttttcacctgaggatactggcaaatgttttgtctctaactcttgaacaccatcagaagaatcattgttgctattatcttcaccattcaaagcttgctcgactacatctgaattagacaccacactattctcctgcattttgtttgcctcattttcatcctccgcctcttgtgaagcatcagctttctgctggacattgctgttagaactagcctttgacccagtatcctccagctccgactcccccatcgcctccaccttcgatgatggtccctccccagccacccccgacaccctactgccaacctcgtcaatcccaccactgcttcggcgctcccgtttgaacccaggagccccattgtcaccatcgtcatcataactccggatatcagaataccgcctgttcctcccactatcctttgcccaatctgaatacctattgtcagccccaaatttccttttcccccttctattgtagttactactgttgctgctactgtagtcaccaccacggttccgccgcgagctggcattacgaataccacactcatcatcgacctgccgccggccattgatggccccgtggtaagcttggtcttcccaagtcacggaaagcggaggcggaggaggaagctggccccaccctccagggacgactgtcccgctgcgttgctgcagggagcccggtgggagcacgcccttcgccaacaggtactcggcagcgaggcggcctgcctccatgagcacctcatacttgttctgcagcggcagagacagcgccgccgacgggaggggagacggcgggtagaactgcttccgtccgcggctgtaggcgccgccgccgcgcgcgaatggcggcatgcggcttcgactgccagcgtgctggtactgcatcctcgaggactggtacccggatcgcggcggaggcaagctcacgccctgcctagggcctaggcgcgacgaggtctcaggagttggcggcagcggcgaggtcgccggcggtgaccatcggagccgcgtcaaacggagtcagggttggcgtcactgagaattacaaatttcgctgtttcttctttttgagagaaaatgtgaaaaagtttgagagtgatctgtgagaacagttcgatgtttcgt

SEQ ID NO: 24131 - DNA, 1344 bp, Zea mays
acagcgcatcaagaacatagatataacaaataaacaattctatttcggaatatagaactgtttataaatgaagacatgtttcagacgaatactatgtcgtgcttaggtcaattcctttgaattacgtggcagctatacgacaactttttacaccgctgtcgggcaaggcagggagtcaaagaactgtttcatacgaatatctgctctttgagctgccgacgcagaccctggtattacagaagggaaagtgcttcgcgtaggatgcacccgtacaaaagccccaatatgcatggcctggaacatacaagtgaaagagctgctgctggcgcacaagtatacgggtttccagtttataggcacgatcaggtgttttatttctgcctatgcaagtgtaactggtctatttatcagtcgaactccagaacagtttcagggatacgagcgcctcagaagaacttctcatagtcttgaggttgctggtcccaaacctccataaaacctatgtcaccaagagaactgtatattgaatcatccataacagttatgccctctgaaccatttaggttcatcccaccttgaagttctgtttgtattgattggtagcatgacatatcagcaccaaggtaatctgaaattgcaaggctataaccatctgggataccatgtagagcatcgttgtttgccggagggttcatcgagccctccatgctagaatataccatctcaccttttgactttgaagtgtcacaagcaccagcttcaattggtgagtcatcttcgatatcaataacttgaactgccttgtttgccaacagaaatggggtacatgtatcagtattatttggattgttaccaagagctgttccaaggtcaatttgttgattatcttgtaggtccactgaacatccagcagtgaagctttggcctaaacgagggtcacctcgcatgtcggcaacctctggactaccaaccaggttgagatcacgtattttaaatgagctagactggccaagcttttcctcttctattgtaacagcatcttctgctttgatgttaggtgataactctgaatcaactgtcttccctttatcgggtggatcgatcaacacttcatcttgtggcggggtatctaaattgtaaatttgtattcctttttccacttgcaaactgaagttattctgacaagaagcaaatgtaggagacagttcattagtctcattattatcctcaacttcataatgtcgagggatgttcttctgctcttccatttcttcagtttcaccttgtgtttccttttcatggaatgccattgattccgccacttgattgcagatattactttct

SEQ ID NO: 24132 - DNA, 690 bp, Zea mays
agctcgaattccgttgctgtcggccccttctcctccaacaacttgaaaaccaagaaacttatcataccacataagagccgtctctaggctcttatctccatttgcatcactttcagcttcaagggattcaatatcttttagttgatttgatatggcattcatgcattcatctcttgtagacctacggtccatagccaagtgtctaagatgttcatttgttgcagtggtgtttgaaatcgactcagtcatgaacttgtgttttgaccttctgcttgcttggacggagagggcctgtgctagatctgattctaatttccggaggtgttgtttttgttcgctgagttttgctcggttggagacggtctggttggcgatggagcgcgcctcgaggagggcggcgctgaaggcggaggaggcggcggcggcgcggtcccgggagtcggtgatccggcgctcgatggcggctcgcttgtccttcatcctccggcgcagatcggcggcggcgtcctccgccatggctgcagcgtggacggcggtagacattggagaagcggaggggctggggaaacctggactgactggatttcaaatttcttttggtggggaaaaaggagaaaaccacgtcatcatccaacctcgttccgttgtttcttggattgggctgggcatggcgcctaaatgggccaaaat

SEQ ID NO: 24133 - DNA, 4085 bp, Zea mays
  misc_feature (2503)..(2503): n is a, c, g, or t
cttgggacagaaaaaggtaataggaatatatagcatgacgtaccactgattatagcagcctggagtctgtctctcacgaccctcacaaatttgtaaagatcattattacagttaagatccttcaccaattcttcagcgccatccacagagggaacacattgtactactgttatcaacaagtaaaggaatttcaacattatgtgacatctaatacaactatcagatggctcaactaaaggcctcaactaaaaacctgtaactcacatgtgtatcttccttcaacaagctttacgcaaaaatagcactccttgtcaggactttgcacatcaattttattgaacataaatttcacgccttgcaaaaaaaaaaatcatgtgtcagatgctattgcatcaatctaatatactaattgactcactaagatttcaattaccttctcctccaacaacttgaaaaccaagaaacttattgtaccatataagagctttctctaagttcttatcctcgtttgtgtcactttcagattcaagggattcaatatctgccatcaaatcaagatttactaaggcatatagatttcaaaacatgcatatccttaaaaaaagggaaaatgagttaagtttacaataaggctatctccagcagcttaccatcatatcactcatcgcatctcttatttcaaatctcactatgtgaacagtgtagtatagtctatagtgcaaaaccgtgttttgcacgaccataagcattatctgctagaaatagcttaacagagatatgatgtatatacatcaaagtaaacccaggttttttagaagcaacagtaattcattcgtatctgagagatcaatagaacccctctaaaccgagattttgtaatattaaattctggtaaagcactgctaattgaaaattcagtttagaacagataccagggaccattcatgtaaataagcaaaacagaggcttcgttaataaataaaaaacaggggcttcatcgatataaagaatcccccataataaaatcctaaaacaactacactgacgtacggtgataaagaatcacaaggattcaaatatgtggtttagaagggaaaaaatgactgaaagctgaataccacaaatggtaacttgttgactgtataatcactaataagtaactacaattacctttgagttgaattgatatggcattcatgcattcatctcttgtagccctacgacccgtaaccaagtgtgtgagctgctcatttgttgcagtggtttttaaaatcgactcagtcatgagattatgttttgaccttctgcttgtttggactgcagtgaagaaaacttccatgagatgagattgataaagaaacccgggggcaagtttggaaccaaacaatagaaagaacagaaaattagcacaagtgagatactgttagcatgtataagagtgacaaaatgaaatgaacgatgatgatacatttcactataattacataacagatgcagtcgcatggaaatgcttgtgcagttgtgctcaccggagagggcctgtgctagatctgattctaacttccggagatgttgtttttgttcgctgagttttgctggcattccaaaaacacaaatacgagtaaagtaattttgcaaataatattgagcttaaacaactagatatagataatatgctaatggcaactgttgtactgaaaggcaacgaccagtgctatttgtcaaattgatgaggtgctataaggtctggatgaattgagaacggccacgttgagagaacacctttagcaagaaatgggtactactactaggcaggtgccactgagtgagtacaagtccaacatagtactagtaggtggggttgtgtcaggcagaatcgagcttccctggtaaaaacgtggactggttctaggagcctatgtggtggattggatgttggctccccacggaatacaacacactatggacctggctgatccatcatgatgactaaaccatagatcgagggcgaagccgaaacaggtaaaaaaacaaaagtgggggcgaagaggttgatatgcctcggttggagacggtctggttggcgatggagcgcgcctcgaggagggcggcactgaaggccgaggaggcggcggcggcccagttccgggagtcgatgaaccgccgctggatggcggcgcgctgctccttcatcctccggcgcagatcggcggcggcatccgccattggctgctgcggggtggcaccgcggtaggagttggagaagaagaggagcctggagttcaaaattctttttttgggaaacgagaaaaaaaaacacgtcatttatccttgtcccttctcgtcgtgcaagggcaaggggaaaggaaccaaaggatgtcgtcggctcttgggttgggctttcttgtaatgcatgggccaaaaccttaagaaaggctcagtcgtatgtatttttgtgtttgatttgaatctcaactcgtaaaatcattttaaataacctccncagcctagttagaagtaatttttaagatcttttcttgcctttttagttaaaaattataataaggtttttgaaccatagaaaataactaatttcaagaaaagtcttagatatatattagtacaacaaaactccaataaaacatttataactcttttttatagcaatttgaaaacttcattaaccttcacacagcattaagggcctgtttgagagagctttacttcaaatgcttcagctttggttttccagttttactataaaacagctccatcaaattattaaggtgagttctaggagcgtttggtttgtatatggactccaacttatatagtacaattgatttgtgtgggtttccttgattacccttgatgattagtgtgttgtcaccagagagaacggaagttgtatgttgcgtaaccagtggtatggtgggtaatttttgtacagcttcatgaggagatataaaaacagtgtttttgaagcaccctctaaggaccttcatgaattttatgaaacgggcctctagtttcgattttttttaaaactaaagctcgtggagctagacctgtttgggtcgaagaagttcaaacaaaattgaaatttttgaagtgaagctctcccaaacagggcctaaatcgctggcgaccaaatctgatacaacgtctgaaaaattatacatccaaatcaactcttgactatcagaaccaatagtagcaagatgatgtgctaccttgttacacattctaggcgcaaacaacaccttaacatcattgaaacatgacaaaatcaggaacttaagctccctaataatcactccatcatgtgaatcatcccaatcattcgatgtgagggcatctcaaagacacttacagtctgtttcaatttccagagtcatcataccttggtttgaagcaaaattcagagcttttaaactcttgaaagcacgtcaaaaagcttctaatgattaaattgaagcctagaatatttaaaaaacaataaaagttatttgaacaccctaatggatacttagccatattttttaaaacacaaatggaacttaaagagagtttaaaagacggcaacgaacgaaacatgcatctactttgcagggaagccatcagagcttggttcctggtagtagttagtgtggttattgcagtaagctggtagtcatcctcttttctcttgagacgagctaatcctttttcagcggagcctgaggtgagattgccctggatttttttttataaagaaagcttatattaaagttaccaagtacattacatcaagaggatacaaagccttggtacaaaactttcggcttctcgcagccaactaaagtacgaaaccacagtaccgaagcaaaactagatcgccacccatgtgcccagggaaaaaaaaagctctcatgtgcccgagaaaaaaaaagccatggccgtccgccccaagagtcgcgaccccgcagcaaccaacggctgagcctcctctcgcccaagagattgccctggatggctttgcatatatcaatgacgagagacctcagacctgctcctgctgtgcttctcatccctcgtctctgcag

SEQ ID NO: 24134 - DNA, 1247 bp, Zea mays
tgaaaacaaatgctcaagcgtttatacattaccattgttattaagaatgattagtaatacaaaactgacgtacagcgccagttttttgagtcagaaatgcaatcagcagacaacactgtacatcgtcgctattgctagtgtgcataacataggggtccacaagtgctttaacttttactgtacagatctccacatcccaatgctattggggcagatcaaacaggaactcgagatggagaatccccttggctatcaagtgtagatcccgtttccttcccaccttcagatgatttttgctagccctttaactggacattcctgattctttgactgacttcgattaatgttgttttcacttgtggaatccagtgatgacgctgagaacgatgaagatattatggatgataagtcagggcaaaatgagcttgacaacatatttccactgattatagcagcctggagtctgtctctcacgaccctcacaaatttgtaaagatcattattacaattaagatccttcaccaattcttcagcgccatccacagagggaacacattgtactaaggtgtatcttccttcaacaagctttatgcaaaaatagcactccttgtcaggtctttgcacatcaattttattgaacataaatttcacgccttctcctccaacaacttgaaaaccaagaaacttattgtaccatataagagctttctctaagttcttatcctcgtttgtgtcactttcagattcaagggattcaatatctttgagttgaattgatatggcattcatgcattcatctcttgtagccctacgacccgtaaccaagtgtgtgagctgctcatttgttgcagtggtttttaaaatcgactcagtcatgagattatgttttgaccttctgcttgtttggacggagagggcctgtgctagatctgattctaacttccggagatgttgtttttgttcgctgagttttgctcggttggagacggtctggttggcgatggagcgcgcctcgaggagggcggcactgaaggccgaggaggcggcggcggcccagttccgggagtcgatgaaccgccgctggatggcggcgcgctgctccttcatcctccggcgcagatcggcggcggcatccgccattggctgctgcggggtggcaccgcggtaggcgttggagaagaagaggagcctggagttcaaaattcttttggggggaaacgagaaaaaaaaacacgtcatttatcctt

SEQ ID NO: 24135 - DNA, 2018 bp, Zea mays
tttgtaagattgaagggtatccattaatcctgtaaatgaactcaactgggacagtcaaataaggtgtctgttttcttctttcgtctttaatttggaatcgagagactgctggatcggtaacaaaactgcacctcatagttgagaaatggcaagacccatttgcatcagttacagctgtgttaaaagaagtgaaaaccatgtcatgtggtgtgcgcataacaacccctagacagcttaagtagctattcctagaaggctacaagtcccaaaacaaccaataaaagaattccatattccaggtagagggctgcctcgctctgaacccgatggctcatgtaattttacaagtgggtacagcagagctgcttcatcggatcttctggctcttgctgtctagcatcctttcagatccaccatgaaatcaattcagcgtccaaacaactaggcttaggcggccacggtcttaacttgatgaacgctgatgcctcacacagacaagatcatccaacttgtttccgtccatcttgtatagagacacgccacccatttggatatggtgttcttgcgcttctcttctcagcttctcaaacggaagcaactcccacttgctgtagtttgaattcttgcgcgtctcgctcatgtctgaagtacctgataccggtccgtagtctgggtcgactgttccccataccttgcagttgctaaatggccccagttcagctagctggccagtttcatgcttctttagacgaaaagctatggtgtgtgcccttctgatctcttctttgcttggtatgtctgaccaatcttccactctctgtgctctcatgggggaatggatacgaatgaccccaaggcattctagaagttgataataagctcggccttgcagtggattgtgccctttcctaggggctgagaaataccgtgtccattccgtgtacccaggatcaactgtaaaaccatacatgtcaacaatatcacacatggaaagggcaagttctatggacttcatgccagtccctttagcacctcttcttaaaactataccttgaaaaaggtagacaggatttggaagttcctttatcaccgcattgatttctttgtgcgtcaaacttttaatgataagtgcctcatcggaggagcccttcagtattggtgccatatttcgagcagcaccccggacaaccagtcgaaagtctcttttcaatccaacatgttttgcatatttcttattgacaggtgcctcattgtcccgaaacacggcgtcatgcgcatcaatctcttgtccaaactctgttttcaagagatctcctgagttaccaacaactgcacatgtcgcgaactggcgtggatggaaagggggtttagcaggcagtaaaatgctaagaagttcatcacagagagtgtggttgtaacatttatcagcaccaagctgtgcgatccttttagctgcataatccaaccatccatccggcctcacatccaagtattcccttgtcaatacagttgtcatgttgcggtactgttcccacaataggatagtttcacagacatcatatttgtattctagaggttcaaaaatcttgaactgagcattataccaggtgctgttggtcccttcaggaaatttaaggaccagcttgcagtgatcaataatatgtgctgtgagaccaagtcctctgctagccacgcactgctggacgcgggactggaaccccgcgagctcgcgcacgtcgtcggcgtccagatccagcctcctgcccggcgcccctggggcggcgaagaaggaggactggatggagaggacggcgaggcagaaggcgagcgccaggcccagaagcagcgccaccgtcggccgccgctgcgccgccgccggcaggtgcgccctcgtcatcggcggacgcgacgcggtgccgcggatcggaggcagcgcgctccggaatgagtcgcagaagaggggaaagggcgcgcgtccgtcacggagtgtcaagcgtggaatgctgagtcccggccag

SEQ ID NO: 24136 - DNA, 1655 bp, Zea mays
ttttttttttttttttggaagcccaagaatcggtattctacacaccttgttcatcatgaatttttttgtcagagttacagttcagcgtagcagcacacctaaagaaacgattgtttgcaccaagaattacagcccctggaactcaggcctcggcatgagatgtatcccacggcatctcttctttctttctttcttctttctctatcaccaacaatcagcaatacaactgtaatttgtaaggtactacctccgttcttttttatttgtcgcatttagttcaaaaatgaactagggggcggcaaatattcgagaacggaggtagtacatcagtagggggcaccctgccctcaggcccaacgcctgctagttgtcgtgattcagcgccataaacttgcactgctcactcatcgcctggagctgcgcctccttcttgtcaagcattgcgcgtagcctcacattctcctccatcactttgtggacttcagcttctttctgagctttctcactctcaagctggttagtcttggctactagtctgtcaaagagtttctccattgtctcaaattgcttttctgatgagagaagagtttctctaacactaaccagagtgctaacataagttctcagcgactcgaaatcatgctttacccgactaagctccacctcattttcagcagcgcgctgtctctgccgagtggtctccagcaccatatcctcaaccctttgcctcatctcattcaacatcccgttcgtgccaacggcaaacttctccatctcctcgactttggcggacatagtctcaacctgcaacgtcttcctcctgatctcttccaaccccatcctcaccttttctttctcgttagcagcttcggactcggccacaatcaccctcttcacaagcgactccatcacatccgtcacgacgcggatggatttgagaatgtcgtccacatccacatcccctccaacggcatcgccatgctcaggacgagcaccaccctccgccaccgtcccgtcaacggaagctcccccgcagggcgcagggtcggcgcccttaggccagtccgccagcggcaccccgtgccggtcgacgtacccgacgccatcctgctgcctgatcccgcaggaggtgtgcgcgaggtgcggtatcgccatgatcctcgccttggacttgaggtacgccagcagcgtggcgatggtcttcaccctgcggcacaggtgttctagctccttccgggaatcgccctcggagcaccgcaacccgaccttcgcctccacgagccgctcccgcagcgcgtccacctgagactgctgctgccgcagctcctcccgccattcgcactccccggcgggaaaatcgctccgatcgggagcggcaggctgctccatgggtttgacacaccctccttccgaccggaggcgtgagcacgaggtcggcggcggcggcggatcgggtgggcgccggcgccgctgcggcggcctgtgacttcgcctggggcacggcggcttcgcgacgctagttgctcctcgtcgtcaccagctcgtcgcctttccccttccttcctccgcctacccaccctgattctgattgggttttggtatgcttcattgttccttctcttttctttgcccctgcgctgcccggaggaaaattc

SEQ ID NO: 24137 - DNA, 2668 bp, Zea mays
cgacctgtagaagcagaacacattaaacgagggtcccgaatacaagtctccgtgtgtcggcgcgcggcggccagactgggtcacggggcacgcgacagcgccccccgaaccgaacttccgaacccacggtgccactgtctgactgactgccatagtgccatgcgggctgcggccatgcctgcctcacctaccgaaattcctttccggtacccactgagtctcgggacccacttgcccaaacccatctcggcatctcgtcgtggccgcatgacactcgcgccgtacctttcagaagtgtcatatttacgtaaatcccccgctaaaaaaggtttcgcgccatacgtcatgtactcctgtccatacctgcttcgctacaggctacatgacagattatacgtactgtaaatgaccgtcaaaatacttctaatcctggatgaatcatatcccgtacggccgtaccgtagctaaactgatatacgattgcgttcctccgccccgccggggtccgcccggcgggaatttggtccccgcttccctcccccctgttcctcgcgttcctgtcaaggctcctgagcctcgccatcgctcgcggcatcgccgcttgccctccccttccccaagcgaataaagtgccggaagcgcgcgcgtcaagcgaagccctcgcccccgcgctccgctcaggatcgggagccaccccctagggttagggctcggttttgcatcgttccggcgtcgaccgatgcgcggcgcatggcggcggtgaactgcctctacgtcgcggctgcctctacggcggccagcgccgccgcgctgcagtggtgggcatcctcgctcctcgacggcgacgctggcgcgggcgaggatggagcctggctcggagccgtgctgcggtcaaaggtcaccgtcgcgctcctggcgaatctggcggtccacgtgttcctcgtcatcatcctcgcgctcaagactctattttttgttcagctaacttctatagagaccagaaaagtgttggagcacatcattaactatgtaatttacaagggaacttttctcccactggttgtgcctcctacttctcagcaaattatcctttggtcaacttggttggtcattctttgttcgctgaagatgtttcaatcattggccagagaacgtctagagaagctcaatgcttctccctcagtgactccttcaaaatattttcgtgtgtactctgcattgcttctggttttatcagctgatctactttggatgtggctctgtgcagggttttgcagcttctgtaattccaagttgttttggctcctgttctttgagccacttagtattgcctttgatacactgcagtctattatggtgcatgggtttcagttatttgacatctggcagcagcatctaatggaaagtggtgcagacttccttgatttacagaaatcttataagcaagcagcaggatctttttctgaatggaggggcaagcttactaggaactttggttttgccattgatttgataagcttgttgatgtcacttggtcattactcgatgatattttggcttcgtggtatggcgtttcatctggttgatgcagttctcttattgaactcgcgtgctcttatagtttcctttttgaagaggattaaagctcacatcaagttacggaaggcacttagttcactcgatggagcacttccagatgctacgtatgatgaaatttgtgcatatgatgatgagtgtgccatctgcaggggaccaatgggtcgagctaaaaagttgtcatccaaccatctatttcatctagcttgtttgcggtcatggttggatcaaggactaatggaaggttactcctgtccaacttgtcggagaccgctcttattgtcatctgaagggcaaagaaggtctacaactgcggaggtagcaaatgttcagcgaattgcggaacaacttactatggggatgaatcagcagagagttcctggtaatgaacatcctgttgaacagcagaacccttcagatgctgtttggagaggtgctggtctggatgctagctggattccaccgtggtcaagccctgtgatggaccatccgagttcctccagtgcagtgaggtcagtaggtcttactggagttcagatgatgatgacgcagttggcttctgtcaccgacaattatgggcatgctgatggtacctggaacctatggcctgaaccgatggcagggtcctctcttgttccttccacttcctcgatttccggcactgcatctgcttctggattgcggctccgtggtagtgcaggcataagcaacgggagtctttcggaggtactcactatggtagatagagtgcgggaagttctacctcatatccctgatgagctaatcttagaggatttgatgaggacaaacaacataaacgcgactgtgaataatcttctgctgatgcaatagtagatacgtcaatacaacatataagtgtgacgtttactggctataaaagcttataagaaaagtatgtgtatagctaagggcgagcctgggtgtaacacgtctttggttctgtaataaaagcccttttttctttatttttgtctgcagaggtctgtatagcaaccaatattatcggaataaaatttgttttgctactaaaaaaaaaaaaaaaaaagcggcc

SEQ ID NO: 24138 - DNA, 874 bp, Zea mays
acggcgtatcgacccaccccagagagcgcgtgggctcctcgccggccgggggcgcactttccatcgaaagcccccggcctctctctctctctcgcctcgcggcgttggattgaatggcgacgaccatgaacgtcagggcgctgtgcctggccgtcgcgaccgtcttctgcgtgctctcacggcagagcctcgccgccggcgagggctccaaggaggcggacaggatcgccgcgctgcctgggcagccaccggacgcggccgtccagcagtactccggctacgtcagcctcgatgacaaggccggcaagtcgctcttctactacttcgtggaggccaccgctgatccggctacgaaaccgcttcttctctggctcaatggagggcctggctgctcttcgtttggaatcggagcattccaggagataggtcctttccgcgtggacacggacggcaagaccctctgcaatttcaaatatgcctggaacacagtggcgaacgtgctgtacctggagagccccgtgggcgtgggcttctcgtacgccgccaacacgggcgtgtacaaggtgatgggcgacaacatgaccgcggacgactcgctccagttcctgctcaagtggctggaccgcttcccggagtacaagggccgcgacttcttcatcgccggcgagagctacgccggccactacgtcccggagctcgccgcctccatcctcgccgccaataacgcgcggcccaaggacatggcctccgtcaacctcaagggaatcgcgatcgggaacgccatcctggagttcgcggcggagcagagcgcgttgtacgagtacttgtggcagcacgcgttcctgtcggacacggcgcacacgctcatcgggca

SEQ ID NO: 24139 - DNA, 1690 bp, Zea mays
attgggtacctcgaggccggccgggagagtgactaacgtgtagaagaaaatgaaagtggactaatgaactatgacctctcacctgtcaaaagaaaggacgggcaaagagccggagccgcgaccgacgactcatcagacatggcgaagccggcggcggcgaggaagccctctgcggcgtcgaccgtcgcactgacactggttctggccctggcttcggctgtcctcctcttcctcctgctccgcttctctccctcctccccgtcccccaacccgcacccgcaccgccgcctccgcctccgcccccgcgcgcatgcgcaccaccaccagatcccattcgaccctgtcgtcgcggacatagagcgccgcctcgaagaccgcgagtgggagcgcctcgccgctgcagggctgcacgctccgggcatggaggcggcgccagtcccagaggatctcaccgacggtgaggtcgacgccgacgaggactacatcaatgacgctgcgcgcttcaacgtcacgcttcgcgtggaggcgctgttcccaaagatcgacgtcgaccctgccgatggcgccgtcacgggcgctgagctggccgcgtggaacctcgcaaatgcgcggcgggaggtgctacaccgcaccgcccgggagctcgagctgcacgaccgcgatcacgacggccgggtcgcctacggcgaatacgagcggcccagctgggcctggcgtttcgacgatcataactcaaccgatgacggagtgggatggtggaaggaggagcattttagtgctgcagatatggatggtgatggctttctaaatcttactgagtttaatgactttttacatccagctgatactaccaacccaaagctaatacattggttgtgcaaagaagaagtcagggaaagagataaagacaatgatgggaagctcaatttccaagagttcttcaacggattattttactcaattcgacactatgatgatgaaggcttaacagatgacaccggtggctctgatgcaccagctaaaaagtcattttcacaccttgatctggataatgatgggctcttatcagcagatgagctaaagcctgtaattggtaatctccatccatcagaatacttctatgccaagcaacaagccgactatgtaatatctcaggctgacacgaacaaagatggacaattgagcatgaatgagatgatcgagaacccctatgtcttttacaatgctttattcacagaagatgattatggctttcatgacgagctccgttagttcccaattcaacacaaagctttatggaatcaccactgtaggaagtcggaagactttgttatgcactgctaagaccatttccgttttctgtctgaaatcatccatcatttgacggtgattccatgtaaaacaagcatgtttttagatgcacctattctagaagctgtgttcttttgtactacccttgagccttttttatagtttgttgtttttttaatcatatatgtacggtgaggatgtgagtgagttttgttctttcaacttcttgaatcttgatacgatacaaaactagcgtcttccagaatcacaatttgtaaaccatacaaacccaggaaagcattactgtaagccatgaattgacgttatctgtaatgattgtgcaaatcatgaaatctgccaaattcatgctttagtccct

SEQ ID NO: 24140 - DNA, 5207 bp, Zea mays
ccggccgggtacattgtgtctcgtgtgttactcgcgttccctgcctgtttcgagcctcccgcccgcgtggcccggcattctctccgccgctcgcccgctccgcgtccggcggcccgcgtcgcctccactcccaattagcctatcgtgttcgacgcgagcgaactcgctcagatcagagtgttccctgatccggtcccaatcttttattggattttgtgttttggtaggggatctagggtttgtcgtcgaattccgcctcgaattttagggtttgcttcggatcgattccgttccgtgggattcttgcttgcagcactccatggctgcggcgcggcacgggggttataggagcttcgacgtggccaggaggcgggagttcgacctggagcgttctaggaggagcaaggagtaccgccactcgagccgccaccgcgactcggatcgccaccgtgatggcagcaggggccgtgaagtgcccaacgggtacatccgccaccgctcgccgtatgcgccaccgaagagccgaccttcaaaaaggaaggacgataaggagcctggtgaggtctcaagcgatagcggctcggagtctggtgggcgcccaccagtgctgagggaggatgggggtcttggggtctgcagggatggaggtgcgttgccagcaagcaagaagaggaagcactcacctggattccacgatacgaatgtttcaaagctgcgggcaagagatgaggtgtggagcaggagaggacctgatgccatagctgcggagctccctcttccttcgccgccccctatgtctgcggttggtgggtgctcaccaatggatccagaagttttggtagttccaaatgatgctgaaaggatggacgcgattactgagggggaagaggattgtgcaacgagaaacatttttacttcaaggtgggcggatgctgctgaagaggaggaagtggtgattgtgcctaagaagaagaaaagtgtgccacctgctcatttgcctgaacagaaatccacaaagaaaatcatgggctcagagctgggagaagcgatgggcagtaaaacatcaagaagaagttcctcaagttcgtctaactcgatgggtagtgaaaactggaatatcgaggtagacgagggtgatggcattgattcttctgttggttgttcgctggatactcattccaggagcaatatgcgtaggtctggatcacctgaggttgtgcgaacaccacgtaggtgctttaacatgcttcagggctgtaggagtattgatgactttgagaggatcaacacaatcaatgagggtacatatggagtcgtatttagggtgagagacaagaaaactggtgagatagttgctttgaagaaggtcaaggtagataaggaaaatggacgggaagggtttccattgacttctctcagagaaatcaatatccttctatcctttgaccatccttcaattgtggatgtcaaggaagtagttgttggtggtcatgacgatgatacttttatggtgatggaatacatggagcatgaccttaagggtgtcatggaggcgatgaagcaaccatatagccaaagtgaggtcaaatgtttgatgcttcagctgctagagggcgtgaagtatcttcatgacaattgggtacttcacagggatctcaagacatcaaatctcctcttgaataaccgcggtgagttgaaaatatgtgactttggactctctcgtcaatatggcagcctgctaaagccttacacccaaccagttgtgactttgtggtacagggctccggaactactattaggagcaaaggagtattcgactgctatcgatatgtggtcattaggttgcataatggcagaactcttgtcaaaagagccactcttcactgggaagtctgagatagatcaacttgataagatatttagaatactcggcacacccaatgaggagcggtggcatggttgttccaaattgcctggcttcaaaggcaacttcgtaaagcgaccgtacaatagattaagggacaaatttccagctgtatccttcacgggaggcttgaccttgtcagaagctgggtttgacctgctaaataggttgctggcatatgaccctgagaagcgcatatctgctgctgatgccttgaaccatgagtggttccgtgaagttcctctgcccaagatgaaggaattcatgccaacttttcctgctctgaatgaacaggacaggaggatcaagagatacatgaagagccctgaccccttggtggagcaacagatgaaagaacaagggagcataggagatcatggcctttttgactgatctgaaagcagacaagtcttgctgcaaatgacagtttttgagtgagtaaacatgttgcaaggctaagagatcaaaggggaacagaaattttacttaagttccatgcagctagtgttcaaatggcagggttagctctctacgagaactgtcatattctaacctatcatcattataagttgcagatgtaatgcagttcgtctaaaaggtttggccttgcgtacaccaagtttcacctctgatacttgtaaagtattataaactgttgacttgtaatcagtaatcaatgagatattagtgacatcgtattttattttctcttttcaagtagtgcatcttcttttgatcttttgattgtctttgcaagagttgaatgaagtgaaggaaccggtgcatttttattttcacaaggaaatcgatactctcttaatgggaattgtaagcttaaagctgtggctgtatcaagagatgaagggttcgcggatgccagattacatacctaactgactttttctgtggtcggtcctccaaaggtctcatctgtaattgtgaatccaagtgagttgagctcagctcttttgaatactttggtaatccctgccctcttcatcttcccactccagttctgtttcatcagctcatcatgatttatttatcattcctgtgattcattgcacgatcattatcaatttgtttctttatttgcatggacattaactgttacaaaatgccgccttcgccctcctgtgcccaccatagttattgaggcaggtaaaagaataaggttaagaatatgttaaattactccttgtgctttggttagatgatattaccaaaaatatatgttgaggtgtaagacaattctgggtttaagtgtttattctcaaacggttgatcaatcatggttttccacttccaagcttgatcctaaccaatccttatgtgatttaattgtcatattttgccactccttcctatcataaaaacatgccgtttaggacaagatttgatcaaaccttaaaacttaaaagctacaaacatttataacttctaatttatttagtttatgattgctgtgtcttgctttgtcagctaccatttttttcatgccataaaatggtggaattgcctgtagagttacataaatgctttctactaacctaagttgagatgtgtgccaatgtatcactgtatcaggtcccaattccacttgttataccatcttttttcttcactggggattgtttttgaataatctgctgataataccgctccgttcttttgagcttttataatctgccagaggtaactagttgactataaaatctgggaggatgctaccatgtgaattatgtctttctttttacctagttgggtaaaatgcgctaatggtttgctatgcctaaatatgaattcgagttgactatgttcctcattgcaatgtttgtggcacacaggtatagcacttctaattactcctgtgagatggctaatatttccgtgttttttattgggttgatgtgttcatatgattttgttaagaacaacagtaaaatacaatgaatcctggaaagcaagttgtgctaagttatataattttagtaaaacgtattcatgtctttgatactgatgtaattctgaatttctgatgtgagattccaacttaagtacctaactgctttcccagttgcctgaacttgtagggtatttaccattcttatgtcacttctctgaacttgcatgatattcaccattcgtatgtcattataatagcatcttactgtcccttgcatttgtagttgcttggaattatgacgtctttagcacgatctgaagtagggagtatatgtaccacagaacgtctaggaattttgttgtagcagttcatctgagtatatccacttactcttaccatgtgcgattaaagtgcacttgagtttgtttacagcttgaaatgtccgcactggtagcagacatggcagattgttagggcacctatggagacgacgtcaaacacatttgaagttaggtgaacttgaatatcgacggagggcagctgataatttatgttggtcagtgaattgaataactatcttgacttatacctccgaactaggaaagcgcaattctagttctcctgagtgaaaccatctaaaggtagatcaaattcatggaaaaaatatcaatatttatgacatgtaacaggtatattatgagagtattttttaattaagaatctaatatttttattttgtattgtcaatattgatactttatataaatttggtcaaacttaatagctttgactctatacttatgagtggtattggactctagattttacactatataaaataaaataaaatgtaaggaccaaattggattaagattgggctttattcacattcatttttaaactaaaattaattgatagcctaacttattgtgagaaacatttgatttattaccacccctaactatactataattgcattttttttctgatttgatggagtattatctcattcatttgattgtttggaaaggttctttatcttcagaatccagacatctatcatcccttggtccggcgttctttggggtagggaatcttaaaagaatgtataaacagcctctcgaggtagtgcttgggacaggaaattgcgagttacctccatgacctcttcaatgcaccattgactgcattattgagaaggcagaagacatcattgatcggttggcacgtgcgaacttgcaatcgctttgacctaaaacaatatgccatcattattgagaattcgctatgcgccattcaaaaacaatatgtatatcattatatgccatcaaaatgtttgctgcggcttctatactggtttttctctctcctggtacc

SEQ ID NO: 24141 - DNA, 1574 bp, Zea mays
  misc_feature (1539)..(1539): n is a, c, g, or t
accatcgacctgttcccatcttctattctgtctttgccatctattttggaggataaagaaacatctgctgctgcattttctaagactttaaaaccacatgactcatactggaaggatacttgagcctttcacccaactctgcactcagctgagtggctgagtctttccaagctcttcacccaactcttatcccttgccagtagtgaggtatgagcattgaacgaactggcaccgacctaagaatctgaaaagtcatgaatagcacattaagtagaattgagaggatgagtcccaactttatagatcattacagaagcaaaatatactaagacacgcaaattctattgaaccaaaatctactgaagtaatcctacacaacgcaaaggtgaatggactatagggtgtgtcacatagaaaaagggctgaaacgagcaagaaactaagatgaagggtggggcaagaaattgggacgacaacagtctagggatgaaatgaagctgccctttgtaatcacgtagaagggattgagccaccacaccggaatgagaaatctttcgccttgcacgagatgagactgagcagcgtaaagagcagatgcttcttttgtaggcgtagcttgcttgcgccagttgtcttcggaccatttacatccttcagtatccactacatgtaagctgaatgcatgtcttgacgctggagaaaggttctcaaaactctgatgtataagatctccatgtataaccaccaaagcaccagattttacttccagcggtacaaattctttctgatcatacactggggagggccgatcaaaatgtgtaccattttcatctctgaccatacgtctcaccaaaccctttttatgtgatcctggaattgcccacaggcaaccattgttgattgttgcatcttcaagtgcaagccacagccctgtgcatgtacgaggttccgtgtaaaggaatgtattatcctggtgcggcacgacctcaccaccaatacctggttgcttaaatatgtacatagattgaatgactgcaggcttcttgtagcctaaagaagagaacaagcttgcaacactctctgagaaagaaaactttttgaacaccggatcaagttcatgtaatgcttgttgccaatagcgcgccccaagccacgtggcactgcagcagcatcaacatcaccaacatgtggcctaaggtcattcgttgcccatgcaacaataagtagtcctgccactgccttgaaccaactctgtggaaggatatcccctcatcaagtgtttgcccattccgccctatccaccactgcccattggcactgccttcaagccctaccttggcatcggcggcgacacgtgcggaggggaggaactgggcgttgccgcattgggcgagccgagctaaggggggcggggccagggccgccacggaccccaccctgtccgcgtcgaacaggaaccagtcggcggaggcgtcctgcagcacccgcgcagccgtggccgtgtgcggcgggtactcccgcatctcgctggggaaattncatgtctattcatatacctcaagcccacgcgtccg

SEQ ID NO: 24142 - DNA, 1088 bp, Zea mays
tgctttctcctacccagccgagagagattttttatggtattacagtagcaatagtatttacagtttagggcttgttcggttagctctcaatccatgtggattgagtgggattgaatgagtttgaatcccaaacaagtcaaacttcttctcaatttttttcaatcccatccaatccatgtgtattggaaataaccgaacaagccctcatatgtttacaggtgaaacggaaacagcatggcgcagcttgattcccccattttattgtgcagagaagcgatccacaaatcacttgctgggaatctctattgttttacggcactagttactggttttgctaagacacatagagcggttcaggggccgttttcctttgtatccagttgtcttcggaccatttacatccttcagtatccactacatgtaagctgaatgcatgtcttgacgctggagaaaggttctcaaaactctgatgtataagatctccatggataaccaccaaagcaccagattttacttccagcggtacaaattctttctggtcataggctggggaggggcaatcaaaatgtgtaccattttcatctctgatcatacgcctcaccaaaccctttttatgtgagcctggaatggcccacaggcaaccattgttgattgttgcatcttcaagtgcaagccacaaccctgtgcatgttcgaggttccgtgtaaaggaatgtattatcctggtgcggcaccacctcaccaccaatacctggttgcttaaagatgtacatagattgaatgactgcaggcctcttgtagcctaacgaggagaacaagcttgcaacactctccgagaaagaaaactttttgaatacggaatcaagttcatgtaatgcgtgtccgactttattaattgaaagttcttttggttgtttcaagcatccatcatctccatatgccttctcctcaaagatgagatattctctgcactcttaaagaagtaatcatccttcaactgccgagatgtaggtgcttcggcaacaggttgtgtatgtgaagaaggaaacgagcgtaacaaaggcagggttcgagactggcccaatcgga

SEQ ID NO: 24143 - DNA, 1147 bp, Zea mays
tttttttttttctcctacccagccgagagagatttttttatggtattacagtagcaagagtatttacagtttacatgtttacaggtgaaacggaaacaacatggcgcagcttgattcccccattttattgtgcagagaagcgatccacaaatcacttgctgggaatctctattgttttacggcactagttactggttttgctaagacacatagagcggttcaggggccgttttcctttgtatccagttgtcttcggaccatttacatccttcagtatccactacatgtaagctgaatgcatgtcttgacgctggagaaaggttctcaaaactctgatgtataagatctccatgtatcaccaccaaagcaccagattttacttccagcggtacaaattctttctgatcatagactggggagggccgatcaaaatgtgtaccattttcatctctgaccatacgtctcaccaaaccctttttatgtgatcctggaattgcccacaggcaaccattgttgattgttgcatcttcaagtgcaagccacagccctgtgcatgtacgaggttccgtgtaaaggaatgtattatcctggtgcggcacgacctcaccaccaatacctggttgcttaaatatgtacatagattgaatgactgcaggcctcttgtagcctaaagaagagaacaagcttgcaacactctctgagaaagaaaactttttgaacaccggatcaagttcatgtaatgcatgcccaactttattaattgaaagttctttcggctgtttcaagcatccatcatctccatatgccttttcctcaaagaagaatgagatattctcagcactcttaaagaagtagtcgtcctttaactgccgatgatccttggtggagaacaccgcggagttggcgccatcgaacccagcgacaaggtcggccatgcggtcccgcatctcccgcacctcctccgcgctcgagaacgagtccatcacgaggtacccattggcctcgaagaagctgagctggtcggcggtgaggctactggctggcggcatagcggcgggcggacgcggaagcggaggcggaggaaagggatgggttgaccggaatagtggagtgaagggtacggaacttcttccgcacgcgtggacga

SEQ ID NO: 24144 - DNA, 1671 bp, Zea mays
  misc_feature (1619)..(1631): n is a, c, g, or t
  misc_feature (1641)..(1643): n is a, c, g, or t
aatcactccattcatcgccggagtcccgaccaaattatccacacacgcgcctcgcctcccactcccccgaactcacacgccgcggcggagcaccaccgcggccgcccaccatgacctccgcctccaccttcctctctctgcgcctgcccactccctcccacgccacttcgtccctttccttccccccgtctctgctccggcaggcgcgtggcggtgtggcgtcctcgacgctggtggcgcgggcggcagggccaacgggagcggcgggagctccatcgccgctattcaacccccggggagacccgttcctgtctaccctcgcagccgcctcaccggaggaccttgcggccgccgctggtggcgagcgccgtggagaggaccacctgccgttcctcgagatcttccagaacaccaaactcatggcctcgcccgcgcaggtggaacggtctagcagctcgtatagtcagcacagacctagaaggcctcctccagatttgccttcattgcttcttcacggccgaatcgtttatattggcatgccgttggtaccagcagtgactgagctcattgttgcccagttgatgtaccttgaatggatgaacagtaaagaacctgtttatatatacatcaactcaactggaacggctcgcgatgatggtgaaccggtcgggatggagagcgaaggttttgcaatctatgatgcaatgatgcgtatgaaaactgagatccacacactttgtataggagctgcagcaggccatgcatgtcttgtgcttgcagctggaaaaaaaggcaaacgttatatgttccctcatgccaaagctatgattcagcaaccacgtattccttcttatgggatgatgcaagcatcagatgttgttattcgtgcaaaggaggttgtgcacaacaggaacacattggtcaaacttttagcaaggcatactggaaatccaccagagaaaatagacaaggtaatgagaggaccattttacatggactccttgaaggcaaaggagtttggagtcattgacaagatcctttggcgcggtcaggagaagtacatggctgacatgctctccccagatgagtgggacaaagttgccggagtcagacatcctgatctaatgtaatgttattcattgaaagttcaacatttggttaggttaatagcttccagggggcagaaacaggtgacgctgaacaataatgcttgattatcaatgataatggttggtaagagccaaggagtacttgtttaactaggtaaacttagagctcagggctgggggctgcgccaccaagatgttgttaatggtctctggatgagagcaggcacgtgtttctcatgaattatcgttgttccccacatcagttctagtccagattttggtatttattagtatatagtccacacattttgatagacccagtggttgaactagccaagttcatattgttatcagcacgaagcgcgatgataatatgatatgttgtccttgaaatttccatggctactgcgcccttgtccttgtgttctggacgttggaaatcctatgtatggatcatatggttttcaaccatcaaatcaaaggactcaggtttgtgtcaaaaaaaaaaannnnnnnnnnnnnaaaaaaaccnnnaaaaaaaaaaaaaaaggcccctagggcc

SEQ ID NO: 24145 - DNA, 2218 bp, Zea mays
acaccgagtacaattcagaggagttgcatacatcatatatcgatgctataaatgatccttgtatcttttcttctacagaaactgcacagctgctatattttttttttttttttgccaaaaaaaatagaggccgcaccgatgttcagatgggcctcacgccttcaccaaaccaatccaaaccaaaccatgccatctagcagactgattttaagaaattcaatgaagtcagattttgttctgagccggaggagtaacaggggtaacatcttcagcgagtccatgacactcggataatctttgcagtgatgtaaactcccagaagtaagttagcagctccaaactgcgcaggctggtagttgatacacctcagcttatggctcctcgtgcataaacgaccaagggcccgctttctgtagcaacctcaggatgcctgcagccatacgcaaccccatgagtgtagtcaaaccagcccaaactccagccaagccaaatacagacggagcccataacaggacgagtgaagacgtaacacccaccacgatagtagcttgagccacatattcaaaatctgatacaccataatgtagaccgtcaaagatgaaggccagggcattgatgggctgacagtgcacaagatttgacaaccgttaggacctctgggtcactggtaaacagtctagatatattgccaaatgaggcatacaatccaatggccaaagctaacccactaaacactcctatctgcaacgcaaacattgctgtcttttgaacttttttgtagtccaatattgcataagagcttgctatcagcgcctgggcagaaacagctaatgcatctgcaagcaaggatacagcaagccatacttgcaaacaaatctgatgagcagccatcgctgttgggccttgccgagcagccattgatgtaccaatggtcatagttagcagaattgaaagagttcttcccaacagcattccaccagattttagatatccaccaaactctaattgatctattcgcggaggaagcaaaacagctcttttacttagagaccaaataagaagaactgtaataatgtactgggacacaactgtagaaattgcagcaccagttatgccaagcttaaagccatatataagtagaggaagaagggctacagcagaaagattgcccaaacctatataaaacaccggagtctttgtatccttgaatccccgaaagataccttggactgccaacataatcacatttgcaggtgctccgagagctctcaatgaaagaaagagtttagcaggtctgtgcattggagatacaggtgacacgcccattagtttaagaaacaatcctgatcctaggaacaatgctaatgcttccattataccaattccagcagctaagatcagggcagatgatacagatgtcagctccaatttgcctgaactaggatgcttggtagcactcctagaaatatcctctgccacaaatgaggttgcaatgctcaacagtggtatgttgaagatctttgacacaatattaaaaatcgatataccaataccagccgatgccaattccagtgcacctaatctaccgatgtatgcagtctccataagttgtgctattggatcaatagcttgacccaagactgctggtagagctagaagaattagctcacttctgacacccacagagttcaggctgatgaaagcctccttcacagtagcaaaagagagcttgttgcctgtttcaaggcattgatcgccatcatcaggtgtgtatcctggtactgactggccactggcaacagtggtgattcgccgccttatggaagaccacccctgggaagcggtgattctgctgtttggcttgttacatatgcaagaacaagcaagcctactcggtggacaaatcgcagcgtgcggagagacaggtgcactatggtggtgcaggcgcagcatttttcgccttagatgtctggatgaggtgcctacacaatgttgttcattcctgtatctggtggatgctcatcaccggtgaagggaccaacgcagccctggcggcgccgctcgcccaacgtcgcttggtctctaccaccctctatatatcacgctcaagccccaggtatttcaatcaatttcacgacctcccgccgccccgcggttcctatttgattttatgcttcgtctcatgggagaggtgagtaagcagagacaggaacggggg

SEQ ID NO: 24146 - DNA, 2291 bp, Zea mays
aaatcaacaaaacggttctaaaataatttacaccgagtacaattcagaggagttgcatacatcatatatcgatgctataaatgatccttgtatcttttcttctacagaaactgcacagctgctatagcatacaaaggagttcgccaaaaaaaatagaggccgcaccgatgttcagatgggcctcacgccttcaccaaaccaatccaaaccaaaccatgccatctagcagactgattttaagaaattcaatgaagtcagattttgttctgagccggaggagtaacaggggtaacatcttcagcgagtccatgacactcggataatctttgcagtgatgtaaactcccagaagtaagttagcagctccaaactgcgcaggctggtagttgatacacctcagcttatggctcctcgtgcataaacgaccaagggcccgctttctgtagcaaccttaggatgcctgcagccatacgcaaccccatgagtgtagtcaaaccagcccaaactccagccaagccaaatacagacggagcccataacaggacgagtgaagacgtaacacccaccacgatagtagcttgagccacatattcaaaatctgatacaccataatgtagaccgtcaaagatgaaggccagggcattgatgggctgactggcacagacaaacagtgcacaagatttgacaaccgttaggacctctgggtcactggtaaacagtctagatatattgccaaatgaggcatacaatccaatggccaaagctaacccactaaacactcctatctgcaacgcaaacattgctgtcttttgaacttttttgtagtccaatattgcataagagcttgctatcagcgcctgggcagaaacagctaatgcatctgcaagcaaggatacagcaagccatacttgcaaacaaatctgatgagcagccatcgctgttgggccttgccgagcagccattgatgtaccaatggtcatagttagcagaattgaaagagttcttcccaacagcattccaccagattttagatatccaccaaactctaattgatctattcgcggaggaagcaaaacagctcttttacttagagaccaaataagaagaactgtaataatgtactgggacacaactgtagaaattgcagcaccagttatgccaagcttaaagccatatataagtagaggaagaagggctacagcagaaagattgcccaaacctatataaaacaccggagtctttgtatccttgaatccccgaaagataccttggactgccaacataatcacatttgcaggtgctccgagagctctcaatgaaagaaagagtttagcaggtctgtgcattggagatacaggtgacacgcccattagtttaggccccgacccccggccgggccccaatgctaatgcttccattataccaattccagcagctaagatcagggcagatgatacagatgtcagctccaattgccctgaactagggatgcttggtagcactcctagaaatatcctctgccacaaatgaggttgcaatgctcaacagtggtatgttgaagatctttgacacaatattaaaaatcgatataccaataccagccgatgccaattccagtgcacctaatctaccgatgtatgcagtctccataagttgtgctattggatcaatagcttgacccaagactgctggtagagctagaagaattagctcacttctgacacccacagagttcaggctgctgtttattcatatgaaagtctccttcacagtagcaaaagagagcttgttgcctgtttcaaggcattgatcgccatcatcaggtgtgtatcctggtactgactggccactggcaacagtggtgattcgccgccttatggaagaccacccccgggaagcggtgattctgctgtttgccttgttacatatgcaagaacaagcaagcctactcggtggacaaatcgcagcgtgcggagagacaggtgcactatggtggtgcaggcgcagcattgtttcgccttagatgtttggacgaggtgcctacacaatgttgttcattcctgtatctggtggatgctcatcaccggtgaagggaccaacgcagccccggcggcgccgctcgcccaacgtcgcttggtctctaccaccctctatatatcacgctcaagccccaggtatttcaatcaatttcacgacctatttccaatccacatatcctatttgattttatgcttcgtctcatgggagaggtgagtgagcacagacaggaacggggaatgcttcgtttcgatc

SEQ ID NO: 24147 - DNA, 2454 bp, Zea mays
gacgagatcacgcacgagacctaggggatttgcattgcattgcattgcattgcattgggctgtctggatgctctgtgccagtcatttattcggaccccagggcccaggccgaccgaaccgtacggttcggagcacttgtttgtctgctactgctaggctggtaatctgctattcacacgcgtgtatgcaagcaaggtatggaagatgcacgtagtacctaatcaacaaaacggttctaaaataatttacaccgagtacaattcagaggagttgcatacatcatatatcgatgctataaatgatccttgtatcttttcttctacagaaactgcacagctgctatagcatacaaaggagttcgccaaaaaaaatagaggccgcaccgatgttcagatgggcctcacgccttcaccaaaccaatccaaaccaaaccatgccatctagcagactgattttaagaaatgcaatgaagtcagattttgttctgagccggaggagtaacaggggtaacatcttcagcgagtcctccatgacactcggataatctttgcagtgatgtaaactcccagcagtaagttagcagttccaaactgcgcaggctggtagttgatacatacacctcagcttatggctcctcatgcagaaacgaccaagggcccgctttctcctccaacctgagtgttttttttccgagtgagttcactaattaatatcagagcaggagaaagttacgtgcctatgattacagaacatcataatacgatttcctttgttataaaatagaatagaaacaaatgcaggatcacaaatgcattgtgcgaggtacaaggaagaattaacaaacagaatcacctcaggatgcctgcagccatacgcaaccccatgagtgtagtcaaaccagcccaaactccagccaggccgaatacagacggagcccataacaggacgagtgaagacgtaacacccaccacgatctatagaaagaaaaatcgagaaatgaataaacaaaaaacaaaacaaaaaaggatatgaaaaagctggagggctagtaaacatacagtagcttgagccacatattcaaaatctgatacaccataatgtagaccgtcaaagatgaaggccagggcattaattggctgactggcacagacaaactgaaacgaaagttaacattaggaaaaaaaagacatagaggacatagaaattaacataacgttggaggatttaccagtgcacaagatttgacaaccgttaggacctctgggtcactggtaaacagtctagctatattgccaaatgaggcatacaatccaatggccaaagctaacccactaaacactcctatctggaagagagaaaagcatacaaaaaaaatagtgaaaacgtgcatccgtatgcatagattaaactttaaatagaatgaagcgaaatacatttcacctgcaacgcaaacattgctgtcttttgaacttttttgtagtccaatattgcataagagcttgctatcagcgcctaaaagaggaagaaaagttagttggactgtaacatctgatagaccaacgagctaggaacaatctcagggtacataatagtacgttctagaagtttgcaggctctgcctgcagtatagttgaccagcagagttcagggaaaccaattttaacagccagatgacttccagaacgcaacatacatacctgggcagaaacagctaatgcatctgcaagcaaggatacagcaagccatacttgcaaacaaatctgatgagcagccatcgctgttgggccttgccgagcagccattgatgtaccaatggtcatagttagcagaatcgaaagagttcttcccaacagcattccacctacaaatccaagcatacatagatgataaaagtaaagataccaaaacaataaggaaaacaagaaaaaaggaaaagaaaaacacaacatgagtttattagtgcccagaaggtgttgacatgatgagatctcaaaggaatatgctgcagtcatgaatttttacaacttatttttttcctcaagctgtaagagagctgcacatcattatactaaaaaaaaaatcagataagaagactcatacaaggccattaggtcaggctccaaaaaaaaagagaaaaaagtgccaaaaacaaaaaaaaaatcaacgagcggcctaacaacataatcatggccaaatgcttctaaggccttttgcacccccatacactatagattggcctcgtgatttttaccatttacggcaaattttatagtgtttgcaaataggagaactgcgtatcatttcattaaggtagaagaaaaaaaacaaaacatgagagggaggcttgaaagtcccctccctccacaccactgtagattacatatgtgccacacacaagacacgaccactacaagacagctcaagcgtccaacctccatgcaccgccctaactgc

SEQ ID NO: 24148 - DNA, 3505 bp, Zea mays
  misc_feature (2202)..(2202): n is a, c, g, or t
  misc_feature (2714)..(2714): n is a, c, g, or t
  misc_feature (3063)..(3063): n is a, c, g, or t
tgcagttcttcgttcaaagttgttatgttctatgtcggcctcgaacaagctgctgcatctcttatcatataatcacggatcaaattctgataatattcacttgtacaaaccgagtacaaatcatccagaactttacgaagcttgccttcccagattttctttacacagctttacgtatttttccttgattattcaatcttttgctgacacatgtttcctctgctattagtcactcaccaaggaggaggagaaagaactcaaggaaaccttgcaggatatccttggggaaaacaaaactattttggttgaacagaaggtaactgcttgaaccacgagcttcttgagagtaatatatgaagggatgctcctcaactgtgccgtctctgttgaagattgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctgtccttttgaataaaatgtttcctctaacaagtgaagggcactgtttttattgtctcgtgggccacagatgcctgctgaacaatttatgttcatttcttcttttcttaaagaagcatgcactaagaacatgaaggatgcatgtcatggaaagtttttgaaagtcattgaaacgtatgagctcctcatgcaatgcattattctccttatattcaaaaaaataaattaaggttcatcgattgcaaatgaaaaaaaaacgcgctaacaagtgtcacaatatgtcccttgatgtttggttgtgtgtgctcctgtacgaagaaaaagcgcgccaaaaaagtggcatgtagtagtctagtacttaattctgaaaaaataagtagaataggtacgcccctgacgcgtgcccttgctttcttccctgttttgcgtaggctttagcttgagaacaagaggcacgtagccccttgcgagggttcagggcgagtttgcttgaaagaatcaacaaaatcgatcccccccaggccactactcggccgctcaagcaaccttgacctctcgctcactcttccaagcaaccaatgcagttatcctaagctcccagctgctgctgctgctgcttccatgtcctcgccgtctctcctcgctccctcaccatcgttgtggcttctgttttctgtctacgcgcgtccagcgatgccgtcgtcgtgcgtgggcgagaccggcctggtggccatggactgcctggtggtgtgctgctgctgcccgtgcctggtgctgcaggcctccgtcttcctcttcgtccggctacccaggaaggtggtcgtgaagaccaagagggtcatcctgaggcggtggcacaggagaaggccaccggcgccgtcaagcgcagccgggctgaagctggccgccctgctggacctggacgacgacggctttgaggccgcgttcggcatgggagagaaagagaggtgcaggtgcttcgctgtcggcggcgacggcggcgtcgacgtcgacgtcgacggcgtgtgggaggcgatcattgagcaggaagggctcttctggttcgggagcttttggggccggcgtggggcggcttctgaagccgatgatcggatggatgggagcttcaggttgcctgtggcgctagagcgggtacgtgaataggcggctaaggtttttcgattcacgcagcggtgtaaatacgcgagggatttggtaattagccaaggggctcccattcagagttccgctggtcgtggtcggcatatatatttatttactcgatgactcgatcagtcaaatgcatgtacataatagtatcaacatgccagaaataatggggtgttcccggcagaatgaccaatatcacaggtaaatttagatatgaactccattgtaaacggtggctggctggctcctggctgtgcctcggtggcggtcagccggtcaatcttttgcggatttgacaaccgacgacggctagctgtgctctcctgatgattggatgacgccgtcgtcacgcgatataatacaccaccagccccggtcctatcattttgaggcctcaggcgaactaaccatagtgcaccctctaaactatataaaaaattntatgatatgtggcgaagcatattagcacttcgtaggtaaataatgatatgcattgaaattagtttttaaaatatctaagacgctagataatatacatcggtgcaaactagcacctcgcaggttaagaaataagaacaatggtcgctggataacctgaatccttattgctcgagcgtgcgtgtctagagcccagcgtagcaccctagaatcctactggcagtgggccacgcgtaccgcgtgatccgtgtgcgttagacgtccgcgtgcccagccctaccggtctgttagctacctatactattttactacttgcgtatagctcgtgctaacgctatgtttctgggaaggggtggatgacgacgatggtggcaggaggaggggttgacagcagtggggacacgagaagagagggatgaaggatattcaaataatattcaacgatctgaaccgttgattttgatgttacgttaaatatgagtgcaatttgtttagggatttaataaagattaagngtgtgtgagttatttagttggataaattttgtaaagtttaaattggtgtattatatagtgttatagatattaaatattagaccctattaattttgggccctcgtcgtcgcctctgtcgcatgtgccagggccggccctgtataccaccgaggtccagaaagaccaggaaacgtagtgcgtacgagctcacttggaaaacagcaaactcgactgatcggtttccccgacacacacacaaagtcgcaactgacacgataatcacatgaccctggagacgaaaacgagtttgactggatcactggaagaagcgatcgcgtgcgttcctcccaaggaagtagggatgaaaacngaacggtaaatttccgtaccgtctcgtttcgaataatgttttttcccgatcgttttcgaattgttcatgaaccgattaaaaacgatataaaatgatttatctagttttttttgatcgttttcgtatttttcgtttccgagtcgtgctaataccgttttttaccgttttatataatatgagatagatctagcatataatttaattaagttatagaattttgttgtgtttaagtgaatgaataagagaaaagcaaatgttataattactctaactaatatgaatgacgaaagagttatttgtgtatttctaaatcttaaaaattaggcaatacatcactttattatgtttttttataaaactacaaaatagttatttttccgactatagtttatcgttttcggtcgatttcgaataaccgacaattctgatcccgtatccaaca

SEQ ID NO: 24149 - DNA, 1235 bp, Zea mays
cattggggaccctcgaggccggccggggcccccggcggctctcggaatagagtggcctccctctttttcctcgcactccgcaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggtcaggacagttatttcactcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctggccttttgaataaaatgtttcctctaacaagtgaagggcactgtttttattgtctcgtgggccacagatgcctgctgaacaatttatgttcatttcttcttttcttaaagaagcatgcactaagaacatgaaggatgcatgccatggaaagtttttgaaagtcattgaaacgtatgagctcctcatgcaatgcattattctccttatattcaaggatataaatgaaaatccagcgattgcaaacgaaaaaagaaaaaaaaaaagcggcc

SEQ ID NO: 24150 - DNA, 1800 bp, Zea mays
ttttttttttttttttttggctcaaaaaactggacggctggatatctcaacaaaatttatcatttacatagacgacggcttttacccccacagattgtaatcagttcatcacatgctaactatccagcatatgtccacactacaaagtacccgatggtttcatcaagccaataaattaaacaagaatcctcatccaatgagctactagccttttacacataccacagaaaggggtagaacacatgcattacaacacttgggggagggatattactgatcctaacttctgaacatactgtccatctagttgtttccctgatcctgcatcaacgacatcagcctcagcttcgagtacatttcgaaggaggcgtcggagaagtcggtcagagcacggaacagctctgggagatgtgccttcaggatcgagagggacttctccctgacctgctttgatagcttattatgggattcaatttcatcgtcaagcttgctcttcaagctctccactgcgaatctcttctcggtgactacatccttatgtcctgtcccctcaccgctatctggatcgacgtcgatcgctctgggctgtggatgcttgtggcaccaatcctcaaaagcccgggccttacgtatgtattccctacgagtctgctcacagatctccttctgtttcaactcctcatcttgaacacccaatatggtatccaagactgctcgaaaagtgacaatggctgtcttggcaagatcatcaggcagcttggctaggtgctcatgccaggcataaagaaaggctttgataggaggttgctgcatcctaggtggcgatgctactttctccttcaggctgctctctatgggtataaggttcaacttcaaccagccatagagagcatttatgtattccttttgacagttcatgaagtcagtaaaatttgtgatccacttatctacaatatcacgcagctgccgtgtgtggctgtggtgataatcacttgtttcaatattggaatcaggaatatcaacagacttcagatttaggacaattttcagctgatttgcgtgatgtatcttcatgtcctcccacatttttgccatccggtcagtaagatccaatagtcttgggtacagttggttatcacggagatactgaatttctgacacagttgaatccattgattgcatatcaactatgtatctagtatgtaagtgggttaccgcagctttcgttttctcaagaacctcaatggcagcattgtgtttcttttgtctatttaacaaagcaaccttcctctgatactcaagcttcataatctcaccagccttcacttcatcatagagctttttctcccatgctaagattttatcaactacagttgccaaggtctccaattcatcattttcgaagtcatctttcccatcatcgccattttgcattcctttaaaggatctattccatgtaattattttcatgacccttgcagaatgatcaatatgccctcggttgtcggcgaaattggagtggtaatgcatcctgttggcctccagcgccttagatacctcacctgcgctctctgacgccttcaagaacctctcgtcgatttctgcaagcacacggaggaggtccacacgcggcatctcggcggtgactaacttccccgccttaccaccggtgaccagcgtgaccagtggcgccgacccggcgcgtgggcggtcccccgcgttaagcttctccttccccttctttttggacgagcgcttgggcggcttcgggggcagagatgcaggcggaatgggcatctc

SEQ ID NO: 24151 - DNA, 2132 bp, Zea mays
  misc_feature (5)..(5): n is a, c, g, or t
ttttnttttttttttttttccaaaaaaagaaacatgtttgtcaccaattttatttatcaaactagcatctcagtgaaataaataaaaaaacattgcacggattagatatgggcatctcaccttctctcaaaacaaagcgtacttgtctccttggaggacaaataatatggttactacaacagggtataagatgcctttctacttgtattgctctgaaactatgcgagcgtacttgtccatgaattggcatttcttgtcaaaaccccagccaggattgttcttaagagagagtagagttttgtcagtaaaccgctttactgaagaagggatgctttctggaagagtgtttgcaactctttgcaactcctcttcttgttgttttgcagtcacaacatcaggtccactgtacatatctatgagctctttcatatggggggctctagccattacatctttcacagcttcctcccattcttcctggttctggatgccctcatatgcaactacaaatggcttcaccttctgaagcatctcctccaacgacattggtggtttctcatcaatatcaggattaccaaaattcacatggtactccggctcaaactcgatcatgttgtttgtgtgacaagcctcgaggtaagcatcttccattggatgtggcaacgcattatctgctgcctccatgaacgcctgctccagaatcttcatcttgtcctcgccgagctgctgctctagcctatcgccatcagctttgtcccccaagtagctcgcttgccagacgtcttccacatcatcagagcggtcgccacgcccgggacgcctgccgcggcctgggccacggccacggccacgggagaggcgacccccaccaccacgccctccgccatcttcgccgctgcggcccccgccgcccaggagttcaaccgcccgtctcacagcttcttgtggcgacaacttcggttgctgcgccccgggagcctgtttcggcggctcggcggcagactgtttcaccgcctcgcggcgccggatgaacctgttctcttccggaggcttatccggcgaaggctgctgcgtccaggggaccccgcggccggcgccggagatcgggagcgggcggggcagcggcggcgcggaggaggaagcatcgaggctcggcggctccggataggagcgctgaggagcgttgtcgaagcccttggtgaaggtcggctgctttgaagcgtcctcagggggtggcggtgggggcagtggggatccgcggccgcggccgcgaccgacgccagagaacacagcgaaggacgggatgcctggggaggagggaacctcaggctccccgcgaccacggccgacgggtgctgtggcagagaagggatccgcgtcatcgtcgttggaaatgggcctcccgggagcgcgcggctgcccggcggtcggcaggccgcgtccgcgcccgtgcccgaaaccgccatcaccgcccccgcttctagaagaggaggagaaggcgagagcgcgggaggagaggaatggagtgtgccgcctggcggcggcggcggcgccgatgcctcgcatggtgatggcctgacggtgatgggttcagcgcggggtgctgctagggttgggctcaacttgctccgcgtgggaacggtggactgtgagatatgtcgtgccaggtgtccgaccgttggattgccttgacggctcaagatctacggctgatcattgtttgagaaatacaaaaataatgttccggaaagtgttgagatggaccaaattttcacttctcattacttcggtcagtgtaaatggtgcgacacaagatcaaaaatttatggtttcctgttcgaaaacatacatcattcttttcgaattataaatagtttgatttctaacatacagtatatacgtataaaagttgtgtttaaaaaatgaaatatttatattatttaaaaaaacatttcatgtctgttttccaagatccatatcttctttctctgcttctcccagtcggccgaggccccgcccgtccgtgctccttcttctagctccagctcacggcgttccctctgctgagccatggctgtcgtgcctccgctcccttgttttccctgcgcgcagcaatgaggtttctgccgcct

SEQ ID NO: 24152 - DNA, 1958 bp, Zea mays
  misc_feature (162)..(162): n is a, c, g, or t
acttcccggccatccgcgtctccacttcctccatggcggcgatcagatggtgcgcttgtgcagagggtcgacttgtagccatggtggtacaagtcatgatttttactggtgtatttttgatccgacagtaaccgcatatagtgtcgtctatgtctcagtatnggaaaattgcatggtcatgaaggctgtgttaataccgtaagcttcaaccctgctggagacctccttgtgtctggttcagacgacacaaacatcatactatgggactggctttctaaaactaaaaagcttgtttacccttctggtcaccaagataatgtcttccatgctcgtgtgatgccgtttactgatgacagcaccatcgtaactgttgctgctgatggccaggtacgagtaggacgactaaaggagggcggtgaagtcacaactaaactagttggggagcacgattcacgggtgcataagatggctattgaaccaggaaacccttacatattttacagttgtggagaggatggcttggtacaacattttgacttaagaagcgattcagcaacaaagcttttcacctgctgttctttcttgaatgacagacgccgtgtaaaactgaatagcattgtcattgacccacagaatccttactatttttcaattggtggttccgacgagtatgcacgtttgtatgacatgaggaaattccagttggatggttcaagaaacacaaaccagcctgtagataccttctgccctaagcaccttattaagggtgcgagtgcgagggtccacatcaccagtattgcatattcctatgcaagggagatacttgtatcctacaatgatgagcttatctatttgttccaacacaatatgggtcttggtccaaatcctgtgtcgacagagccagagtttttcaacatgcttgatcagccacaagcatacagagggcacaggaattttcgaactgttaagggagtcagtttctttggacaacatgatgaatatgttgtgagtggatcagattgcgggaatgtattcatatggaggaagaagggaggtgaattgatcaggatgatgaatggtgacaaaagtgtagttaactgcattgaaccccacccgcatttcccatttatggctactagtgggattgataccactgttaagctttggactcctgcagctaaaaaattgattatgccgctgcctaaaaatgcaaagcaaataatagccgctaatgaacttgagaggacagttcatatttctcaagcaacagcgtcactttcatctgatgtcatgatgcatgtgttgaggttgttacgtaggagagattctgaaatgtatatcgagaatgagccggctagtgcagatttggccagtgatgacgatgaggctttctactttggatttgacgatgcggaaaggaacgaaagggaaaactctgatcccagagaatgcaacatgacatagctaaaacaactggggaatttttttttgcagcctgggcctggccctgcctctatgttggagtaaactgaataggtcttagatttcagttctacatagtaaggtgtgctgaatgggcctgaccgcctgatacacatgggaggactatacaggtcgtgattattaatggagaaactaaacgggtagagccacatcctaccactcggttattctgctctagttttaacgcatgttcaatcttctcgattgccgtatacctagcctagtaaaataagttgtgccccccagcctgtgtgattatgaactgtaaacctgaatttttagttatcatcaggcaatatgtacataggttttccgtagtgtggaaatgttgagaagtttgttgtttcatctgtctggcaatgtgttctcatacgtaatctggaagtacagtggcttggtatttcaacaaaaaaaaaaaaaaaaaaaaaaaagtactctgcgttgttaccactgct

SEQ ID NO: 24153 - DNA, 3869 bp, Zea mays
gatctctttgtgattgtcttgcccacaagaacttgcttcgcaactacttagtagcactaacatttctataaccaagttttgtggctattagttgttgaatttttacaggatcacctattcaccccctctaggtgctctcacacacacctagagttatcagtgccgcatattgcattaatggataaggtcatctcctcatcagacctacttccacttgtctccaaaaaatccaacatctcatcagacatcaatggtcctctatctcctccatcctctaaagtaatacaattcccctgtgggtgtacaagggccttgcacttgtgtcctagcacatatttttccacacctctaactcaaatcatttgctcttctatattcttttaacttcttggccttccacacccccttgtgattcttggttctccttcatgatgcgtggcagaactgttcttgctcatgcactcttcttcaccgagggagcttgtctgttttgccacttctcatgtttcaaggacaattgtgctgccatcgaaactgtcttaggagactgagtttccaccacaagcttcaactcatgtttgaggcccagcataaactgagttactagtaatgtctcactaaccgctttgtcaaatagtttgatgtagtaaaccaacttctcaaactgaattttgtatcccagcactgatccaatctgtcacaaggttagtaactctagcatcttatcagaatgtgtggatactcaaactcatccaatatcgacatcttgaagtgaaagcactccataaattcgactgaatcacgtaaagcctggtaccagtgagcagccctacctctcaaatgaagagatgtagcactaactatgaactcctcaggaatctggtataacaaaaaataagcttcacaattatcgatccaaactctagcctcatctacatcaaacatcgggaactccaactttggcaaccagcttcttcgatgattcggatcagcatctgcacccattttgttgctaatctcatgtcccgaccttgcttcctcgaccgacaaagtagcagatatagaggaagatacatgaactccaggtggtctgacatgagggtgtgctcccattaatctgtcgcccgcaaaaacccacagtgttgtgggtccaccccgggctgcagtcgtcaccgcgctagacagccgtacttgctcttgagacatctaggccaaagaattaatggagagatccatcttggcatgaagatattgcgtaatcttgtcatgctccacctgacgcgtctcaatctcttccaatttgttagacaaggtgtccaacccgtccaacttctttgatagctccttgatcgtcactgtcgaagcctccaaagcccgttgaaacttcccggacatccgcgtctccacttcctccatggcggcgatcagatggtgcgcttgtgcagagggtcgacttgtagccatggtggtacaagtcatgatttttactggtgtatttttgatccgacagtaaccggtgtgttttccatattgagctttcgttttcgatgttttcaaattactgatgtcgttcccgtttccggagttgtcactttcgattttgtttctgatgaaaaatatgaaaacgaaaatggttttagtgtttactgtctgtttcagattttaggtattcccagtttaggtttgttatttcggatttgagtttcagttagcgagttttttcagccctggatatgaccataggtggtcacgatatatcttagagcatctccaacaataactcaaacttgtgcttcaaattaaaatatggggctctttgtagaaaaaactactacaatagtgtctcatttcataaatttttcttaaaaattatatgacatcctctcaagtgacttataatctagatttaagaatttagtattggaacgagatattttattgttgtcataaattttataaaatatacttatttttaaattgtagagcatttttataggtcatttgtcggagatgttaccactgtcatcctgctcctgcgcctcgactagcagattctaccatttaaaaatcccacaaaatccccaacccctcctatcttcctagtgcattccaccgctcaccatggccgccgccgccatcgaagcagctggtcgccggaagggtagctgcttcttggaagtcggccgccgcgagatcggctcttcattcccccgcgtctcttcccgccgaatcagcggctccgagcatatagtgtcgtctatgtctcagtatggaaaattgcatggtcatgaaggctgtgttaataccgtaagcttcaaccctgctggagacctccttgtgtctggttcagacgacacaaacatcatactatgggactggctttctaaaactaaaaagcttgtttacccttctggtcaccaagataatgtcttccatgctcgtgtgatgccgtttactgatgacagcaccatcgtaactgttgctgctgatggccaggtacgagtaggacgactaaaggagggcggtgaagtcacaactaaactagttggggagcacgattcacgggtgcataagatggctattgaaccaggaaacccttacatattttacagttgtggagaggatggcttggtacaacatacgccgtgtaaaactgaatagcattgtcattgacccacagaatccttactatttttcaattggtggttccgacgagtatgcacgtttgtatgacatgaggaaattccagttggatggttcaagaaacacaaaccagcctgtagataccttctgccctaagcaccttattaagggtgcgagtgcgagggtccacatcaccagtattgcatattcctatgcaagggagatacttgtatcctacaatgatgagcttatctatttgttccaacacaatatgggtcttggtccaaatcctgtgtcgacagagccagagtttttcaacatgcttgatcagccacaagcatacagagggcacaggaattttcgaactgttaagggagtcagtttctttggacaacatgatgaatatgttgtgagtggatcagattgcgggaatgtattcatatggaggaagaagggaggtgaattgatcaggatgatgaatggtgacaaaagtgtagttaactgcattgaaccccacccgcatttcccatttatggctactagtgggattgataccactgttaagctttggactcctgcagctaaaaaattgattatgccgctgcctaaaaatgcaaagcaaataatagccgctaatgaacttgagaggacagttcatatttctcaagcaacagcgtcactttcatctgatgtcatgatgcatgtgttgaggttgttacgtaggagagattctgaaatgtatatcgagaatgagccggctagtgcagatttggccagtgatgacgatgaggctttctactttggatttgaggacgatgcggaaaggaacgaaagggaaaactctgatcccagagaatgcaacatgacatagctaaaacaattggggaatttttttttgcagcctgggcctggccctgcctctatgttggagtaaactgaataggtcttagatttcagttctacatagtaaggtgtgctgaatgggcctgaccgcctgatacacatgggaggactatacaggtcgtgattattaatggagaaactaaacgggtagagccacatcctaccactcggttattctgctctagttttaacgcatgttcaatcttctcgattgccgtatacctagcctagtaaaataagttgtgccccccagcctgtgtgattatgaactgtaaacctgaatttttagttatcatcaggcaatatgtacataggttttccgt

SEQ ID NO: 24154 - DNA, 1670 bp, Zea mays
ctgaaggctccatgctcttaccacatcaagaaaactaaaaccaacacatatattaagcttatgcttagatgactctaagttgattaaactaaagctaaaaatatttaatgtttggagagaaatcatttagattggctaaaaaagaaagagtttgccttaactcccacagcaggttgcaatcacactctttctcctcgtataatgcgccaaagccaagttcttcatgaagcacctactttctttgctctcgaatgttctcgagatgttctcatcctaccatctaggattttggtgacatggagctgtttaaagcccagccatattatacttgttctaaatggtggggtggacacttgtgtttgtaaaagccaagggaggtccttgaggcataaggccccaagaacaggttggttttcatcacagttcttccatgcgtcttggcagactccaggactatagccttccccgagcacgctgacaaccgtagtataaaaaaaaaatcatatacacaagtaccactggtagatgcacatgcagcattgaatcacgttcagcaaacacgacctagcacgcagctggagatcagttaaaagtgcatgtcgtgcttgtaattgtaagtggagctgcaattttcgtgtcaccaactgatagcaacgcaagttagtgtgaggttgtcatgtatctgccaataatgcgcaagttctgaatgcaatctacaaattgattgtctcaagctccatgccccagctttgaatccataaccaacaagccatcctgaaacacccatcactttcatgcatgcctcatacagtcatactgtcctcactctgtccaaacggacgttctggctcttccgaggtgttggttccagtgacatgatcacctgcggcatagtcattcctcctgaaacaattatttctatgccttcacgaatagacaaattgggccttataatttcggcggagtttaccaaaaagatgtcaccaatatataaatgattggttggcacataaacactacacaattcttcatcacctttgtctgtctgaagaaccatggttgatgttatgaatccaaatgcatattcaccaacacggggatgactaatgattgctacttctttgaatgctgttgtattttgatctggtgaaacagcagtgctaacttgctttgatgcagagtatatgtgccttacaaagggcattttctttataaaccattctccaacccagaagaccgttgaacccacccaagaagacacaaagattccaacaagaagtataaacaccagggaggtcaagaacccaaggccgaatatgtcaaaccccagttttgcatagagtgggctgaaaaaacccatcaacaaattggataaaccaccaagtgatgaagaatgtgacagcaattggcaaaagaactacacatccagtcataaattttcttgacacccagctttgaagaacagcaaagaatgccttgcgagtggacgtgccggcccacccggccccccgcggcgacttggcagggtcctcggggtcaggcgctgccccctcgcccgccccctcgccgggccgcacgcgcgcgtactccttgtcctccggcattgacggtcggtgggacggatgctgctcgctgcagttaccttcccggccggcctcgaggtacccaat

SEQ ID NO: 24155 - DNA, 591 bp, Zea mays
tcacggggatgactaatgattgctacttctttgaatgctgttgtattttgatctggtgaaacagcagtgctaacttgctttgatgcagagtatatgtgccttacaaagggcattttctttataaaccattctccaacccagaagaccgttgaacccacccaagaagacacaaagattccaacaagaagtataaacaccagggaggtcaagaacccaaggccaaatatgtcaaaccccagttttgcatagagtgggctgaaaaaaccatcaacaaattggataaaccaccaagtgatgaagaatgtgacagcaattggcaaaagaactacacatccagtcataaattttcttgacacccagctttgaagaacagcaaagaatgccttgcgagtggacgtgccgggcgagctgggtcgcggcggcgacttggcagggtcctcggggtcaggcgctgccgcctcggccgccgcctggccgagcggcacgggcgcgtactccttgtcctccggcattgcggtcggtagaggacggatgctgctcgctgaagcttaccttacgcaaagttctcgcggccgggcgctggcagttggc

SEQ ID NO: 24156 - DNA, 1342 bp, Zea mays
cttttttttttttttttttttttttgcaagaattagggatcttgatagacagtagcataaggaactttatatacacaagtaacactggtagatgcagcattgaatcgcgttcaggtaaacacgatctagcacactgctggagaacagttaaaagtgcatctcgtgcttgtaagtggagctgcaaaattcgtgtcaccaaccgattgcaacgaaagtcaatgcaggttgtcatgtatctacgtctaccaacgcgcacccgagttctgaatgcaatctacaaactgatactgcttcatgctccatgccccagctttgaatccattaattaaacaatccatcctgaaacacccatcgctttcattcatgcctcatacagtcctcactctgtctaaacggacgtggctcttccgaggtgttggttccagtgacgtgatcacctgtggcatagtcattcctcctgaaacaattatttcaatgccttcacgaatggacaaattgggccttataatgtcggtggagtttaccaaaaagatgtcaccgatatataaatgattggttggcacataaacactacacaattcttcatcacctttgtctgtctgaagaaccatggttgatgttatgaatccaaacgcatattcaccaacacggggatgactaataattgctacttctttgaatgctgttgtattttgatctggtgaaacagcagtactaacttgctttgatgcagagtatatgtgccttacaaatggcattttttttataaaccattctccaacccagaagacagttgaacccacccaagaagacacaaagattccaacaagaagtatgaacaccagggaggtaaaaaatccaaggccgaacatgtcaaaccccagttttgcatagagtgggctgaaaaaaccatcaacaaattgaataaaccaccacgtgaggaagaatgtgacagcaattgggaaaagaactacacatccggtcataaattttcttgacacccagctttgaagaacagcaaagcatgccttgcgagtggacgtggcaggcgagctgggtcgcggcggcgacttgacggggtcctcggggtcaggcgccgccgcctggccgagtggcaggggcgcgtactccttgtcctccggcattgcgatcggcgggacggatgctgcttgccgaagcttacgcgaggttctcgcgagcggcgcagtgcggtgaggagtcgcggtctcggtgctcgacggggacaaggtggttggcttccgctggctgccagcggcaagaggcagctaaaccaaacagcacttgcgtggcggttggggggttctgggtgctggtctcgtgc

SEQ ID NO: 24157 - DNA, 1047 bp, Zea mays
ttgggtccctcgaatactgggcacggccgggacagaaccctgcaactgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggaagtgatgacatctccagctatcacactatcgtctgacaaaaccgtgatggatgctgctgttctcatgctcaagaagaagatccacagattaccagttgtaaaccaggacgaaaaagtaataggtatagttacccgcgctgatgttcttcgcgtgttggaaggcatgttgaagatttaggagcgcagatacccatgctcggaagccacagcctcttgtaaatatgtagatgtgcccgggcatggtgtttctgagtagcagcaaagagatctaccatgtataggagtttctccttgtaaataatagtagcacgccaggagactccatcccaggttccgtactgcttgcgcgaccagatgctgtaaactagccagatacttgaagaccaatataaatggatatgtctaaagtagtgtttcggaaaaaaaaaaaaaaaaaaggggccggcc

SEQ ID NO: 24158 - DNA, 1669 bp, Zea mays
  misc_feature (86)..(86): n is a, c, g, or t
tttttatgtggtgtgcaggggatcggtagaatgcgtacgcgtaatcacagcaaccgaccgtgtcagagtgccagatccactcggtnaaccacgtctcagcttggcccttcactggtacttagcattcctatccacctcggcccacctccacctccctgacagtcattttgttatataaaacccatcaagctcccctgcagggagatacagaaccctgcaactgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatggggccaataagaacgacgtccccctccacctctttctttctcatggggccagggccatgcatgcgcatcaagctgctagtttctcatagacaggcaaataagaacgacgtacgtccgttcagtttaccggtctgtttctacttgtgacagtccaagacgaagatatcggaagtgatgacatctccagctatcacactatcgtctgacaaaaccgtgatggatgctgctgttctcatgctcaagaagaagatccacagattaccagttgtaaaccaggacgaaaaagtaataggtatagttacccgcgctgatgttcttcgcgtgttggaaggcatgttgaagatttaggagcgcagatacccatgctcggaagccacagcctcttgtaaatatgtagatgtgcccgggcatggtgtttctgagtagcagcaaagagatctaccatgtataggagtttctccttgtaaataatagtagcacgccaggagactccatcccaggttccgtactgcttgcgcgaccagatgctgtaaactagccagatacttgaagaccaatataaatggatatgtctaaagtagtgtttcggaaaaaaaaaaacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttttaaaaaaaacaaatttttaccccccgggtttggaaaaaaaaaaatttttttttttggggccccaaaaaataaattcccggggcccttttttaaaaaacggggagaggggaaaaaaccctggggtaacccaaaataaaaccctttggaaaaaaacccttttttccaaggggggg

SEQ ID NO: 24159 - DNA, 964 bp, Zea mays
agtcattttgttatataaaacccatcaggtaccttcgaggcccggccccgcgatacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggaagtgatgacatctccagctatcacactatcgtctgacaaaaccgtgatggatgctgctgttctcatgctcaagaagaagatccacagattaccagttgtaaaccaggacgaaaaagtaataggtatagttacccgcgctgatgttcttcgcgtgttggaaggcatgctgaagatttaggagcgcagatacccatgctcggaagccacagcctcttgtaaatatgtagatgtgcccgggcatgcctgtttctgagtagcagcaaagaggtctaccatgtatacgagtttctacctgtccataatagtcgcacgccaggagactccatcccaggttacgt

SEQ ID NO: 24160 - DNA, 580 bp, Zea mays
ttcatgtgtgatttttaccgggttgtctcggtcggcccacgccttacgtctacagatgctgttgttctcatgctcaagaagaagatccacagattaccagttgtaaaccaggacgaaaaagtaataggtacggtgagtgagtgtcagaatgctcacaagccagcagagattaaaaaaaaaaactgcatgccatacacttaattagtattatccttaattatcattgacaacacagagattatatgttgcaagggctaatggggttctaaacactgtcaacaggtatagttacccgcgctgatgttcttcgcgtgttggaaggcatgttgaagatttaggagcgcagatacccatgctcggaagccacagcctcttgtaaatatgtagatgtgcccgggcatggtgtttctgagtagcagcaaagagatctaccatgtataggagtttctccttgtaaataatagtagcacgccaggagactccatcccaggttccgtactgcttgcgcgaccagatgctgtaaactagccagattctttgaagaccaatttaaatggatatgtctaaagtagtgtcttgg

SEQ ID NO: 24161 - DNA, 750 bp, Zea mays
ctccccctcctgccaggctgcgcattctttctccagctctctgataagctagccagcgtcgtcgtcgtgtcttgttagttattagctctatctcgccgccctgcagctgctgatcgagtgagggaattcagcagcagcagcagcaggtagcatagcatagatatgacggcggcggaggtggaggccgccaaggacatcgccgaggagaaggccgtcgtgccgttgccaccgtcgcccgccaagccggccgacgacgactccaaggccatcgtcgctcttgtcgtcaaggatgcttacctcgccaagatcgtgtccgagaagaggctgagtctgatcaccgcctgggaggagagccagaaggcgagagccgacaacaggagcaactgcagaagaagaaggcggcgtacgaggagaagctcaagaacaagctggcgatgctgcacaggacggcggaggagaggagggcacagacggaggccaggcgcggcgaggagaccatcctggcggaggagatggccgccaagtaccgagccaagggcgagggccccaccaagctctttggcctcttgaaagcgtgacctctgctatggagaatgccctgtttcgtgcgtgtattaatttcgtattctcaacaagtgcactaggtgtgtgtgctgtttgttgttttctctcttgtattccaaggcttgcttgacaatatctgttgtattgtattaacaaaaaaaaacagtgcagtgcagtgcgacgcgg

SEQ ID NO: 24162 - DNA, 1466 bp, Zea mays
  misc_feature (1445)..(1445): n is a, c, g, or t
  misc_feature (1454)..(1454): n is a, c, g, or t
  misc_feature (1456)..(1456): n is a, c, g, or t
tagcccatatagtaatggaatttgtgttgcttcaggcaggggagaaataaagtacgtagtgtggtggtaccaccggtcgtgcactaagttaatgatgatattatgatcgacgatgattctcacaagaaaaggcaaccccatggtagtagttagtacgtagcctagctgtacgtgcatggctttggtcttgagaatccagagtactacgtaccccagctagctagattccctggcatgcatgcatggcctggcctggcctatcatgaactgtacgttgctgcttgacagctagccggaaagcttgcttgcttattggaatatactccctccgtttctttttatttgtcgctagatagtgtaaaattgcactatccagcgataaataaaaagaaacggagggagtatatatctcattgggtacctcgaggccggccggggagccaactactagcttgtttgttaagccattcacttcccttgtttgttaagagctgagctacatttattctcttcttcttgagcccctggcctccccctcctgccaggctgcgcattctttctccagctctctgataagctagccagcgtcgtcgtcgtgtcttgttagttattagctctatctcgccgccctgcagctgctgatcgagtgagggaattcagcagcagcagcagcaggtagcatagcatagatatgacggcggcggaggtggaggccgccaaggacatcgccgaggagaaggccgtcgtgccgttgccaccgtcgcccgccaagccggccgacgacgactccaaggccatcgtcgctcttgtcgtcaaggacgctgctgctgggaaaccttctacagctattattggaggctcaactgaaagagatgcttacctcgccaagatcgtgtccgagaagaggctgagtctgatcaccgcctgggaggagagccagaaggcgagagccgacaacagggctgccaagaagcttgccttcatcacgtcctgggagaacgccaagaaagcggagatggaggcggagctcagaaagatcgaggagcaactgcagaagaagaaggcggcgtacgaggagaagctcaagaacaagctggcgatgctgcacaggacggcggaggagaggagggcgcagacggaggccaggcgcggcgaggagaccatcctggcggaggagatggccgccaagtaccgcgccaagggcgagggccccaccaagctctttggcctcttgaaagcgtgacctctgctatggagaatgccctgtttcgtgcgtgtattaatttcgtattctcaacaagtgcacttggtgtgtgtgctgtttgttattttctctcttgtattccaaggcttgcttgacaatatctgttgtattgtatttgtataggagtgcagtgcagtgcagtgctattctttcttaaaaaaaaaaaaaaaatcttcataanacaacacananagggcgacgg

SEQ ID NO: 24163 - DNA, 1493 bp, Zea mays
actctttagatccccctgggaaagaaaggacacacaaatagaccatatatattaatggaattttttgttgcttcaggcaggggagaaataaagaaaaaaggcgggcgtgcgtacgtacgtagtgtggtggtaccaccggccgtgcactaagttaatgatgatattatgatcgatgattctcacaagaaaaggcaacccatgcatggtagtagtatgtagcctagctgtacgtgcatggctttggtcttgagaatccagagtactacgtaccccagctagctagattccctggcatgcatggcctggcctggcctatcatgaactgtacgttgctgcttgacagctagccggaaagcttgcttgcttattggaatatactccctccgtttctttttatttgtcgctagatagtgtaaaattgcactatccagcgataaataaaaaaaaaacgtagggagtatatatcttgcgagctgagaggctggcaacggttgagccaactactagcttgtttgttaagccattcacttcccttgtttgttaagagctgagctacatttattctcttcttcttgagcccctggcctccccctcctgccaggctgcgcattctttctccagctctctgataagctagccagcgtcgtcgtcgtgtcttgttagttattagctctatctcgccgccctgcagctgctgatcgagtgagggaattcagcagcagcagcagcaggtagcatagcatagatatgacggcggcggaggtggaggccgccaaggacatcgccgaggagaaggccgtcgtgccgttgccaccgtcgcccgccaagccggccgacgacgactccaaggccatcgtcgctcttgtcgtcaaggacgctgctgctgggaaaccttctacagctattattggaggctcaactgaaagagatgcttacctcgccaagatcgtgtccgagaagaggctgagtctgatcaccgcctgggaggagagccagaaggcgagagccgacaacagggctgccaagaagcttgccttcatcacgtcctgggagaacgccaagaaagcggagatggaggcggagctcagaaagatcgaggagcaactgcagaagaagaaggcggcgtacgaggagaagctcaagaacaagctggcgatgctgcacaggacggcggaggagaggagggcgcagacggaggccaggcgcggcgaggagaccatcctggcggaggagatggccgccaagtaccgcgccaagggcgagggccccaccaagctctttggcctcttgaaagcgtgacctcttgctatggagaatgccctgtttcgtgcgtgtatttcgtattcccaattgcacttggtgtgtgtgtgtacgtgttgtttgttgttttctcttgtattcgatggcttgcttgacatctgttgtattgtatttgtatagaagtgcagtgcagtgcagtgctttctttcttaaaaaaaaaaactcgagcccgg

SEQ ID NO: 24164 - DNA, 2376 bp, Zea mays
tttttttttttttttttttttttttttttttagacaaactgtccacttcattcaaaacaatgtcagacctcatggcgaagaccatgccggaggtggtgtccacaggggccttacatgtctgcctcatgctccagtataaaccatctgtttacactctcaggattctttttttttttttttttttgcttagattcgtgtcttaaaccatctctccaatcctgattctagagtttttgacccacacattacatgatctcatgtaatttgatacttttggcagttctgactggacctggtgtcctacacctcttgtaaattatagaagcatccaccaacactcactgcatttcttctcctctttgactctggactcatacacaggctttgcaaatctgtcaagtgtgttgacaagaagattggacacatcagcctcaccagtgaaagtgaaacgatcttccttggtagcctcctgatgtgcaaccggtgccttgtctgaagcatctgctgtattgggcttggacacgatgccaaggattggtgagtcctccagttttggcaaggaagcaaactgccgaacgttgttgatttgctctcgttcttcttcattgtgctttgttgtcccttcctctatcacctcaaccacttgctcttccttaggatcatcacttactgtaggcccgttgactgcatcagaaggatcagccgcacattctttctgacccttccgtgctgccgcccccaccttggatcttgctgacctcctcctccttctctttgtcgtggccacttcttctgccgtagcttcgggtgccgctgtcacctggcctgtctgcacctcctcgtgtgccttataaatataagttgtagccctcttagtgacattcttgccttcctgtggttttgtggcctcctccaccttgggaacaacttcatcatatttaggatcaatttcaggtccaacggttgtgtcagaagaatcagctttctgccccttctgtgctgccgctgctaccttggatcttgtggaccttctcgtccttttctttgccatggacaactcttccgccgtcctctgatcctgctgcaaatcctcatgtgtattatatggcgctgctctcctcgtcacgttttgaccttcctgtggctttctgacctcttcttcctccaccacacctactactattgcatgctcttctgaatcctcgcagctcttatctttctgctccttccgggctgccgccgcttgtacgtcctcctctttctgatccagcgcgaccttcaccttggatctcgctgaccttctcgtcctaattcctacggccgcctcttccgcatcatccacaggtgccgcagcagcctcccgtgccaccgtcatcttgggtcccggcaaggtctgtgggcccggcaccatcacctcctcctcatccccctccgtcttactcttacgtgccacggccttccttctcttcccccgtgcacggccgccgcgagggagcgggcacccgtgctcctgctcccctccgaccgcctcttccgcatccggcgtctgttccttcatcgccgataccggcggtggcgccgtgctcccgatctcgtcgatcctgtccaccgcggggaggcacctaagcgcttccgccatggccgcgttggacatgttggcacggatgccgttgctcttgcagagcgcctgaagttctcgccgggagagggagtggaaatccatggccgccgccgccgtctgcctcttctctcgcgtttccgtagtgcactagtggtctagtgcctcatccagcctccgtcccctctgtccatccgctcctcgtttgaatatttgaacgttagaagagaaagagacgcgacgctgctagtgtgggccctccccatgctggcgcagtggcgcttccaggatagctgcatgtgggggtctctatgacgtcagcggggcccgggcaaatggacggccccgatgagaggacaagtgcacgtggcagtggcacacatccaccgccgtgatcgacgcagatcttccttccatctccatcggacggcctagattgctcgtgtattagtattgcacatccacctaagacatgtttggtttcttgatcttaagaaactgtgactaaattttagtctctaccatgttttatttcagagattaaaaatgatcggcaacattaaagcatatgaaaaagaccatattgtcctttgaccaacctcctttctcccattagtacctgagtgtgcaataaaggagggacattgaccctaagagctagtttggtgatcatagaaatagagggaatctataggggagaaatcctctagctatttaaaatcatctttctaaaataattacacaagatgttgtagtca

SEQ ID NO: 24165 - DNA, 1906 bp, Zea mays
cattgggtacctcgaggccggccgggaccatccatcgcatccaagaattgaccgactcccagtgacgccctgtgtgctggcttggctctgcctctgtgtgttggcctgttgggtagagagagactggtgaccgaagaagcaaggaaggcagctgtgctgtgcagtgagaggtccgtgcacgcgaggccggcccgcagtggccggcccggccatccacaccacacacccacagcaaagccacgaaccaactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcctctgggctctggcctctgcgtgtgacgtgccgtgccatggcgctcgccctcgcctatatccccagcctccctcgccccgccgctggccgccgcattcagtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcagcagggacaggcggtggagctggagcctgagcagcagctggacccgcgcgcgcagccggcgcacgacgcggaggaaaccgcggcagagccgccgccggccgcatccaacggaaccgccgacggcggcaacaagaggaaggcggcggccatggaggaggaggggatgctggccgtgatgacggtggcggcgccggagagcagcaccaagccgaggctgtccaccaccagcaacagcctggcggtggagacctgagctgagaatcggacggcgaccggatcacatactactacctacgtacattaatccaccattgcgggcagtcgagaaccaaccgaccaaacccaggccaccgccgagaaagagctcgtcctccttttctttcgctggttcttttggttctcggagctaattaatggaatgaaggtgtgagctcctggggatggaggggcggttaccggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttattgtctagtctaatttttaattttactcggcttattaatcacggtactaactggctgcctcaaaacctgtactggatcagttggctgctgatgttgttttcgctcagttcttttcccacaaatatgtacactcaatattcaaataaactcttttccaatatctaagctttaa

SEQ ID NO: 24166 - DNA, 1401 bp, Zea mays
ggggatcgaggccacgccgctgcgtgggcggctgggcgcgcgtctgacgtgccgtgccgtaccatggctgccaggctgcgccgctcgcctatatcctcccctcctcccccgcccccgcccgggatctccctctacccgccgccacattcatcagtagaaaccacctatcctgcctgctctacctacctccgctccccagccatgacggtgctggacgccgagtcgcggttccatgtcctggcggtggacgacagcatcatcgacaggaagctcatcgagatgctgctcaagagctcgtcttaccaagtgaccacggtggattccgggaacaaggcgctggagctgctggggctgagggacaacggcgcggaggacgcgtcgccgccgtcatcctcctcatcatcttcgtcgtcgtcctcccctgaccatcaggagatcgacgtgagtctcatcatcactgactactgcatgcccggcatgacaggatacgatctgctcaagcgagtgaaggggtcctcatcgctcaaggacattccggtggtgatcatgtcgtctgagaacgtgcctgcccggatcagcaggtgcttgcaggatggcgcggaggagttcttcctgaagcccgtgaagccggccgacatgaagaagctcaagtcacacctgctgaagcggaagcagcccaaccagaagaacaagcctcaggcgcaggcggtggagtctcctgagcagcagctggacccgcatccgcagccggtgcacgagccggaggaagccgcggcagatcgcaacggcgtcaacaagaggaaggcagcggccatggaggaggggctgaccgtggtggtgacggcgccggagagcaccaagccgaggaggctgtctacgagcagcctgactgtggagacctgatcaaccgtggcgacctacgggctacggctacgcacattaatctagcagtggatgcaagccccagtcccagccccgccgccaagaaacacattttggttctgggagctaacggagggaagtgacaaacaattaaattatatgtagcggctgctgcttcggcctgcaaattctgttgcgctaacggtcatggacatggacatggacaccatcccttgtgttcgttaatcgttcggaaggggaaaagaagaagaagctgtagataaaaaaaggacaggcggctaattgttaatttccgcatggcttaattctggcaacgacctgctggctcaatcaaaaacctgtgacggacagacggatggatcaactgatgatgttgttgttttggctcggttcttcttccttgtacactgagtgttcagatgaacatgttgtaatctgaacatccgttcatgtcagcctgcctgacgatggaggcaaaagttcttctacatcatggtc

SEQ ID NO: 24167 - DNA, 1681 bp, Zea mays
acacgaaccaactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcctctgggctctggcctctgcgtgtgacgtgccgtgccatggcgctcgccctcgcctatatccccagcctccctcgccccgccgcccgccgccgcattcagtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcagcagggacaggcggtggagctggagcctgagcagcagctggacccgcgcgcgcagccggcgcacgacgcggaggaaaccgcggcagagccgccgccggccgcatccaacggaaccgccgatggcggcaacaagaggaaggcggcggccatggaggaggaggggatgctggccgtgatgactgtggcggcgccggagagcagcaccaagccgaggctggccaccaccagcagcagcctggcggtggagacctgagctgagaatcggacggcgaccggatcacatactactacctacgtacattaatccaccattgcgggcagtcgagaggcaaccaaccaaccaagaaccaaccgaccaaacccaggccgccgccgagaaagagctcgtcctccttttctttcgctggttcttttggttctcggagttcctggggatggaggggcggctaccggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttgttgtctagtctaatttttaattttactcggcttattaatcacggtactgactagctgcctcaaaacctgtgatggatcagttggctgctgatgttgttttcgctcagttcttttcccacaaatatgtacactcaatattcaaataaactcttttccaatatctaagatttagaatatcaaaaaaaaaaaaaaaaaa

SEQ ID NO: 24168 - DNA, 1215 bp, Zea mays
tgtctttctttaactttattaagaactcctaaaaaactcgacccttgtattaataactccatcttagctgtgtgtcttgaactaaatggattttcttcccaagtggaaacaaaaagggatcttatggatggaccttaaagaagtatgtgtttctggcttaagataacagatgatgcatggatgatccttaaatatgtgctaatgcaatatcagatgatacaaggaagaaccttgaaagtagtatgtgtttctaccttaagatgacagatttatatctggggtactgcaacatcagatgatactattcggtcaaaaaaaacacaccagatgatactaacgtcttggagaccaaagtgttatcaacttttaaggtgtgttctctgaagtaggtagttaggtacattgattgaactcttgtggtgggtactggagctgaaacttttctgctcaaacagatctatattcttttttgagtagtcattcaaagttggcaatatgctagtaatgtccacctaggccctgaataatgctttactcctgttctttttataccattatcaaatgtttaaacataactttttgtggtatacgtggatggcttagatcatctgagaaatgtttgtttcatttcttctttacaggcaatcctggtcaacagaaagctaaggtctcagaactaccaaaatttggaagaccggcaaaactgcggagttcctcgtggtggacaagatactttgtccagactggcttaacagagaacgaagggccactgaagaaatttgaagaggctacatcccagaacaaataccaaccagattgtcagatcttccacttaagttcgccaaggtgatgcgcatccagaacaccttgggttgttgtcagttgtcacatcagttctgtaagcagcacctttgcttacccctgttgacttgcgcatctttcgtgcggaggaatggtcacacaaacagagccagccatcagcagtaggttagcttgtgtagagagggagagagagagagagagagaggcctcgacacttgttcctagaaaatcgttctggaaattaaattatgtgtaaccaatgactgaaaactggagcccgctgggatatatatgtaagaacttcacgctgttgtactaaaaaaaaaaaaaaaataaagtgttcacgctgtgtgcccgcgatggtccaggaggggctatttggccaccagctcc

SEQ ID NO: 24169 - DNA, 1582 bp, Zea mays
ttcggccgcgacaagtacgtgtcctataggctacgacgcgtcaacgaccgacatccccacgaacaaaatctcctctgaattcgggccgcgctccactaatcctcatctctcggtcgctaatggcgtgctgatctttccaccgtcgcatacaggcagcaggatgctctttattcccctgtgtcagcttcagcgaagctaatcccattccagtgcccgtaccgcgccgtccctatcgtgccggatcgccacccgctcgctgcgcccccacctccccccctcgccggttcgccacttcgccccacctccgcgcctcagatccatccccaatccggcaaccctagcgccgggttcctcctcctcgtctccgcccgccgccgcctccattgccagaggtgatcgagggggagagacagagcttgggtggtcggattagggagagagggaggggaggatgtccagaaggtcggtgaacccgagccggcgggtggcggacgggggcttgccgtccttcggcggcccgttccaccctaagtcacgctcgcctcccgtgctcaccattgccctcgtcgtcctgggtgtcatttttctcattgcctacttcaacagcagcccaggtgtaactgttacgagcaaagagaccgtgaccaggtctgaaggttcttgcacatcagaagttatgcgggcgcttccatatcttaagaaggcatatggcaatgccatgcaaaaggttctccatgtaggccctgatagttgtacagtagtttctaacttgttgaaggaaggaaaggttgaagcatggggagtggagccttatgatttggaggatactgacagtacttgcaaaagactcgtgcgcaagggctttgtccgtatgtctgatattaagttcccccttccataccgtccagattcttttaatcttgttattgtgtcagatgctttagattatctgaccccaaggtatctgaacaaaacacttcccggtttagcaagggtttccacagatggccttgtgatttttgctggcaatcctggtcaacagaaagctaaggtctcagaactaccaaaatttggaagaccggcaaaactgcggagttcctcgtggtggacaagatactttgtccagactggcttaacagagaacgaagggccactgaagaaatttgaagaggctacatcccagaacaaataccaaccagattgtcagatcttccacttaagttcgccaaggtgatgcgcatccagaacaccttgggttgttgtcagttgtcacatcagttctgtaagcagcacctttgcttacccctgttgacttgcgcatctttcgtgcggaggaatggtcacacaaacagagccagccatcagcagtaggttagcttgtgtagagagggagagagagagagaggcctcgacacttgttcctagaaaatccttctggaaattaaattatgtgttaccaatgactgcaaactggagcccgctgggatatatatatgtaagaacttcacgctgttgtactactaagctatgagctgaaaaaaaaaaaaaaaaggtggtcaggtgtcaaaaaaaaaaaaaaaaa

SEQ ID NO: 24170 - DNA, 1254 bp, Zea mays
  misc_feature (920)..(920): n is a, c, g, or t
  misc_feature (1002)..(1002): n is a, c, g, or t
  misc_feature (1004)..(1004): n is a, c, g, or t
  misc_feature (1026)..(1026): n is a, c, g, or t
  misc_feature (1028)..(1028): n is a, c, g, or t
  misc_feature (1037)..(1037): n is a, c, g, or t
  misc_feature (1079)..(1079): n is a, c, g, or t
  misc_feature (1096)..(1096): n is a, c, g, or t
  misc_feature (1111)..(1111): n is a, c, g, or t
cactaatcctcgtatcggtcgctaatggcgtgctgatctggcaccgtcgcatacagcagggcgctctttattcgcctgtgtgccccgccgcgccgggaatcccattttcggtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtgtaactgttacaagcagagagtctgtgaccaggtctgaaggttcttgcacatcagaagttatgcgggtgcttccatatcttaaaaaggcatatggaaatgccatgcaaaaggttctccatgtaggccctgatagttgtacagtagtttctaatttgttgaaagaaggaaaggttgaagcttggggagtggagccttatgatttggaagatactgacagtacttgcaaaagcctcgtgcgcaagggctttgtccgtatgtctgatattaagttcccccttccgtaccgtccagattcttttaatcttgttgtggtgtcagatgctttagattatctgaccccaaggtatctgaacaaaacacttccagatttagcaagggtttccacagatggccttgttatttttgctggcaacccnaggtcagcagaaagctaaggtctcagaactaccaaaatttggaaagaccgcaaaagttgcggagttcttcatggtggacacngntactttgtccagaccgcttgangnagaacgaanggccgctgaagaaattcaaagagctacatcaagaacaatacnaaaccagtttgcaatcnttcaactgagttcgncaaggtgatgccatcctacaccttttgaatggttgccaccctgcccctcctccggtggtttgctcatttgtccggggggaggaaatcgccccaaaagccttcgggaaaaggtagctttttgtaaaaagggcccgaacctggtt

SEQ ID NO: 24171 - DNA, 2203 bp, Zea mays
cgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtgtaactgttacaagcagagagtctgtgaccaggtctgaaggtacaacttttttttctccctattgtctcgttttgggttgcaaatcacccgctgatgttatttctttagtcatccaaaattctgtattctcctttaaacttgctctttactgtgtcgttaaaattgcaggttcaaatattttttgttctcctgattacaaggttgcacttattgtagtttgcaattgagatgcttaattagttttacttcaatatattgtatccatggctatgtttttgttatcttagcattgttgagtagtgcagttaccccaaaatcttacagacacattctgtatgctaattcttaggagcaatatcctatggttacaatgcatttatattattctgcctccatttttactgcaatagtgtcctatttcctttgtaactgatttgatgtttggtattcttcagtaagatatgaaatatcttgcagtgcatccaatactagtaactggtgaccagcaatcaacctcatgataaatagcaaacactgaaacgaactctgctgtgccactatgatttggttccctgattcttggtaactcaaaacatatttatttttctccttattcccatatgatcaggaggaccagtagctaattttctacattaggtacatgattatttagtttctttagttatgttcacatttttctttcccaacatgttgatgggggaagttttgttcgctttcaagcagagagtctgtgaccaggtctgaaggttcttgcacatcagaagttatgcgggtgcttccatatcttaaaaaggcatatggaaatgccatgcaaaaggttctccatgtaggccctgatagttgtacagtagtttctaatttgttgaaagaaggaaaggttgaagcttggggagtggagccttatgatttggaagatactgacagtacttgcaaaagcctcgtgcgcaagggctttgtccgtatgtctgatattaagttcccccttccgtaccgtccagattcttttaatcttgttgtggtgtcagatgctttagattatctgaccccaaggtatctgaacaaaacacttccagatttagcaagggtttccacagatggccttgttatttttgctggcaacccaggtcagcagaaagctaaggtctcagaactaccaaaatttggaagaccggcaaagttgcggagttcttcatggtggacacggtactttgtccagaccggcttgacagagaacgaagggccgctgaagaaattcgaagatgctacatccaagaacaaatacaaaccaggttgtcagatcttccacctaagttcgccaaggtgatgcgcatccatagcaccttgaattgttgtcacaccccctgccctcctccggttggcttgctcattgttcgtgtggaggaaatcgtcgcaaaaaaagccatcaggaataggttagcttatgtagagaggctccgacacttgttgctagaaattcactctggaaattaaattgtgtcccccaatgattgcaaactggagccccgctgggatatatatgtaagaactttcacgctgttgtaccgctgtgctatccatgtattgtcaggtgttcaccgagcagtttgaaatgtaaagctcttgatgatcccagagggaggggctatatttgaccactagctccttgtctgcatctagttgtagacatcgtagcatgtcattttcagcaagttggatgatgcttcaagctgacccgttctttctgagacgcgagaaagatggtctaccaaattctgtatcaaacctcagtttaatt

SEQ ID NO: 24172 - DNA, 1376 bp, Zea mays
  misc_feature (1376)..(1376): n is a, c, g, or t
cattgggtacctcgagccggccgggaatcccattttcggtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacgggggtctgccgacagtcggaggcctgttccaccccaagtcacgctcgcctcccgtgcttactattgccctagtcgtcctgggtgtcattcttctcgtcgcctacttcaacagcggctcaggtcggttaaagattctcggtgtaactgttacaagcagagagtctgtgaccaggtctgaaggttcttgcacatcagaagttatgcgggtgcttccatatcttaaaaaggcatatggaaatgccatgcaaaaggttctccatgtaggccctgatagttgtacagtagtttctaatttgttgaaagaaggaaaggttgaagcttggggagtggagccttatgatttggaagatactgacagtacttgcaaaagcctcgtgcgcaagggctttgtccgtatgtctgatattaagttcccccttccgtaccgtccagattcttttaatcttgttgtggtgtcagatgctttagattatctgaccccaaggtatctgaacaaaacacttccagatttagcaagggtttccacagatggccttgttatttttgctggcaacccaggtcagcagaaagctaaggtctcagaactaccaaaatttggaagaccggcaaagttgcggagttcttcatggtggacacggtactttgtccagaccggcttgacagagaacgaagggccgctgaagaaattcgaagaggctacatccaagaacaaatacaaaccaggttgtcagatcttccacctgagttcgccaaggtgatgcgcatccatagcaccttgaattgttgtcacaccccctgccctcctccggttggcttgctcattgttcgtgtggaggaaatcgtcgcaaaaaaagccatcaggaataggttagcttatgtagagaggctccgacacttgttgctagaaattcactctggaaattaaattgtgtccccaatgattgcaaactggagccccgctgggatatatatgttagaactttcacgctgttgtaccgctgtgctatccatgtattgagcagtttgaaatgtaaagctcttgatgatcaaaaaaaaaaaaaaaaaan

SEQ ID NO: 24173 - DNA, 1305 bp, Zea mays
tttttttttttttttttttttgcagaaggctctcaggtttaacatatgagaatccgtttcattacaaccgaaccaaacttgaagctgcaaccgatggtgatggtagttaaacttcatgtgagcatgaagcaagccgccggccacttagatcgcatgccagcatggtatggtacattgctctgcttcaatccaaagcatttgcaacaaatgcgcatcaaggatccacaagtcctccatccaaagctcccaggtttacacagttgaactcaagtgcagacgtccttttcaaacaagtggggcggtagcattcagctaagtttgcaccgattgtgataaagcatttgccgaatcaaacacagcagagccttttgaacgcccccagctactgcctgctcttcacagttgctgaagcttttctccaatacaacagtaacctgctagaggacaggcagaattggaactctttcttttatcacttcccacctttttggtacatgactgacaaagctttccatgagttacaaaaagacaattcaaatcaaacttcagatcatcaggaatcttattatttagatgaatgtaggccttctccctgctagctgtagcaggaacccagcccatagccttcgtaatgcggagtacatgagtatccactggaaaatcatccttctgtagatagaacatcagcacacatgccacggtctttggtccaatccctttgaaccgcgagagctccttcttcacctcatccaccgacagttcccgcaggtactcgaggcaaatcttgcccctccgctccctcacgtccctcagcatggaccgtatcctggccgccttcgtcgccgccaggccgccgcaccggatggcgtcctccaacctctttccctcctcatccaccacctggtcccaggaggggaaagcggccttgagcgaggcgaaggcgcggcgggagatggcgtcggtagtgttctgggagaggagcgtggtgacgaggccgtcaagcactgtgggggacgaaggccgagggtcacggttaggcgagaggccaccgaggcggaggacgcggaaggccgcgaactcttcggggaacccgtggaacgcgaggagggcgtcgcggactaccaggcattgtgccgagcagggggaggcatgggaagggtagggctccggcgaagggtcgtgcctcgccggtgaggccggagccttccgtttgggcttgcgaggcatcgtagaaagaaggttgcggcggctgccggccggccacggcgatgcggctggaaaaagaaagggaaaattatttctcta

SEQ ID NO: 24174 - DNA, 1099 bp, Zea mays
  misc_feature (1077)..(1077): n is a, c, g, or t
  misc_feature (1083)..(1083): n is a, c, g, or t
  misc_feature (1096)..(1096): n is a, c, g, or t
tttttttttttttttcggggggaaagtatttcatattttcatagcatgcacctactcttctgtgaaatcgactatagtttatcgcagacaagaatcagttacatatatatcagacgtctgattgcttgtgtatcgcgaaatagcgcactaaaactgtgccaaagcccttctatatccaagacggtctaggtcattccctcatgaagattgacaaccctagacaaacctagcctaccataaagcatccaggactttcttcatctggacataaaattagcgaacaggtgaagagaagaaaataaccagtgaatacacaataaatccagccagaaggatccctccatagacaaaagcctgggatgactgctttggatgactatattcaatgctacagcatttcatcttgtctctctcgttagctagaacacgttccacatactgttgtgtaaaaatagtgctttgcaggatatcggtactgttttgatatgcatcgaccagccggtggtcatacaataaggaagacaagtccacgagttgcccttcaagtttatccaggtattcttctaacttctcaacaagatcatggggaaaaggctccggtagattggttaccttcttatagaatttctctacccataactcagtggtggacttgtttttattacctttcacaagttctcctaatggcgtcttaagatgctctgatgcaaaagattggacaaactctgatgtgtctcttattttgcgaagagcagcatcgacttgagcataaattgtagttctcagtgctacatcctgaagaatttgactgatctgtgaggagttcgagaatggtccaaacggatgacagcctgcagcccacagccagttcactacatgtctttcatgaatacgtgatgctctttcatatggtgcactcagaccgccaactgctgatgccagaccagccaagatgtggcgctgtgcgatagatggaagagcaaactgcctagtcgtttctgacccgtcgcgtgggcggtcttttcattgttatgctcaagcacaataacaactctttactgtccaaacaagactctncttttnccatgagaagtcnagc

SEQ ID NO: 24175 - DNA, 4011 bp, Zea mays
  misc_feature (3409)..(3409): n is a, c, g, or t
cgtggcaaaataagcaaatacataaacccatcgagtatatcaacaagtattcattataatggtaaaaaaggtagaggatggatggatagagttttgagtagagtttgtgttaacggagtgaaaatgattacgcgaaggtatatcggaagacacaggttattgaaacaacagtcgtttccctagcttagtgcaagccatggtttgacaaaaaaaaacgaaatgccaaggacacgaagcagaagcacaatttctgtgcctcgccttaagaggataaaatggtaatgttctagagaaagccagttcacaggctttatttatcgtttatccatggaacttccggtgccagcggcgagctcgtaaatctaacactatagagggagtgagggacaaaatgcttgaatgcatatccatatcttttatattgaaacacgctggacattgaggcctcggcgcttcaggcgtacggtggagccttggtgtcaggcaattttcaaaaggagaaaaaacacacgagccaaggaaaatatttttttggaaattattgtcatgaaataaagcgactacgtccttgcaccagtccaaggccacatgtctgctggctggtcctcatgaagctggggggcttattaacaaacgggggtttctgtcagtggtgttatgtgcagttctgcagtaacaagttgcaaaaaaacaagttgcaaaatgggatgaaagtatttcatattttcatagcatgcaccagctcttctgtgaaatcgactatagtttatcgcagacaagaatcagttacatatatatcagccgtctgattgcttgtgtgtcgagaaatagagcactaaaactgtgccaaagcccttctgtatccaagacagttcaggccattccctcatgaagattgacagccccagacaaacctagcctaccataaagcatccaagactttctgcatctggacataaaattagcgaacaggtgaagagaagaaaataaccagtgaatacacaagaaatccagccagaaggatccctccatagacaaaagcctgggatgactgctttggatgactatattcaatgctacagcatttcatcttgtctctctcgttagctagaacacgttccacatacctgtcaagagaagggggaaagggtaaaaatgtttcgaatgaaacaaaatgaaaataatgagtttcaaaaagatagcacaagagtagccaggtgcgaatatagcatctctgtataaacatactgttgtgtaaaaatagtgctttgcaggatatcggtactgttttgatatgcatcgaccagccggtggtcatacaataaggaagacaagtccacgagttgcccttcaagtttctacaaggggcaccatagatgaaggaaaatcagaacatatatatgcattatttcatcatgaaagtacacttatgcaattgtatggtatataatacttacatccaggtattcttctaacttctcaacaagatcatggggaaaaggctccggtagattggttaccttcttatagaatttctctacccataactcagtggtggacttgtttttattacctttcacaagttctcctaatggcgtcttaagatgctctgatgcaaaagattggacaaactgcaccagaccagagatagtagttatactttctgtgcatttgaggaaatatctgaagatgcgctggcgcaattgcttggacgacctctgatgtgtctcttattttgcgaagagcagcatcgacttgagcataaattgtagttctctacacacaataaaacatgggttacatagtggatatgaaagcacagaagaaacaatttatgccagtgaaatatcaacagactaaaaaataatgcgaccatgattatacagtaagcataataccaagatttgttggatttagataattggatgcatcaaatatcctgattcctgacaggtcgaaagcctccaaaaggtcacaggaacacagtacaagtgtttttggtggctggaatggcttgccttttctgttttctcttctactactactattataaccaatgtgagctacaaataaagctgtgatagcccctaataaatgcaggatattactcaactaatcagcatattacttcctattattccatgctgaaatttagctaaagtaaatgctatgaagtatgaacctagacacgggattatttccatcatacccaagttatgttgatccaaaaaattgaaactggcaaactcagacagaaacaattggggcatagtttggcctcgtttttctttgttggtttgcatacctatgcactgtgcaaaccattggaagcatgaacagattttctactttaagctgcacttcgacataggagcattgagcattgacctccctcgctccctgcctactcattgtacatatcatagaaataaaaaaattgttgttgataacattaccagtgctacatcctgaagaatttgactgatctgtgaggagttcgagaatggtccaaacggatgacagcctgcagcccacagccagttcactacatgtctttcatgaatacgtgatgctctttcatatggtgcactcagaccgccaactgctgatgccagaccagccaagatgtggcgctgtgcgatagatggaagagcaaactgcctagtcgtttctgacacatagctgtgacagcaaagggtgatataaagaattaaatatagaagcaacttgagcaatgcagtacatacaagagttcatggaatatcttgcccgacaaaaaacactaaaataccttagaggaatcttttcattgttatgctcaagcacaataacaacatctttacttgtccaaacaagactctcctcttccatgagaagttcagcatcgacaccggccagtgataatacaaaactgaaggttattaagaaaaagggtcaaattttagatcattgtcagaattaaattttgaggcatgatagtttgattttataaccatgttctgctagagatggagagatagaggaggaagaggtgcctgtccatgtaaatgaagcttacactgggatcactctggtcccataagttctgtacagacttccatgtttcttctttccagttcctctccttcctttattatttttgggcatgtaagattcccacaagggcctgtgcttaatagagtcttttacatcatcttctccatcagtccaatgctatagccaaagacaaaaaatcacaataaaaatccataacactataacagcgctaatatagatagaagtagaaaaatatttagtatagtctcatgaaacagatgctagcttgtaggatatatcggacagaacatattatgcacctgctttaggaagaatctacttgagagagaaggatttgcaacttctaatagancagcagacagcacatcagcagaccgctccatttcctgtacatgtcaagagcacatcatttctgactgcggctgcagcttctttagttcacgctacagtattttgtagttatagagctgcagccacagcaagtgcagctgaacacagccattgcaatgctgcattcaaaatttaagacaacaagaaatttagaccgatctttataattctcatactcagcaccatcttgaaactgagttttactcaagaaactcggtaacacatccatttgatggtggcttttttacatttggtgtggaatgtctgttatttgcacttgattcaatcatttcctattacaaaattacataatcagaaagtgaagattatgaatcatataattgtgttgtttatccttaaggcatgattaaacagctatatgacagatggccaacaggtcaggtgaacccaagcctacttttctgcgtcccacattctcatttagacattaatagatgcaaaatgtgaaaattggaggatgaaaaaaataataataatactgccagaagtgtccatttcatttaagcatacagaaaacatacaaaacctgcaggtatatgcact

SEQ ID NO: 24176 - DNA, 762 bp, Zea mays
ttttttttttttttttgagctaaaaacgatatcaatgttcataaatatatcccatgcaaaccaaacatacaaaataatagaaggtcaagttctatgctaagattcaccaaaataattggagcgtagaaaggatgaattaaaacaagataatgagggtgtaaaaaattctactgtcatggtgtaccttgtccatcatttgggggtactggacgtatctgtcgtatactgctcaagagtggactaggtactgggggtgcattgttctaatgcttgctgtcaacggggaatggactagcgaaggggtcaacggatactcgagcacctgaccttgggcggtggcagttgcctagtcgtcaactcatcgccaaaagtaaagactaaagctaaagcagtgggctggaggccgattatcagtggtagcgacgacctgggcgaagctcaggtcgacagcggacctcaggcactcctgtagcacctccacccacagcgcgccagcacctacgtccagcgggggagtaggcgaagacatggactcgtccttgtcattgtctatctgacggctacgcttgatcgctgcttcctctgagttaggtcttgctggatctggtgctggcatcctcctctggccctgacgaatcctgagtccatcctccaccaagatgaatctgccaagcggcgatttgggccgcttcgactctaggtcttcgcttcggcgatctctgctcgaaccgaacctctaagctggttgttggggatgggaag

SEQ ID NO: 24177 - DNA, 4415 bp, Zea mays
  misc_feature (3133)..(3133): n is a, c, g, or t
aaattcggcacgaggcacctacacagctacctcgaagtcgaagctcgccccccgcctcgagaactcgttcgctcgctacgtttccctccgtttgccgagtgccgcgcgggagcacgcgcccatggcgacgccgccggcggcggcgacggcgtccgcgcttcccaagtctggggcggtatccaagggctacaactttgcatccacttgggaacagagcgcgccgctcacggagcagcagaaggccgcgatcgccgcgctctcccacgccgtggcggagcggccattcccgcccaacctggaaaaaagttcagggaaggatgaaggcgtggctgttcccgagaaagaatctgctttggaggaggccggtgcaatagatgcagtcttggtgaatacacatcagttctacaagtggttttcagaactggagtcagctatgaaatctgagactgaggaaaaatatcgactttatgagaatacattacaggagcgtgttaacacatgtgacgtaatccttaagcaggttgatgatacattgagcttatttgaagaactgcagtctttgcactcaagcgttgccacgaagacaaaaactttgcatgatgcttgcgaccaacttttggttgagaaacaaaggctgatcgagtttgcagaggcacttcgaagcaggctcaattactttgatgaattagaaaatgtatcaagcagcttttactctcaaaatatgaacattggaaatgaacagtttcttccactgttgaagcgccttgatgattgtatctcgtatgttgaaaacaacccgcaatatgctgaatctgctgtttatttggtcaaatttcgccaacttcaatctcgtgcactgggtatgattcgctcacatgtgttgtcaatacttaaaggtgcttcatcccaggttcaagctgcaattcgaagcagcgattctggcaaaaacattgtcacagagggtgtggaggcatctcttatctatgttcgcttcaaggcggctgctagcgagctaaaaccaatattaggtgaaattgaaagtagatcttctaggaaggagtacgcacagattctttctgagtgtcacagtttgttctgtgagcagcggctgtacttggtacgaggcatggtgcagcaacgaatcttggagtttgcaagaaaagaggccttgccttctttgacaaggtctggctgtgcctatctgatggaggcatgccagtttgagcaccagctttttgcccacttcttcccagcatctgctgctgatgtttctagtatggctcctttaatggaccctctgtgcacctacttgtatgatactctgaggcctagactgatatatgaaggaaacattgattctctttgcgaacttgttgatattctgaaagttgaagtgctgggggaacaactaagcagacgcggtgaatcagtagccggtctccgtccaatattgcaaaggatacttgcagatgttcatgagcggctagcattttgtgctcggactcatatccgtgaagagattgcaaatttccgtccttctgtcgaagatctagattatcctgggaaacttgaacgacctgtggatatgtcttcaagtgctactgttggtgacaactcagacatatatataacatggtacagaccattggagaaaacagtttcatgcctttcaaagctatatcgctgcttagagccttctgtcttcactggattagcccaggaagctgtagaagtttgctcaacatctcttcagaatgcaagcagggttatctcaaagaaagcaaccccaatggatggtcagctttttctgattaagcacctcctcattctacgagaacagattgctccatttgatattgagttctctgtcacacataaggagttggatttctcccatttattggatcacctaagaaggattctcaggggtcaggtctcattatttgattggtccaggtcaacatcactagctaggaccttttctcctcgtgttttggagaaccaaattgatgccagaaaagagttggagaaaagccttaaagctacctgtgaagagtttataatgtccataactaaattagtagttgacccaatgctttcttttgttactaaggtaactgccgtcaaagttgcattgtcctctggtagccagggtcagaaattagattcagttctagcaaaacctttgaagactcaagcttttgcttctcctgataaagttgctgagctagttcagaaggttgccgctgccattcaacaagatttgcccaaagtaatgaccaagatgaggttgtatttgcaaaatccatctactcggatgatcttattcaaacctatcaagacaaatatagttgaggctcatatacagctgcattcccttctgaagtcggagtactctagtgaagaaatgcaatccatcggtatgttgccgatacctgacctgcagtctcagcttgacagccttttgtagtttgcatacaccatacagcggcgctgctgtagtccatgttgacgttgcagtgcagttctttcaagtaacgcaagtaaagttgttaccacaatttcgaacctctctaccatatcgttgttgtaacttttcattgtttatattgaaaaatggaaatggaacgcctcccatgattcatgtgattgtggacaatctggaagtttgaactcatatcctgtggtgacttatgtatattgtacacgcacgttggttcctcctctgaaattgactggaatagtttcaacagatcatgggttgttcatcctcttgtgagatctgcctatctgtggcatggcttcccaatcctcactgttatgttttagaagaattatgccttctcaccgaaatccattggaagtttcctactcttctagacatctaggcaggccgggtcaaatggctcggttccatttgctagagattccgggccccactggttgcaccagattcatgtgtaaaataatgtgatgcctctcgacgcctggggtttctggccggcgaggtggcgacacgcagcgggtactggtaggcttccaccgcgggtcatagccgtcgtaatatccgcgctgcgagcaacctggtgttctgctcggcgattagtgcgtgcgctcgtttcgttccctcggngtgggacgagaagcgctcctgccgatgaagaaataagttgtttggttcgtagagtcactctattttttatatattattttttatatattataagtttatcttataaattttggtagaatcaattcatttcttatgtatgtattgattattagcttatgagaaatatgatggttccatatcctatttggttgtagggactaaaaatattcaaaacacattaaatgatttataagaagactaaaatgtcccttaccattctcccaccattagtgcaattgaaataaataaggagtaaaaggtgaaattaatataatttaatcttttttagcatcctttaagagactatagactaaagtaatttagtctatattttagttccattgtttggttatttagggactaaataggactaaaatagatgaactaatctttaatttcttaaacctaataatatctaatgagatctaacttattatattctacaaactaaataaaaaagtgaggagcgagaaatagactaatcacctcaagccaaacacattccaccggcatcggtagctaacgttcctgtcacggacttatgggttggggcccattcctacgcggacttgggccctccatgccgcccgcggttgctgtcagcctgtcaagtccgagcgggccggattgataagacgcattgcacgcctttgttctatcggtttcagaatgcaatgcatctcgggagtgctagtagctatgggtacgtgtttttttaatcagttcatcctatttcttgctaactcacgtaacttctaccaccggtattttgaatccttatagaaattgttgacatcacaggatagacaacgactattccaattataaaatcgttttcatggtatttaactctctttgtttaggatattcgattgttttcgtagagctaaagaaaaaacttgcaacgaaccgagacgacaattaaaactagagaggtacacccacttccaccaaaaagccccaatgcgagttccatttctatttaacgaggtgagacaacagcaaaaatgacaatatggcatacgaattatgatgaagagagagagagaggtaggagatgagtttccatcgagatttaacctagcacacgggccttccaacgcattagaaacaactagcgaggtgcccgtatgttgttatgattttaatttatgtttaaatatagaatatataacacaaaggcatgtgtattctattgactaagtgagtgttaatgtaggtttagagctacctaccatgttcc

SEQ ID NO: 24178 - DNA, 2475 bp, Zea mays
agcttcaaatccttgattttttcgaatctaaaatcttgtaagatacacgctaaaactcgtttgctgttctgttctacactaaatagatcctgtgatgtgtgccgcgcctcttttttttttttttttttacaaaactcgtgcattctctattaatcaaaataatatctattagtgatcgatacagaaaaaaaagaacaaattagtgaatgtacgccctgtaatatattctatctgaaagtaaatatcaatttccgatgttgaagctggcaagatactggaatcgtctaccagacattttgcttgcttgctaacttgttctgcattcggcaagccattgaccctgaagattccacagaaatgggttgctacatgagcaaagggtcagctgatatcttggactcaacactgtgagcaacctcttcatcttttgtcctgtctagaggtgccctatatgtcgtccataagttcttccgagttcattccgggagagccaacagtattatcacggcttgtggaatcagaatcagaatcagaagttacaacaatatttgcatgatcttgacttccagactcgctctcaaaagcctcatcctgttggcttgcgactgggtgagagatcaatataatagaacttgattggtcttggacgctagattctatggcagattcaccatgatgatcaagactctcagaagtctgctctataaagttatcctcttcatcagagtatgatatcccaaatttctgcgcatgagtcaatcctggacaaactcccttgatgtaacctggcgtaaacaacacattggacattgaatagtgactggaaggggtttgaatatcatctaattgggtatagtttccatttcgatgcttagtagaactagcactagcaccatatccatggtcggcaccgccattacagaatgctccaaaatatgaacaatgttcatcttccaaggctatctcaggagtaacaggtaacaaatggccctctgtactaaatatgtacttatatggtccattttcaacaatattgtcagggccagcagctaaatcaaaaagaagccagagatacttgaccgtttctgcaaggaaaaaactctccatgtgatcatcctgcttgtgggtttccacatctgatatgtggcagtaaccacaagggcatctggcaccatattgaaggcttgctaatatgtcccttccaacatcaaggtatctgtaatctctggtagccttgaacaaccaatatgtgctttcaatcaactctggtcgtagcgggtagctcctttgtccattctgtacagtggatgtagcaagattaaaaccttcaggggtaaaaccatactttttccagacgctgaagaaggcagcatgtgtgcgaatagcaggatcaacatctccagctaaaacctgaagccctggccagaatgcctgcagactattgaagagtggccaaacagtagcaccagagttcatattaacctccacgtaccaaggatcatgatggagatagtgcatggcagctttgtaagcctcctgaaaaatgtacaggtattcttcatctccaaacaataaatatgcctttagaagatattcatagaatgaatcaatgcttgtgccaattcctgcatccttctgtgtccattcaccagtaaagacatttatatgggcaccaacaagattgagttttgatctgcgtgaccatattccacgcactgatttttttgtaactcgctcaaaaacagtattattagtcaagcgactcaatatgccaaattccagtgtcaaagtaccaccaccagccgttgatgttatcttgctttcattttcatcgactccgtacaataaattaacagatccaaatggaatacctgtaggagtgtcaaatgcgggcaacaacctctgagctaagtcagcagctaaatgaagtaactggtcatcataagattggattctcataccagtggcataatcactggcaatcaggtgagctgatagcagacccccaaggatacgtatgttggtttcaaaaacagagacggttttattaatatcaaagtggacattcttaccaacccactccacagcagcaccaaatttctccttatcacccagtaaagccaaggtatccaaagaatcgataagagtgagcgcataaccaccaagggagtcttcaccttggcaacttaagggccgcagctcatcgagtgggaaagcatacttcatgtatccatcaaacgcatgatagaacatatctttcacctcgtcgcggagccggcgcgcctcggagggcgtgacaccttcggcgacggcggcgccggggagcagagtggcggcagcgaggagggcggcggagagacagaggagtgcaaagcctcggtgccgccgccggatcggctgcatcgagctcggacctcacgacgggcgggcccgaggccagtagcgagtttgatgggacaatgggcccggccggcc

SEQ ID NO: 24179 - DNA, 1457 bp, Zea mays
  misc_feature (2)..(2): n is a, c, g, or t
gnaaaataaagtacactagtcttgatgattcttttgacctggcttcgcaaaagagaatcaatgtttccttgatttgccaagagaacaagaaaaaaaggaaggttcagaagcctgcagtccttgtggttgaacgaaaggaaaatgttgatacagatgatatttctaaagtttctgaaaaagatggcgtgcatcacgtgtctcttaacccagagccgcccagggtatccagaagcgaagcagtggtgacggactttgcaagggctttattgactgtattaagacaatataagcacaaacttttggagtccgagaatgctgttgaaagcatgaaagaattgattagagataaagatatcgaaatcatggagttgaaatgaacaaaggacctgacagcctgtcagctccttgttcatgcaagagttctccaataaatgaagatgactctgtggaccatgatgattcttcatcatttggtcaagctgctcagagtttagttaatatatcaaatcaagctgacctgggatctaatgatgcttcagaagataatttccatgtagagttacaagcgcttcataaggaatcagataaatctgaaagttttactgtgccaacacctgcacccactggtggtgcaatgcctgcatctagttattcagatcaaagcttcacagggcaaagtgatgaagaaacggaagagctgagtaagatcacactagagaataaggatattcagcttgatatcaatataagagaagagaagcaccatgaatcttgtagctcttcacagcaagtgaactttgacacagaaggtacccgctctagtgaggcttccttgcttggaacggttggttctgaaaagaagcttgaggaactgaagcagaaatctggaagatgtgtgtctgctgtagaaaaggctaacgtggaactggagcatggtatagacggtggtcaagctctagacgaaaagtgtgatcatgcctcagcgaaagctgcaaaggctcctccaagcaagggcagggaggcagacgaaactgcggatacagataaggaagcttttggttctaggacagagaaaaccaggaggaggttacagccagctgctgctatgttgctcagggaattcactggcgctgacattgatgcggataacgaaagggaagaaagaggcagatcatcgtccagcgtggcaaccgggagatcagatgcgcttgttcaacttctgatgaaaggccgtccggtccgtggattagcttcatgatagccggcaccgcatgacgtgacacatattatactgtttggttcagctttttttacctgcttttctgagagaatctagcgtagagaatctgagtatcattaagattacgtgtgtagaaagataaatgtgtccatatgactcaagatgtagaaattgacggatttctgctatttaatgactcaaccgattatatgtttat

SEQ ID NO: 24180 - DNA, 1763 bp, Zea mays
  misc_feature (4)..(4): n is a, c, g, or t
  misc_feature (24)..(24): n is a, c, g, or t
cccnaatattaatacccccaacancccacaacttttggggaacttaaataacaagaagccagaggattcaattcatttgattcgaatcaaggacggacggacccatagccagtcaaaatcattgctggacgctgatgaatgaactcgtctctctttgcatcatcgatctctgaccaacaggcactgagtttgatgctagctaccgcatcaccattcaccaccatatattgttcaacacgcagcatagattctattacaccacaagtgtatcagagaggagaaaatccgacattaggctaatgagaagaaaaaaaagaatcccatagttacatcatcactcatgcctcatgcccgagatggcgagcctcatcatcttaaaattcatcacttgccccagaaaaccaatggccaccacagcttaatcttatgccgcttccgaaccgaagcccttagtagaaaggaggaggatcgtcgtcatcctggcggtggcccgttttcggaccggctacattgcgttgtggaggccggcggtgtgcatcagcacggccttaatttcttcaggcaccattccaggaccatccgcgcactcagctcggaacacgtccatcgcaaagccattgaagcagctgatgaccgcctgctcgatgtcgaggcctaggctgtcgagggccgtcattgtcgacagcaggatgcctggcctacgcgcacagaacatgtggatattgactgcatgcccttccctcatcctgacttcgactgtggcttgttgtccagtagggcttgggaatgagcccgggcaaagttcttccttgacctggccaggaaatgtctgcaatgtcggtgttgatgggttgaagctagctgatgttggtccaacaagcgaagagctcggagctgactcaagttcattgtgaagatcgctgatcctctgcaggagctccttcagatactcaattgcgtcgccaaggatagaagccctatccatcttgctgatcttcggcaccaccgagcgcagcatgtagaggcggtcattgagcttcttgcgacgccggcgctccgccatgaggttcttggccggcatccctttcttcttgcctctcccgctgccaccgccggcgccacttgcccccgccaccgcgcccgcagcattctccatggaggccgagatggccatcgaggaggcgtcgacgctttggtcgatctcgtcctcgtcgtcccagctcatcccggcgtcgttgaagtccgaggccggcagcggcgcaaagaacccacctttctgcccctgctgctgaggcgccgccgccgccggcaccggcgggggagcgccgaggaagtggccggcgtcgtcgaaggggttgatgcagctgaagtcgtggaaggcggacagcgaggagccggcggtggccgcggccgcggaggagggagggaaggtgccgttgaagtcgaagagcgccgcggggtccatggagaggagcaacgacgcggaggtcggcgtggataggacgtctctggagaaggggaacgccgggtaggagccggagcccatcccgtcggagcccaggtagccccagtcccccgccgcccctccctctcccgtgatctcgtccaccagcttcacctccgccgagtcgtccatggctaccgccacggccgtccgctccttgccgatctcctcctcacttatcctggttcactggcaactctctctctctcccttctctcaacccttttcgattaggatgttctaggtaatggtctcgtgc

SEQ ID NO: 24181 - DNA, 2222 bp, Zea mays
  misc_feature (2201)..(2202): n is a, c, g, or t
  misc_feature (2204)..(2219): n is a, c, g, or t
  misc_feature (2221)..(2221): n is a, c, g, or t
cgacaaacaccaagccgaagtggtccgctctcgaagaaaggtaggctgtagtgcgacatctgctctgccacgtttctgctgtggtggtgccgtggtggtgtgactaatcatcagagataagtagcggaccctcgacccccgccgggcccgggccaggcaagtttattttcatctcgctatctccctggtattggtgtctagattgaagattatgcatcagcgacaagtaacgaccgcccggaaagagagccggaaaaaaagggctggaaatcgccaccgcccgcccctatttgagcagccgcttgttccttccgcgtcctcgctgctcctcaattcgattggctccgtgccgacctccaggttgagaaggaaagcatcgcgagttcgccatacggatgggttccaaagcgcctttctgtctcacgctcctcttgctgctcgccgcggcctgtggacctgctgcacatgcccacgatgctgtcgagctcccgcatcatggctcagccttgaaggaacagatttcttcaaccaagattcctgcccgtctcaagagtggcagcggactatgctcggcctgtgaaaacttcacgagcgaagccgtcacttatctcggcaaggaacagacacaggacaggatcatggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacggctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcgaaggtcacgtccagcaggtaggctttttggctcttcctctgtccttgtgattctgtgcaaaaggcgagctcgtcctcttccttaatgaggttcttaagagtgtttcctcagctgtattggttacccttactactttggattttggaaacagtccgagacccttattagttaacaatatcatagttgttgcaaagatactctactttttttcatcatctcttctttaccattcatatctcccagttgttgcaagggaaaattaactccagtaattctttcttgaggggtagaacaggagtgtcgttctcagattcaatgattatcaaacaacatgtactaattatattttagcaagctggcagttgatgtgattctctatgtttacattttgtcaaattaacgacaagagggttaagttttagaagcaactaccctgcactggttaataatatctgtgaggacccaagttggtcccagtcctcttcgattggtgctctgttcctgtgatttgaggaaagtttcagtacaacacattgtattttgattagtgaatgaagcatttagacgatattgttgcaggtgtgcattctctttcttacatttgatttaagctttcttatttgagctttatgatactatgtactcaatacttgtgctcttctaagataggttgagcagatagtggttgaaaggtctgaaggttggcattgtggatatttttgctatcttgcatggattcccagacaatgtgaggacgaaccagaagggcgagttctgggtggcgatccactgtcggagaagtatgtatcctcggctaatgagctgccatgtcaagctgaggaagtttttgctcagcttcccaatccctgccaagtaccactacctgatgcatatcgatagcaagctctacgcgttgatcatcagggacagcccgatggccagatgcttcacatcatggaggacgacaagggagaggtggtgagagttatcatcgaagtggagggtctgtctgatgccattcatcgctgtctttgacctcgtgaaggcgtcttagccacttcaatttgattggaaatattgttgttttaagatacgggtccatggttaatgttgtacgcttctctgagaagacctgtcattccaataatttggttctggagcaacctggagctgtatactgatctagcttcttttagtaacaaatgtaagttgctcacattttctttagattgtctatagaactttgaacgaccagctcgtcccttcttaannannnnnnnnnnnnnnnnant

SEQ ID NO: 24182 - DNA, 658 bp, Zea mays
ccgttccctaccccagtccccagcacccagcccggaatctgcaacctcgccagcggttgctgggggttcttccccttgttcgatcggttggttgcttgactgattggcccgcttcctttgttcctggttgagaaggaaagcatcgcgagttcgccatacggatgggttccaaagcgcctttctgtctcacgctcctcttgctgctcgccgcggcctgtggacctgctgcacatgccaacgatgctgtcgagctcccgcatcatggctcagccttgaaggaacatatttcttcaaccaagattcctgcccgtctcaagaggggcagcggactatgctcggcctgtgaaaacttcacgagcgaagccgtcacttatctcggcaaggaacagacacaggacaggatcgtggagttccttcatgatgcttgctcccaatcattctcctttgaacagaagtgtgtcgagctgatggactcttatgcgactctcctgtttgccaagatcacggagatcagaccgtgagcgttctgcaaacggtatggcctgtgcagggacacggctcttcttctcaggtgtggggagtgacagcacgtgtgtggtctgactacatctgctcgatgaaatcatgtccaaactgaaagatccagatgcggagtttg

SEQ ID NO: 24183 - DNA, 1470 bp, Zea mays
ggtaccctccgggtcggccgggagtggattcccggccggcccggcaagtgaatccggcacgcaacagcaacgaccgccccgaaagagagccggaaaaaaagggcaggaaatcgccaccgcccgcacctatttgagcagccgcttgttccttccgcaatccgcgtcctcgctgctcctcaattcgattggctccgtgtcgacctccaggttgagaaggaaagcatcgcgagttcgccatacggatgggttccaaagcgcctttctgtctcacgctcctcttgctgctcgccgcggcctgtggacctgctgcacatgccaacgatgctgtcttgaaggaacatatttcttcaaccaagattcctgcccgtctcaagaggggcagcggactatgctcggcctgtgaaaacttcacgagcgaagccgtcacttatctcggcaaggaacagacacaggacaggatcgtggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacggctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcgaaggtcacgtccagcagtgcaagaggctggttctgcaatacattcccctcatcttggtgaacggtgagaagttcctcgagaagaacgatgtctgcgcgctcgcacaggcttgtccagcgagcagtaggaagacgttcagctcgatgttgaagggagcgttgtggagtgacgcctggcttgaaggttgaagaagaacacacggagcggtttagcagtggtcagaaatagtgtgaacaagtgctgtgctgtacatataataatgtcgtgtataaacgcatgaaggacgtgtgccctgcattcttttcgtcttgtatcataaattcataaacacgtcgtcttaagtaattgtttatggacacctagaggggatgaaggttaaaatatttggccttgaggtatgatgcagccaatcaatttgtatccacaaagtttcagcgctggcgacttgaaactgcaaatgatgtggtatttttatttgcatcaaagctcaagatttcagagtaggaaagagtggtgtttcagaaacaacagaatacgttgctgttaaaagtgacgctggaacggtttgctgcacttactgtttgtgtgtaaaaatagtgaagttagtggactgaatgatcctggccagtttctcttaatgaatgattctggccggtttatgttaatggatgattctggccagttttcttttaaaaaaaaaaaaaaaaaaggccccta

SEQ ID NO: 24184 - DNA, 1119 bp, Zea mays
cggggggctcctcccggccggcaggtgaatccggcacgcaacagcaacgaccgccccgaaagagagccggaaaaaaagggcaggaaatcgccaccgcccgcacctatttgagcagccgcttgttccttccgcaatccgcgtcctcgctgctcctcaattcgattggctccgtgtcgacctccaggttgagaaggaaagcatcgcgagttcgccatacggatgggttccaaagcgcctttctgtctcacgctcctcttgctgctcgccgcggcctgtggacctgctgcacatgccaacgatgctgtcgagctcccgcatcatggctcagccttgaaggaacatatttcttcaaccaagattcctgcccgtctcaagaggggcagcggactatgctcggcctgtgaaaacttcacgagcgaagccgtcacttatctcggcaaggaacagacacaggacaggatcgtggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacggctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcgaaggtcacgtccagcagtgcaagaggctggttctgcaatacattcccctcatcttggtgaacggtgagaagttcctcgagaagaacgacgtctgcgcgctcgcacaggcttgtccagcgagcagtaggaagacgttcagctcgatgttgaagggagcgttgtggagtgacgcctggcttgaaggttgaagaagaacacacggagcggtttagcagtggtcagaaatagggtgaacaagggctgtgctgcacatataataatggcgggtataaatgcatgaaggacgtgtgccctgcattcttttcggcttggatcataaattcataaacacggcattattatatgtacctcgggcgggaccacgc

SEQ ID NO: 24185 - DNA, 955 bp, Zea mays
ctatagatctagtaaaacttatgattggttgacaactgaaaaaacaagattatttttctttttgagacagtggaagcaactattagacaagtcaagtttaacagtacagtacacgtgaatacttcgccctcaagtcctcaacccacacaaccaacaaatacgtgtagtactcatcagatctatacaacgataaacactcacctgaaaaaggacagaaggtgagcacagataccctgctcaactaacagttgatgcagtctatctcttcaacactgctgtgcatgaagtaacccacacaaactgcaaccaatactattaccgggatcaatagcctcagcacaagccacagcgtggaacccttgctaccatcggcagtgaagaatctcctaagcatttccgccagtggccataagagctcacgcttcttgtttactgcctgactcatttggccattatcttccgtgtcttcaagcttgctcaacttggaaatcatgttgccatataatttggcatcccttcttttgtactccttgaccttctcctttagcctcttgtaccccatcttcacatccctgttgtcaggatctatttctagagctttcttgatatctgcctctgccaaatcaagatcaacaagatgcatgtgtgcctgtgcccttctgtacaaggccttcacgtttgtgttgtcagattccaggacctcggtacacagttcctttgcttccttgtaatcattaagtcttagtttacatgcggcattgttgagcttgcagcttatctgaagtggtttcgatagctgcttctcttcttcagtgaaggagctgtcgcgctcggccgaccccgaagccttttcatatctcttagaagccctggcatacttgccaattttaaaccacacattcccttcttctttcttcttagcagctgcttcaatcttctcagcaacgttcttcaa

SEQ ID NO: 24186 - DNA, 3758 bp, Zea mays
ggcggtatattaggaaacaaattatccctatttgagttgcgcacacatttcatgttattaatgtgaatttgtgagatattgagtttgatgatatatatatgttgttcattttcatgtgatcgttatgcactaacagttatcgaataatttatacgctgtcgcaacgcacgggcacatacctagtgaatctatatgattatacctcatggtagaattaaatctgtcatttaatccatatatcttttcaaacaagttattcttttgatctatagattctaatataaacttttgcaataattttataaatttgtttcatatctaatgagctatagatataattaatgttttccatagtttaaaaaatttccaaactcttagattataatctataatgggtttatctgaataaatttttttgaacggccttgaattattttgggttttttggcataaactgtgacatggatttaattttaatccatattaatttagaactagattgatgtaaaagaacaagatctaatatgtgatggagctaggaagggaagggcttcggcacggtggtcatcggggccgagcgagagatttcagttcactttaaccaagcgaagaagttgctcgttggcgcgcctcgctggtggcttggtgcgctctagaactataatggctagttcggtggagatgtaaattagtttatttttacattaatctccttcgatccttaataagatttgagtggtctaatttctcgtagacttgaacgagttttaggaaagaagatcaactccaatagttatctaaaagacttcctaaatcaatactttaggtagttaacaaaaaaacttcaacagttctcaaaattaacttcctaaatttagcaacttctcatctaatttcatttcccctctacatttagcaaccatttagcaactctctacataaaaatgttgactgcatcatgtagataatgaaggtgattgttgacatttatgacctatttgtttttatgtgcatagatacaaaacaaaactataacctatatttagagaactattgaaaaacttacattttttacttataaagttatttagcaacttcttaaatctgtgatttagatagctgaaatttacataactattgaagatgctctaagtaattacaataaatcaaacttaatatatacatgtataatgcatttacttggctttgcattaaatgtcgacatatttgtctatataaaactagtaaaactaaaataatttggggtaaaactaaaacggtttataatttaaaacagagatcagtagtcgtcctgaagtgtgtccttattgtatcagcctacgatacaaagattaaaatgatgcgccgggacggcaaaatggccccataacaccattagaagtttcaaactgaccgcattcagtgaatggacatcggtgttcaaaactccaaggaacttttttttttttttttttaaggaactaatctgcaagcacaaaattcagaatttggaagttggaacagtacatgcaacgatgtatccaaaccattaactgtccaattcagtgacagtggtgcacacactgcatgttccaggccagcacccgcccatgggagtacaaaaagaatgtgcacaatctgctgtgagttgacatttctgtacaggactgggacgggcgctcccattcagacggtagggaatgtgcacatgtaatgaatatagatacaaccttcacccttacctactaactaaaaaagtgagaaacagataatactaacatggcatctccagcgacaccagtctgtatagttgccaccaatattcgtcattatccttttgaagggaggtgctggcattatatcatattagaaagagactgctgccgcccaagcactcgagttcagtcattggcccactttcatccccatgattctatgtcacctgatcatttccatttcgaggtggatcggtgtaatcttgaccatgatcacgaacatctctgaacatagagaagaaagaaactatgccatcagaagcaccgcctcccagcaaccacagcaaaagggacccaaatgggttgagggagcctgagcctgcaggggtacttccagctcgctgagggttttgctcttgatactggagagcattgttggcagctggctcagaaattccattctgttgaccctcttgctggctcctggtagactcatcctgaaccaatagggcatctgcttcacgagcagcaccgaggccatcgtttattgtaccagggtccctcacatttaccctagcaatgtgtaaggtagaagtgtagatagttgaggatgtaatgtggacacctgtttgctggtgaatgtgtgctcgacttcgcatgaatctctggagagctggcacctgaagcagcacacgcaaacacgaagtacacattgggtgacaaggatttaatggagctaatgaatcctatatatgcacactaatctaactccaaagtgaatcaaccaatttttggttaattttctgattcacatgaaagttatgacaagtggtgcatacaaaagactgttcaaaagctaaaaaaaatacatatatggatattaaactttgaaacatttaacagatagtgatcgatgattattttctaaaaaaacataaacataaaagtacatcaaaatgtagtactccctccatcctggatgatcttacaggattcaaattgtcccaaaatacttgaccttataggatctcaatgcacctctcttttctcaatacacctctctctttttccaatacatactatttccatctctctctatcagtgtccttaaggcggtaaggcctatctccatctctctctatcagtgttcttaaggcggtaaggcgaggcaaggcattggaccaccgcctagatgcctaggcgcttactaaggcaagcaaggcgacgccttaccaatcagaaaatagcacaacaacagcatagatgaggaagaaaaaagaaaaggaaaaaggagaagggctaggagatgtataagagatggtccaaaccatcagctagcccttataacctcccctgctggtgttagggttaccccagtctcagactctcagtgccgctgctctgtctcagtgccgcctctcctgctctcccgagctctgccccgctgctgcccccgagctctgcgccaccagccgcaactcccccgagttctgcgtcgccgactgccgctctcccgagctctgtgcagtcgctctcccgagctttatgccgccgctcccgctccaccaaatctctgctaggcctctttcccttcccctcttacctttattgctgattcttagctaggcgacaggggcgcctagaacttttgggcgcctggacgcctaggtgttgcctaggcaacgcctttgaaaccatgtgtgtatctactgtaaatttattttaaaataaatattaaggcatcaaatacaacaaatcaagagcacacaaggttctcaccgataggtgctccaaatgcaccaggaggaagtggatcaaattcaataccaagcactggtccatcgtccctcaaaggttcccctataagtgcttccacagaatcgatcacccggtgctctgcttgcataaggtgcactggtgccatatgaggcagcatgacttgtggcggttcatagtacctcctcccaatctccggcacagataacctagctgcagccgataaccggccagaccctctcctggaataggtcagccaaggtaccg

SEQ ID NO: 24187 - DNA, 1422 bp, Zea mays
ttttttttttttttttgccaaacaaataaaatacatgggggtaacattaattataaattgtaatatacatgcacaatacagttacatacttctggaagaaaatgatttaaaatggagaccatctttattcataatggtgcagaatcaagcagtaacacggatggtggcattggtgtttagtgggtacaaaacttacatatttcacataaacccaacagaaatttaccgatactgaaattttgcaaatcaaatgtgattctttatgtcacactactacatttgaatgcaaacaactcccccttaagaactcaagcaaaccagtgaggaagcgtcatgtactgtcttctgcatcaagtgtacttctgactccatcttgaaatgatattggcttgataccaaggatctgggttagcttggtgatgtccatggatatgtctggtggagaagctactccgcgattaaccgatgatgcagacacagatttgattatactggggttatatccacggacaacagcaacagactcagccatctgcagtcttgataccctatctggaccaccgacattcaggaggacctggacttttttgccatcatctgggaaccaagtctttgtcagtgacaaaattacgtccaccatatctttgacatagacagggcaccggaattcatcactgaagaactcaacctgttggccttgtgaaagaacaccatccatccactgaatgggaagggattttgccacaggagagattgtttgtggcccatatataatgctgcttctcaagatcgcatagttcgagcatttctcaacgattagtttctccgctgcaactttagattttccatacatgttcaccggcattgtctcgtcctcttctttgtagaatgatttcaccccctcataaacttgatcggttgagagatgaatcaaaagcgagtcgtcattcccaaaacttagcaaccaattcacaagcgaagaaggcacattggtagccatagcagcaggtggatccaattcgcatgcccgaggaactgacatcgcagcacagttgacaaccacgtgtggctggccaaaggacgcggagatcgcctcgaagccgtcgccggagcggaggtcggcgcggaatgcgcggacggaggggagcgtctcgaggagcggctgcggcggggcggggctgtggtgggtgaaagcgacgtcgaggcggtcgacggtggaggacgccgcgaggaggtgctggcccaggtagccgctgccgcccaccaccaacacccgcttcctctcctccttccccgccatctgctgtgaacgcgatgcgagagatttgcgagggagctcggcttcggcggcggaccgtgggtcgcacccacccaccccacccatccttcatttcagtttcagctgagagcgtgattcctgct

SEQ ID NO: 24188 - DNA, 1821 bp, Zea mays
ggccgcttttttttttttttttttagtcagtcaaaaatatagtgctcgtatagatactcgaagtcagtcacagtgtcacaacagaatataccagatctaccaccattcgcagcatgggaaatgcggcggaattgcggaaatcatcattccatctccattccgagcagcacaaaaggcatcggaacggcaagtccaggacacatgcaccaaaaggaaaacacatcacgcagcaaacgcggacattacagcaactgcatacacgcgaaaatattcgaacaaaagaatacgaacctccttcactgaccatcacaaacacctataaaaatcggttaagtagctaatatgcccccgtggaaccggtgctgtttttccacctcgtccagagcaggacttccagggtgacgatggtgatcagaaggacggccaggttgaaaccgtagccgatcttccaagagttgcctgctccgccgaccttgatcccgagcacaatgttgatggctgcaaagaagagggcgagcctgccgacccagtggtggtaccagttccagaacttgcggtacttggagtccttgttgggcctcaggaaaatcgccaggatctgcaaaatggcaagcacgagcacgaatatgccaaggcccctgtgcgcggggacgtcggcctggatcttgctgtacaaggatactccagccacgacgccggctaggcccaggatgaaccccacgaactggatgccggcgtggaggtagaaccacagagggtcccatctcctgcagtaccttgcgacgatggcgccgatcggcagtagcacgccccaggcgaacaggttgagcgccccatgggtccttttcagaccttccgggaaggatgacgagcctgatgagctgcctgtggtgaaatcgaatacgatggaggtcttatcctggtgctcggcgaggcggtcgttgacggggatggcggagccgacggcgaggagcacgttctggcgcctgagcggctcggtgaagctgagctggaaggcgaggtagatcttggcctgctgcacgagcacggtgggcttgtggttgtcgctggagacgaggaagccctggtccgcgaccacctgggagggggtcttgccccgcagcgagaacggcttgatgtgcgggagccccgtcttgccgatccaccccaccatggcgctggagtccaccatgaggccgttcttggagaaccccatccccacccaccccgtgctgtacatggtcgacagcaccacccgcagcacgttgtccttgtcctgcgcgtaccggagcacgaagctgttccagacgggggcgcaggcgagccccgagaagttgccggcgagctgagccggcagctcgtcgtcgcagctctgcgtcatcaccgccggagcgaggacggcgagcgcgacgagcagcgtgccgacggacgcggcccccattaccatcttcccgagaaggacacggccgtcgacgccgacgcgggagaaccagtacagcctacgctacgcctccgtatcaactgcgatgtgccaaccaccgcccactactgctagtagcttttactgaaccgagctgcgtgggagttgggtacgtgttggtggctgtgtgggcatctccgacctggatgcagcttatgatattgtcattggcaatttggcatgttgctagtgacggtgggctgttcttacgagaagggagaatctcctgcgagcaagcgtccctagtcgctagatctagaacaagccaaaggatccatgtgtgtgcaccgtgcacgcgctaccctccctatggatctttcttgggttgtgctagccatgtt

SEQ ID NO: 24189 - DNA, 2279 bp, Zea mays
atcgcgagcgccgccctttttttttttttttttatctcaaatttgtcaaaagaactcaatattgcaaagggacaagggtttacactttacaacaacgatgctgcccaaatcataaatacatatatattatcagacatttcgatatcatattagttatcattatttgacacactctaggtgccgcaaacggataagtgagttcacgaagcacaacaacaaaaatacacgactgatacactacatgatctaactgagtaaacagatggtgagatggcacattgaaggtatatttggcaatgactgcattccaactgaagaagaaacttgcaccttctaccttggagtggaaccttacttcaaaagtgacaccaaattataggagcaaaggaacccatcggcacctattatactagacctctgggtcacgcaacagcaacctgtatatctcattgttgttctctgacatgtactcgtacccgagattatcagcatgactcttgaattcatcgaagtccactggcggcacttgtataccaactaatacatttgctccagtttcaccctgtgcacggtaatggaaaagactgatgttccaacgagggctgaatgcatccaaaaatttcataagggcaccaggcctttctggaaaaatgaaccggtaaacaagttcatcttttatttctgatctacctccaataaagtatctaaggtggtcctttgctaaatcattatcagtaagattaacagtcttcagtttcgccaattccatgcgatccaccattgctccaagctcattgtcagtgtaaatgccaacactgtaaagaacaagggcatcctttgcattaaaatcatatctgtatttaaattcagtaatattcatcctgccaaccaattctgtgaattttttgaagcttccgtgctcctcgggcagaaatgtagctaacactgcttcccgttttcggccaacatctgctagctcagttacaagtctaagtcggtcaaagttcatattcgccccactagttattgcaaccacagtatctcctttcaagttatagtatttgcagtaggcttcagccccagccaatgcaagggcaccggcaggttcaaggatacttcttttctcctcaaacatatcctttatcgaagcacaaatagcgtctcgactgaccataacaatgccatctacaagctctctgcacaggcgaaatgtttcctcccctacagctttgacagcaacaccatcagcaaacccaccaacatgctccaacatgaccctcttaccatgatataaggataatgccattgcatttgcatcggagggttccactccaattattttcacctctgggcgaacccgttttacataggcagcaattccagcaattaatccaccgcctccaacaggtacaaatattgcatgcagtggaccttgcagttgccgaacaatttccatgccgacagttccttgcccagtgatgacatcaggatggtcaaagggaggtatgaatgtgcggtcttcttgctgacatcgtaattttgcgtatgactgagcttcatcatatgagtccccctcaaggaccaccgttgctcccaaccgctccactgatttccacttgatttctggtgtcgtcacgggcatgacgatgacagcatcacaacccagtctctgagcagaaagagcaacgccctgggcatggtttccagcagaggagcagatgacgcccctctctaactgctcacgggagagctttgccatcatgttgtatgctccccgcaatttgaatgagaacaccggctgcaggtcctcgcgcttgatccagatgttgaccccgaggcggtgggagagcttggaggcgagctgcagcggtgattcgattgccacgtcgtacaccttggatgacagcacgctggtcaggtactccatcgcgccggggcctcctccttcccccgcggcgtccccaaacccctccccatccgccgcgcacgcaccgcgcgccctaaatccctccacgaggcacccgctttcccgctgcagtgactccggcaccacccgaaccatcggcgttggcggcggcgccgggacggccgcgagccccgcctcagcggccgtcgtcgccgcggcggcggcggctacgcatgaggtcctgcgcgcgtcgcgacggagggatgctgcagggaaggaggccgagggcgaagcggtggtggcggcggccgccgccgccgtggcggggacggtggcctcgtcaaattcctctgatttgtttacctcgtgtttt

SEQ ID NO: 24190 - DNA, 1341 bp, Zea mays
gggtcccggtccccccctcggtttttttctttgaatgaacattcaaatcttaaatttgttgataactcatgttgcagagacaagggtttacactttacagcagtgatgcggcccaaatcacaatcacataatcattattagatatttagataacatatcggttatcattatttgacaacctctaggtgcacaaagcaataaattgagatcacgaagcacaacaacaaagatacacaactgatacactacatgatctaactgagtaaacagatggcacaccgaagctacatttggtgatggcttcatttcaactttagaagaaactcgcaacttctaccttggagcaaaatcttccttgaaaagtgtcaccaacttattatgggagcaaaggcatatgacattagacctttgggtcacgcaacagcaaccggtatatctcattgttgtgctctgacatgtactcgtacccaagattgttggcatgactcttgaattcatcatagcgtggtcgcggccctggtacaccaactaatacatttgctccagcttcaccctgtgcacggtaatggaaaaggctgatgttccaacgaggactaaacgcgtccaaaaatttcataagggccccaggcctttccgggaaaatgaaccggtaaaccagttcatcttttatttctgatcttcctccaataaagtatctaaggtggtcctttgccaaatcattgtcagtaaggttaacagtcctcagtttcgcagattccatgcgatccatcattgctccaagctcattgtcagtgtagatgccaacactgtaaagaacaagggcatcttttgcattagaatcatatctgtatttgaattcagtaatattcatcctgccaaccaattctgtgaattttttgaagcttccctgctgctctggcagaaatgtagctaacactgcttcccgttttcggccaacatcagctagctcggttactattctaagtcgatcaaagttcatatttgccccactagttattgcaaccacagtttctcctttcaagttatagtatttgcagtaggcttcagccccagccaatgcaagggcaccagctggttcaaggatacttcttttctcctcaaacatatcctttattgaagcacaaatagcatctcgactgaccatctcaatgccatctactagctctctgcacaggcgaaatgtttcttccccaacagctttgacagctacaccatcagcaaacccaccagcatgctccaacatgaccctcttaccatgacacaaggataatgccattgcatttgcatctgagggttcccctccaattattcccggccgag

SEQ ID NO: 24191 - DNA, 1751 bp, Zea mays
tgcagttcacaagtctagcttgttgagcgttgagattctaacgaaattgagctcctataaacttgtgggatcaagtttcacggtacgctaaaaagcaaccacttcaaggtttcagcactctagtaccaacaataataaataacaagtccaaagtgcaaaatatcctgcaacgtctattctcctcagagaaagcgtgacaagaacgtatcgaagccaaagtggagaattaaagggaatgcccgagtacctatccccatgattctggggatccaagcatcgcgttgaaacccggtgaacaacataacacgatagtaccgaggtaaccacccaaattctcaagatatgacactgaacaatgtcatgggtgagtgcaaatctatccacaaacacgagtggcaactgaaacatctaaaccacatgtacaagaaatgatgatgttttctgggaataaaaatgcacaagccacgtccatgaccatgaacacaagccaaccaaacaaaggtgacgaggtcggggtaagtaaactagggctgcacatcgacgtcgattaccggctgcaggtcctcgcgcttgatccagaggttgaccccgaggcggtgggagagcttggaggcgagctgcagcggtgactcgattgccacgtcgtacaccttggatgacagcacgctggtcaggtactccatcgcgccggggcctcctccttcccccgcggcgtccccaaacccctccccatccgccgcgcccccaccccgcgccctaaatccctccacgaggcacccgctttcccgctgcagtgactccggcaccacccgaaccatcggcgttggcggcggcgccgggacggccgcgagccccgcctcagcggccgtcgtcgccgcggcggcggcggctacgcatgaggtcctgcgcgcgtcgcgacggagggatgccgcagggaaggaggccgagggcgaagcggtggtggcggcggccgccatggtggtgacggtggcctcgtcaaattcctctcccgtgtttacctcgtgtagtcgtgtttatgcggtgggtaaagctaaaggctgcttcaaggtttcacaatcgattacacaatcgagcgatatcaattttatctccatacattgcttttaaactttatcgtatcacatcaatatttcttttagatattcgtatgaaaataaaaacgacgttttatttagaaaaaaattatagaacatatatgaaaagaaaccataatttatacaaggaaaaagtctaaattactcacatcacatatgagttatatctatataactccacctatgagttgtatctacatacctatgagttcaatttatccatccatatgtttaagttggttcaatctatctctaacaaaatttatctttttatttctgtatatacaaactaaattatcaattcaaattttattggcaagtagctattatcataacttagcctagaaaaatatattatgattttttataattattttgatagattagagatcacataatataataagtttaatggtacacactaaatgtggaacaatgattaaaaatcttaatatattttctaacataagttaaaatgttctgcatcatcatagaaaatatgaactttaaatttaaactataagtggaaaacgaaaaagacaaactctaataatatttgtcttttttctccatgtaaaaagtgaattttgagttcatattttctaaggtgttctagaacatcataatttatgttag

SEQ ID NO: 24192 - DNA, 1344 bp, Zea mays
atctcaaatttggtaaaaggactcaatattgcaaagggacaagggtttacactttacaacaacgatgctgcccaaatcataaatacatatatattatcagacatttcgatatcatattagttatcattatttgacacactctaggtgccgcaaacggataagtgagttcacgaagcacaacaacaaaaatacacgactgataccctacatgatctaactgagtaaacagatggtgagatggcacattgaaggtatatttggcaatgactgcgttccaactgaagaagaaacttgcaccttctaccttggagtggaaccttatacttcaaaagtgacaccaaattataggagcaaaggaacccatcggcacctattatactagacctctgggtcacgcaacagcaacctgtatatctcattggtggtctctgacatgtactcgtacccgagattatcagcatgactcttgaattcatcgaagtccactggcggcacttgtataccaactaatacatttgctccagtttcaccctggggcaagagaattaggtcagatgatgaaatgtatataattgtagcccctgcgtggtagatctttccattgtttagtaacatcaatacaagcaatatacacgtccctgaacaacttcagcaaggcatatgtttttttctcaagtttgaaatggaaagggtgatatgatcatttgaaaagcagagaagttttttcttgttcaagttccgtctttcaaataagtagcaaaaggatctttgtttcaaattataagactgcataatagacactactataggaaaactacagacaaaactcctcatgtacctgtgcacggtaatgaaaaagactgatgttccaacgagggctgaatgcatccaaaaatttcataagggcaccaggcctttctggaaaaatgaaccggtaaacaagttcatcttttatttctgatctacctccaatctgaaaaattgatatcgtggaatcatgaacaagatagaagaataactacaaaaatgaaagcaagggaactaaaccaattttaggcgtcgaatgtcacaaaatgcaaatccagtcaattatgctataggtaaatctcaatattgccatattaacactaacagtaaactaaaattacaattgatctctttgatagaataatatgccagcagctattgtgacttgtgagtgtgaaagaacaacttacaaagtatctaaggtggtcctttgctaaatcattatcagttagattaacagtcttcagtttcgccaattcccatgcgatcacatttgctcaagctcattgtcagtgtaaatgccaacactgttataaa

SEQ ID NO: 24193 - DNA, 5118 bp, Zea mays
cagcgagcggcaacagatgctggtggggggcacgcagtcagtatggaatgaggcggccgatgattggactcgcttggtgataatagtttggagccggttgctttgctttgctcccaggtgaactcaacatggacacaacggtgaagactatcacggcataagtgcatcacaaatagggatctaaagagaagctgaagaaaaattacacttctttgcttggatgaatgaagcctgaaagagagagggagatgacggggggaaaaacgaaaatttgatccaacaaaacaatgccctgaaaagaccaaaaaaaagagcgaaaataaaaaaaaaataaacaaagaagaaacagaataccagtgtccatcgacatgcaggcaccaggaacctatgcaattgaatccggccaaggacatttaccccgctagctgcgtcgtcacggcgtcggggcggcgggaggcgtgccccccgaccgctcctcctccgacgtggcgcgcacgccctcgctctcctccgtcgtggtccggccgccgtggccggcgccgatctcctcgaccatccttaccacgtcgggggcgtcggggcgcgcgtcggggaccgtggccacgcacgccatggccacctgcagcagcgccaccatctcctcctcggcgctggcgcccaggcgcaccagctcgacgtcgaacacctcggcggtccactcctcccgcaccacggactgcacccagcggggcaggtccagcgtgccgtcgccctccagcgacgcgtgcgagggggacttgcccgtcaggagctccagcagcagcacgcccagggagtacacgtccgacttgtacgtcagccgccgcgtgtccaccgcctccggggcgcggtacccgccgccccgcgccgccgtcgacgccgcgaacagctggtgcaggccgaagtcggagagcgccgccgcgtcggcgtccgggcggagcagcacgttcgaggccttcacgttgccgtgcaccaggttgtgcgccgtgtgcaggtgcgccagcccgcgcgcggcggacagcgccgcccgcatgcgcgcctccccggacgcgggggtccggcccgagccccggctccctgcgcgtgcatgcacaaactcccgtcagaaagctcaacccagccccgcggcgtccggcccgacccccgcctcccttcgcaatgacttagcgacaccatccaaatgacaactgagcaacacaaccaagttttttattacacgtagcaacagaagttcaagttcacaaaatccatgcggctggctggcactaaaaagcaaaaaatgaagatttgtttattctgccggtgagtcgacaatcatgttggacaggtatgaaaaccacaggggtttgtcactgctcaccgtcagggaatttgtgacggtcacacacataaacaaacgttgtgcagactggaatgcagagaactagctagctagtgcatccagcgtggagaggacaagacatgagcaactaactggtcaagtagaaaagtagggttggacagcggcatcaagcacacaacaagggataaacaaaacaaaaaaaaaatcatggccgtggtaggttgattaggtctactgagaaaccgatctaagaaactaaacggtctaattagaatagcgcagcacacagggcattcataagcgcatctgctagatggactggtaggacgtgacaggccagctacaacgccgaactagtaggtcgcataattgcacggccaaacagacacacaaaaaaaaaaagaggctgcgcgagctgtatttttgactcgagcgatcgacgggcttcttcaaggaaaacaacgaggctgtgagcaacgttgactggcagtggaccacacggcagaggcattaccgtgcgtgttcctgctaaaggctgctataaaacggcagtggcagctacggtagtcagtgcacagtgctgtggaccaccgcgatacagctacggagtactacaatactgtggcattgacgcattgtgcatgttactccagcggtacaaactacaaagttgagaggatttttttccctgtccacaggtgtggcatccattgtccctgtccgtttttttccaggatgggtaaccggcaacaacctcagcgcgtgcatccagcgtccatggatcgggagggggaggagaccccctggaccgtgggcacgcaggggaataatgagccacgtcctcctcctcccggggtggaaggagaaggcggagggcgggggttgaagaaggtctgaagctgcgctcgccggtcgccagcacgaagcgagcgcggccaaagagcccaagaccccacgacaactcacgcccgcattactctactgtcctccaccatatatcccatcgccaaagtgctacgcgtacagggagttcctgtggcagagcgagggtagttaaagtggagagcaccggacagcttccaatttgcaaccggtccccggagcatatttgcaacttttcctactgctgctgcatgtacgctgtaggatcaaatgagcagagtaccgggaacaagatatggcgccaggtgggtaccgtacagtacaaatacgcagggtcgttcctcacgtgccaataactgcggcgcgccattgcgttgcgtgcccgtagcgggtttctgctgttctggatcgttcagccagaggcttgctggtcgcaatgcgacggctaccaataataaatgagcgaaacaattctcgcccacggggcgcacccatccgtccgccgtgaccatccacgggggggggccggcaaggccagggcgtggcaggaccacgaccatcggagcctttacagccagggcaggaccctcacgcgggctcatcactgctgcgcacgacgcccgcaccgcacgacgccacgccaccaccactccgtccgcactgcctcgtcgggcgggcagcatctctctcttccatcgcatcgcagaaaagcacgggaaaaaacaaagcgggacgaagaaaagcgcgcgagaaccaccgccaccactcaccaccacctgccaggacggcgaagcggtcgcggcagcctaccaacaacctacgatcgatcgcccggccatcaaagccggcctgttccggcagaattccccgcgttcaattcaagcgcgccgccgtgcgcgatgcgacggagaccgtaccgacgtgacgacgcgggttgcccgaattaaattttgacaaggagatgctctctgatggtggattcctcgcacagtcctgcacggattggtgctgttggtaaatgctgcgttccaacgcgcgaacgaaggaatgagtggcgctgccgatccggctatccgaggcgacgacttggactttgaaatcccgccccggagtctccgggtccctctctctcctcgccgtcgccgcagtccctctcagctctcaaggcggtaaacaaaaccccagtcgcgacgcaaaatcgaagcaaatgcagcagcaacgccgcgaccgcgacccgatggacggcgacgcaatgcaagcgcgaggaagaggtcggatagtgtgggcagtgggcactgaccgtggagcatggcggagaggctgccgttggggaggtagtcgtagacgagcagcttctcgtccttggagaagtagtaggcgcggacggggagcacgttccggtgctccaccctgccgaccgcctccatgtgcgcgtcgaactcgcgccgctgcaccgccacgtccttgagccgcttcaccaccaccgtcgtgccttcctccagcaccgccttgtacgacgtccccacgctgcctttgcccagcacctccgccgacgcgcgcagcaggtcctccaggtcgaagctgtacccggcgcccttccccacgaacaccagccggctctgctcccccgcggcgccgcccgccgccgcggctgcgacggccgcggcagacccggacgcgccgcctccgaggtcctccttggacgaagacgtcatgccgccgccctcgccggacgccggcgggggctggcccctggtcgctcccgaacccgccgccgccgccgcggacgacgtcgcggccttgggcccctcacgggcgccggcgctccgacgtttggacaccgcgcagagcacgacggcgatgaggaggaggagccccaccaccacgccgcccacgacgatgcccgcgattgcggcgccggagagcttccgcctcttggaggagcccgtcgcggggccagggctaagcccgggcgatggtgctgggggaaagaacgagctgctgcagggcggcagcgggtccccgcagagctggaggtttccggcgaaggattcccgcgggaagtgcgagagcgatttggggatggagccgttgaggttgttgtcggagacgttcaaggcgccgagccccgcgatgctgatgctgggaatgctcccggagaggtggttgccgtcgagcttgagcactcgcagcgcggtgagcttgttgagcgcgaaggggatggagcccgagaggttgttgtgggagagcacgaggcgctccaggccgccgagcttctggattcccgtcgggatggggccggagagcaggttctgttgcagaaacagcgccttgaggctggcaagctggagcacgtcgtcggggacggtcccgaggacgcggttggagcggagcgagagcacgcggaggttggtgagccggccgagcgtgcccggcgggatggcgccgacgaggccgacgcccgggaggcgcacctcgacgacggtggagttggcgttgtcgcacgtgaccccgacccagccgcacgccggggtggaggcgttccacccgaggcggcgctcgtgcggggtcgcggtgaggaacgccagcagagcggaccgctcgctcggcggcggctccgcgacggcgcagcacgtgagggcggcgaccgcgagcagggccgccagcgccgctgcgggcacgctggggccggccattgcgacgtgcggcggacgcggctacgggcgaggcattggggaggagggggacccggacccggggccggacccgtgcgcctcactggctggcgctgccgttttcttttttctgcggacggttttcttttttttcttcttcttgtgtttgcttctctcggagtgtgagcctcgtgccgaatt

SEQ ID NO: 24194 - DNA, 2570 bp, Zea mays
tttttttttttttttttttgcatccagctatgattcttctgtctcaattaataatcatcaatttttttcaacaacattacctgtcagcactcagcagcgactgtcactggctaattgagagaaaatttatcttgagagaaaatttatctcaagctaaacgaaaaaatccatctctaaatgttatcacaatcacaataaatagtttccaagcatagactatccggctaccaaactacacctggcctgactaaatcagagcgaactatatatggtgcacagcttatattcattccaagctgattcttccacaaaactgtgcaagcttacaataaatgcatgcgctcaacataaggattgtgcaaccacttgttgagtggctccccgcagccgacaaagcagccagtatttccacgggtggtgaagaatggggattcaaagaggtttagaagcttttgaatcgattgcctaaccagcgaagatccagttaccctgctcctcctgccccagccagtgacaatgtcaattctttcagggccagtgcccaatgtcagaacctgcctatggaaccaggcaagcgtcctggacagtgcagtcactgctgtgccctcagacatcaggtgaaggttgatgagccaatacgacgagctcttctcccttacagaatctgggtacacgttcttctgtgcagcaacctcccatataaggcctgcttcctccttgagaccggacttgtgcaagaagtctatgacagcatccattagaccccttttactctctctgtcctcactgtgcatcatgtccaagaaataaccggtgtgatccctgacgttctggccaccagcttctgcatcaggcaagtacagcaggaacatgtgagctggatgtccagtgatggccatgagctggcagcacaaacccatctgtgactggcccacggtgcagcagctgagtagcagggtataagtctgcacagatggaacaagcccctgagcaagcatgttctggagcacgatgtaggcatcttgaaatctgttcatcttcaggaaagcactcaagagcgaattgcaggtcggcacgttaggctgcaaaccatcctgaagcatcgcttggtaccatcctagcgctttgtcaacattgccagctttgccccagagatcgaccaaaagtccatatactggctcatcaggagcccaatcacgcctcatctcaataaaaaccgcctcagcctcatccagatggccgcaatgaccaagaacttccataacgatgctgtaagttattttgtcaggacgaaacccagcaacctgcatgtctttgtacagcttaacaacattctcataatttcttgctttggcttggagcgcaatcataatattgtaagtaacaaggctaggtgtgcatccattttcaatcatctcacagaaaagcttataagcagccgctaattgaccacctttaccaaggcaattaaccatgacactgtaggtgaacgtatctggtgacaagcctacttcttgcatcctgccatataaatccattgcaatgtctaggtatccagctttagcatggatatcaatcaatgtacaatatgtaacccgatcaggctcataaccagcttcctgcatttcctcaaatactttgacagcctccttaagataatttgcacggccatatgcatgtattattctgttgtaggtcaccacagttggtttgcagtgagctcggctcatctcatccagaagttccttcaaaacaccaaattgcctggcttgtccaaggatgcctatcatggttgtgtaagtatgaccatcgtgcttgaatccaggttgcctctttaaccattgaaagaagccaagagcgacagtgtggtcatgaagcagcttgagtacttgatttgcctggaatgcatctatcttgcaatgaagattgtctagaacatgctcggtcattggaccccatttcatttgctgcagtgtgtggtagtactgctcaactgatcgcaataacttcaatgatcttaagttagattggggtcctccactatgagcttttacccttcctgtagaaccctgaattttgttgccagaaccactaaacacattgggacctgatgggttccgagtttgtacatcatcttgcctggcatctgaattgaaatgattagaatgatattttgcacgaggtagaccaggatgcccttgactccttatttgcgatggtgaactggaaaccatcacagaaggtcctgagaaactctgctttggctttgcatagccagctcttgggtaacccttcccaaattcattgttcacggaagggttataagccatctttccctcaggaaagttaagttgattctgtgccctattattagaagaatggttagccagataacctctgataagaccagttagtgcccatctgtggagcctgagcagtgcttccattattagatgatgatctgccattaagaagctctgtacacactccagctccagcaattccagattgagaaatgcttctggctgtctgcttagatggctgtacataatcacttcctatgatctgat

SEQ ID NO: 24195 - DNA, 2921 bp, Zea mays
tacatggaggtgttcacaatcatcatatcacagatacagaatgaatgcagatgtttcgccatctgtcctcatgattaatttgatgaatgatctcttagatctctcactacacaactatgaaactgttcgatcgtatgctggaagatcgcttacaaaattgttgaaacgttggccttctctaatttctaattgtgttctcacacttacgggaaatttgcgtgacccaaaagctcctgaacatgttgttcttggttcttgcagcattctgatctcacagactgttttaagacacttgaccactgattctgtttccctctcttcctttatcatgggaattctggaaagctctcatcatgaatcgttgaagtgtcagaaagctattactgagctctttgtaacatataatatacgtttctctggaatatcaaggagcttctttaaaactcctgaaaatcaagctgacaagccaggatttctcagtctaatttctcaaattaatgctttgggctttgagactaatggactacattggaggtacaatttgatggccaacagagtattactattactaattttggcatccagaagcgaatctggcatatattcacaaatgcttgcaaaaattgctggtcatttcttaagaaatttaaagagtcaactgccccactcaagaatgcttgctatatctgctttgaacacattattgcaaggatcacctcataagacatctgcacaaaattctaagcaaccaatagatcaccctgaagattgcaatatttcatcaacagaagagattttgaatgagataatccgggaggaaggattcatgaatgagacactgaacagtttatctcatgttcatattatttccgacaatgatggttcgtcattggcgccctcggggccggccgcgtttccatgcggatctgacaaagcaataacttacttctattttgatttctctgcctcatggccacgtactcctagttggatttctttactgcgtggtcacacattctattccagttttgctaggatattcaaaaggcttatacagcaatgtggaatgccagtaatctcttctcttcagagtacactagaagagtttttaatttcaaaagagagaccaaggcaatgtgtcgctgctgaagcgatggctgggatgctgcactctgatatcattgggaatctggaatgtgagaacaactggttgatggcccagttgcataagattatgttagcaccatctgtggagtcagctcctgaatgggcagcttgtattcgatatgctgttacaggaaaagaaagagctggaactcgtgctcctgttctcaggcaaaaagtattagaatgcttatgtactcctcttcctcattccatggcaactagcgtacttgcgaagagatattcttttctgcccgttgctctaatagaaatttctccacccaaaatgtccccagcagagaagcaataccatgttaaaattcttgatgaactacttgacagcatgaaccattcatctgctcaggtaagagaagcaattggtattgccatgtgtgttacaacctcaaatatgagactttctgggttatttggcactggatgttcaccgcaaggccttcatggggatgtaagcatgattgaacaaacaggaaataaatattggtctgaacgtttgacagatggagctaatgaattagccgtaagtatacaaaatagtactcaatctaagcaactagaatcaacatcagattcggctgaagatagcatggatgatagagagcaggctgatgctaaaaggatggaaacgatatttcattttatgatcgcatctttgaagtctgggcgatcttctgttctactggacactattattaggcttgtgtacccaattctctcactacaggaaacatcaaataaagatttatcattgcttgctaagtcagctttcgagttgctgaaatggaggattctacatcggccttttcttgaaactgctattacgtctattcttcctttagtcagtgatcctaactggcgtaccagatctgcactgttatcgtatctcaggacctttacctacaggcacacattcatactttctggctcagagaaatcacaaatctggcaaacaatagaaaatttacttgtggacaaccaagttgaggttagggagcatgctgctggtgttcttgcaagcttaatgaagggtatagatgaagatctatcaaaggatttccgtgaacggtcatatgcacaagcccagcatatttttgttgcacggagaagaaatttgaagttttctgttggtaccatccatggtgcagtccttgctttgacagcttcggtcctttctgttccatacgacatgcctagctggcttccttctaatgtctcgctacttgctcgcttcatccgggagcctccccccataagatcaacagtcacgaaagctgttgcagaatttaagcgcacccatgctgacacatggagcatccagaaggacgcattcactgaagacgaactggaggttctccgtgatacatcttcctcctcgtcgtacttcgcttagattaaaatttcaaaggccataggatattctctggtactggtgttgtgtatatgaatttataactgttgaagtgtcggtgtttttcataaagtatatccttgtacgtacctagttttatttcatcaacagatgccttcgtacaactgagatgaagttatgcagtctactgtataccgtctggacatagcggaagcattatggcatgtgggatccttgcgtgggctgagaaattgttaacatccaaatcttttgcccaaacaacgacgtgaataagatgctgcctagtttaaccgcaaaaaaaaaaaaaaaagagaaaaattaaaaaaaaaaaaaataagggggcggccgc

SEQ ID NO: 24196 - DNA, 1643 bp, Zea mays
cagacggatagagacccgcccgtctctccctcccggaaatcccgctcccgcaccgcctttccgccttcaggcgagcaacaaggcaagaatcccgcggcgaggatcggcgattccggatggccgcggccgcagcgtcctcggtggcgaggcgtgccgcctcgcgcggcggccagttcatcgcccgcgccttcgcctcgggagttggcggcggcggcgagaaggccaagcgggtgctggtgccggtggccgccggcacggagccgatcgaggcggcgaccaccgcggacgtcctcaaccgcgccggcgcgcgggtcaccgtcgccaccgccgacccgcccggggacgacggcctcctcgtccaggccgcctacggggtcaagctcgtcgcggacggccgcgtcgccgacctgcagggggagcccttcgacctcatcgccctgccggggaggaatgcctggatcagttggcctcagagactgcaaagcgctcgagaagatggtcaagacccacgccgaggatgggggcctctacggcgccatctgtgctgcgccggcggtgacgctggcttactggggcatgctcaaaggcttaaaggcgacatgttatccgtcgttcatggagaagttcactgcagaggtgatccctgtggactcgagggtcgtggtcgacagaaatgcgatcaccagccagggtccaggaaccgcagtcgagtttgctcttgctttggtggagaagctgtatggcaaagagaagatggaggaggttgctggacctttgtacttgcgtcctcaacatggagttgaatataccatagaagaacttaattcggttgaatggaaatgtggcagcacacctcaggttcttgttccagttgctaatggttcagaggaaattgaagctgtcaatttgatagacgtgttgcgtagagcaggagcaaatgttatcgttgcgtcggtggaggagaagttacaaattgtgacccgtcgccataagtttaatctaattgctgatatgatgttggatgaagccattaaaatgcaatttgatttgattgtcatgccgggaggtttgcaaggtgctcagaagtttgctagtacaaagcaacttgttgacttactcaagaaacaagcagaatccaataaaccttatggtgcaatatgtgcctctccagctcatgtgcttgagccgcacggtttactgaagggcaagaaggcaacagcatttccacctatgtcacacctgctcacagaccagagcgcatgtgagcatagggttgttgtagatggtaaccttatcaccagtagagccccaggcactgcgacagagttcggcctagccattgttgaaaaactgtttggtcgagataaagctgtcagtatagcaaaggagttgatctttatgtgagattgcactaatctggtggtatgagaagtatcataatgtggataaacataccagaaacctgatagtggtgcttctgtttctatgcctgcaaaaaaaaaaaaaaaatagctgactgaggatttcaggtgaatgatactattacatcacactgtaaattgtgagtcaagaatgtacgttttgcatttggtaagaccgtaagagaaaggttattgtgactcgttacttggaaaaaaaaaaga

SEQ ID NO: 24197 - DNA, 1297 bp, Zea mays
gagggccgctttttttttttttttttagaaatatcagcatcgcttgcctacatgcatggcgtcgataaaatctgaacgcaggtccctggcatcacatttctccaactcaaaatgtacactagacttcagtccggatttgatacacgtgaacgagacgctttaaacgtatcacagaaatgggcgtggagaacaagtttaacagccctgcgtcgtcgctggatccaaaacttcccatggaaccggcagcaggtgaatcacaaccaacagggacaggtttttcatcgcagatgagatggggatggcccagcttgcgcagctggaggaactcggaaacagggagtacagaataggatcacagccaaggcgcagaacggccacattcagatcctcagtgcgacggctgctgtgacaccggcgcgtaccagcggtcagcctcgtcggcggcgttgtcctccgccttgtgcagcgcggcgtggacgaggacgaggacgaggccgatgagcagcgaggagaggatgttggcggtggcgtcggtgaggaggagcaggacgagcgtgacgacggcgagcacggcgaggacgtagccgtcggcgacgacgcggccgaagaggacgaggggctcgtcgcggaggaagtagaggacgagccaggcgagcatgcagacgaggaagacgatgagggagacggggtgccagaggagggagaggaagacgacgacgaggacgacgatggcgtagttcatggcgaagtgggcgaggttggcgcgcacgcggaggtacgcgtcgccgaggctcgggggcaggccgacggcgtggacgtccacgagctcgcgccagggccggcgcgtcgccagcgccgaggcgccccgagccttggcgcgggagatgaaatcgagcggggaggcgccgccgaggggcacgggccctccgcccgcggaggaggaggtgggaatggtgccgtacttggacatggccggcggcgtcggcgtcggcgtcggcggcgaggcccggggtgtggaagtggaattggatgggatcgggggaggaaggggatcggggaagaggaaggggaagccgatgggatcaacggatgggcaggcacagagggcagagcacgcgaggaagatgcggcctgcggctgcggggtgcgatgccgtacgggacggggtccagtcctgtgccagttgtgcgacacgggaacgtgagtttcgagagcctgctactgctagacgtggtcacgtggaccaggacccaacgtcccaacccatcccccggttcgacagtccacactgatggat

SEQ ID NO: 24198 - DNA, 3547 bp, Zea mays
  misc_feature (2956)..(2956): n is a, c, g, or t
atgcagttgtggtaatgtgaattttgcgaggaggactgaatgcaataagtgtggagcaccttgcccaagtggcggtggcggcggtgggggttgtgctcggtctccgtggctgtcggggggatacaaccgtggcagtggtgattatggttctggaggaggtggtggcttcgacagagatggcggagactacaattctggtgggcgtggtggtggaggcgggggcagaggagaatacaatcaaagtggtggtagtgaccgtggtttggatgaccaccgtggtggcagaggtggcagctatggaggacgagaccaggagaaccaaaagggtagtgaaggtggctacaatgctggtggttatggacaaactcctcctcaaggtcctccttcctatggtggtcctgcaggtgactatgcagcacctacgagctcttatggaggcaacaatgcgtatggttcagaatctgcagtgccgcctcctaatagctacagtggtggcccaggctcatacccaccaagctatggtgccccgcctccacaccaatatggtggtgccccaggggggcaaggcggcctgcctcctacatatgctggtggatatggtggtcagtccatgcctgggggtggaggatctgggggtgcaccgccaccttatcgtggcggcgccagtggttatactggtagtgctggtcctgaaccagctggaaaagtcaagcaatgtgatgaaaattgtgacgagacatgtgacaatgcaaggatttacatatcaaatttgcctcctgatgtcactgttgaggaattacaggagctatttggaggaatcggccaggtataattaaattttccaacctaagtgttgtgcgacattaattgtatgttttacaaagaatatccttttctctactggtatatattttataattctgtaactgaattcattactgctcctttactagtttgctagactgatagttagatttgtacaccagtaattttgctctctatgattgtgcgttttgtaggcgagcaatctttagtagttaactaattattctgtgtaattcatgtaatcttgtaaagtgacttcctgtgatggaaaatgatatgggttacatcaaatctggtagtggtgttccactgctcttttggttgttattatgcttctcagaattttatcttatttgtgtaggagatttgtatggaactaatttttctctctacttttcatttctatattgaatagagtacagttggtttcacattatgttgagtctttttttgtaactaacatttcttttattaccaatcaccactttttagagtttcatcttatttttttacacgagctatcatgctgttgaaaccaattcatttatttaatgtgttgcccttcatcttcattttatctttgcattggatgattctgcaacgcttgtggctatttaaaaaaaaggttgggaggatcaagcaaaaacgtggttacaaagaccagtggccctggaacataaaaatctacactgatgactctggaaaagccaaaggagatgcttgccttgcctatgaagatccttctgctgctcattcagcgggtggattttacaatagtaagattgctgtcgagtttgcaatgtttagtgacatcaatttctccaatgcatagtccagttcagtttctaacacatctattctgttcatgttctagattatgacatgagaggctacaaaatcagcgttacgatggctgaaaaatcagcacccagagcagcaccttcttatggtcatgggtaagtagtttttatctgtttatctgctagattcaaattgtggattgccatatcaaactgaatcaagtagtactggtattggaattctatagtagtatagtgtgcaatttcaattatgtgacacgttcagctagaaatgataattcctgcgagaaacaaaaaaacgcaatcaattttatatgccgcgacactgttaacacttttgttttgatctagcttttgaattagcttcatttatagaatgatagatattgtccaaccaaactgagtttgtaagttgttctatcatacataaggtattaacggttgatcaaaacacatagcccaaaggtcatgatttgtgctttcattttagcccttttatgatatattgaatattgatatacctttacataagtaacacatgggtggtgttgtcaagggccttagtgtctagggtagatggcccttggctacggagatcgtagccgcggtccgtcgtcttctccagcgaggttatgcccctctgccgtcggcttagttgagagagagagattaggataatgatctttcttaattccaactcaggtctgattacaggaatatatataggcccctaggtctaaccgcatggagctaactgctccctaattctaggcatgcaaacaacccttaattctaggcatacaaacaacccataattctaggcatacaaacaaacttatctagtttctatccttaattctaggcatgcaaacaaacttatctagtttctatccttaattctaggcatgcaaacaaacttatctagtttctatcctatccactagagccggcgactgttgcctcctgggcgcgctcacgcccacgacgcacatcccgggcgcgccattgcctgatgtagggccggcggtacatgacatgaatgttgacgttatcagcttttgttagcttgaactctcctataacttgacagaagctaaaaaaagtaatattgtgatggattgcagtaccatataaatcattaaaaatcactggtgggagggggaatggtttgaatgtggaaacaggcaaaataattatgttttgatgtgctatatttttatgtgataatgtttacgtgttgaaattatgtttgtaatatgtgaagcaagagtgacttcatcaaggtgattacacaagcggcagggaaccanttcaaatttgtgtactaaatcatgattcatgtggacgcccttttatgtaatttggactttttgatggggtgtgcagcggtggccgcggtggtggatatggtggaggtgcccgcaggcataattacagagatggtgggggccatggacccaatagaaaccagggtggtggttcgcgttcccgaccatactgaaagcaactaatattcttactgtgattgttgcctgtgagaaaccatttctattcctgttctacggatttgtactcattcaggcgcataaggtaggttgtctgcttcccttattagacttgtgtcaaattgtcatacaccagtcttggtcggacttatgtttgtcctgaagtgattgatctatgttgtatgaatttttgcatagaggcagatggggatataagctccccatgctggtaggtttgtgatgctattcccggtgcgcgccgaaccgttatgattgcttatatttcttcgtcttcacttcgtcattaatctaatgcttgcatcccacatggtacctcagccggtggatcactcctgtaagctttggattttgctgcaaagaacaggtagcgtggtt

SEQ ID NO: 24199 - DNA, 1439 bp, Zea mays
  misc_feature (10)..(10): n is a, c, g, or t
  misc_feature (57)..(57): n is a, c, g, or t
cccacgcgtncgagcaccttgcccatatggttgtggcggcggtgggggttataatangtctggtggaggtggtgggggatacaagccatacactggtgattatggttctggaggaggtggtggcttcgacagagatggcggagactacaattctggtgggcgtggtggtggaggcgggggcagaggaggatacaatcaaagtggtggtagtgaccgtggtttggatgaccaccgtggtggcagaggtggcagctatggaggacgagaccaggagaaccaaaagggtagtgaaggtggctacaatgctggtggttatggacaaactcctcctcaaggtcctccttcctatggtggtcctgcaggtgactatgcagcacctacgagctcttatggaggcaacaatgcgtatggttcagaatctgcagtgccgcctcctaatagctacagtggtggcccaggctcatacccaccaagctatggtgccccgcctccacaccaatatggtggtgccccaggggggcaaggcggcctgcctcctacatatgctggtggatatggtggtcagtccatgcctgggggtggaggatctgggggtgcaccgccaccttatcgtggcggcgccagtggttatactggtagtgctggtcctgaaccagctggaaaagtcaagcaatgtgatgaaaattgtgacgagacatgtgacaatgcaaggatttacatatcaaatttgcctcctgatgtcactgttgaggaattacaggagctatttggaggaatcggccaggttgggaggatcaagcaaaaacgtggttacaaagatcagtggccctggaacataaaaatctacactgatgactctggaaaagccaaaggagatgcttgccttgcctatgaagatccttctgctgctcattcagctggtggattttacaataattatgacatgagaggctacaaaatcagcgttacgatggctgaaaaatcagcacccagagcagcaccttcttatggtcatggcggtggccgcggtggtggatatggtggaggtggacgcagggataattacagagatggtgggggccatggacccaatagaaaccagggtggtggttcgcgttcccgaccatactgaaagcaactaatattcttactgtgattgttgcctgtgagaaaccatttctattcctgttctacggatttgtactcattcaggcgcataaggtaggttgtctgcttcccttattagacttgtgtcaaattgtcatacaccagtcttggtcggacttatgtttgtcctgaagtgattgatctatgttgtatgaatttttgcatagaggcagatggggatataagctccaaatgctggtaggtttgtgatactatttcaggtgagtgccgaatcgttatgattgcctataaaaaaaaaaaaaaaagcggcc

SEQ ID NO: 24200 - DNA, 1759 bp, Zea mays
tttttttttttttttttttttttttaacttagcatataatacacgcaataatgttttgaagtcgtacaacttgctagtcattctagctaaccgatttgtacgattaatcatgattaatcaccattagtcggatgactttgacgattaatcatgattggtccaaatcgacttgaacgattaatcatgattatcacgattaataagacaatttgaaaacagtgacaatatcgagcagttagtttgacaaaccatgctatcatgtttcacttgcactcagcattggctacttactaattatctacttactcaaataatactacaaatgcatctagcacaaaaaatgctacatttaaatacatttccatttgttccaaacataggtgcagcacatgcaactgaaacccagcagcgtcaatgcatccttatcacgaggtggggttgtagcgaaggtgttgctcatagtaatcaataagcaccaggggctccttagctttcaactgcttatcgtccacgaataccatttccccgtcagacctgagagccttgaatgttattgcaacttgctgcacaccatccataactgtggcaaaatagcgcactggcttaatgatcttaatgatcttaggcatatgaatttggttaccagagtcctcccctttgttcttatcaccaggatctccttctgtggaatcaacagtctcgttgcctggcttgtcacttgttcgatcacggatatctccttgctcatgtgttacttcatcctgcttaaaccttcttacacatccagacttgcgcttcttagcacctgtcacctgtccaccctgaggtgtgattgctcgtatttcattgtccatcttcaatgaaccattagcagggtgctgcgcatcttgttgatcagtcaagctaacagataagggagcctcttgagatggaaacccaactgagaccacaccagaactaccctcctgtactattctttgcccaagcaagttcactgctgcgccaaggcccccaggtgaggtcttgttactattattatttgctctcctactacttgtcctgcagggcagtttcttcacttctgaggcatgtatgctatgcatgctccgggcctccgaccgaggtggtcgaccacgtttgccacgagaagggttaggatcggatgttggagttgttggagtcttgcgctttcgctttccacaggatctgggcgaccttgaccgcttattgaaagcatcaacaatgtcagaacaggccttcaggttttcaaggggttcccatgtgttagcactctctggccacccacgccacttgacgaggtactggagctggcccttgcggaggcggcggcggcggatggcctcgatctcgaagtagccctcagccagcttcggcggctccacagcttcctgcgccggcgtctccgcttcaacttcatcctcctcaccacatccctcctccgtctgttcctcctcttcctcgtcgccctcctcagtcagttcctccgcctcatcctcctcccctggagccgccgtcggatagccggaatccttcctgttccgccgcatggcgaatcttgtttcactcgacggcccaccacacgttcgctcgtgttatccaaatcaagggcggatcttgtacagattttgctgaggagatctggtttttggagccgccttttctcggagggattcggaaggaacaaggctcgttcagttcaggggcgcagtacgcgtccggctccggatcccgtgttatt

SEQ ID NO: 24201 - DNA, 3309 bp, Zea mays
  misc_feature (465)..(465): n is a, c, g, or t
  misc_feature (748)..(748): n is a, c, g, or t
ataaacgtttaagcatctgcttgattatcataatctaagtatctagattatactcttcccgtcctattatataaggtgtaaccacctatggttcagagactaaaaatacatttaattatctctataccactgtatcgatgcacgtgtgtatagagagcacgtcttatattgacaaaaacaaaaaatgggtacacttggattctaagacggagggagtataatctatctaataatatgtattgtttatctagattatataatctatcaataatctgtgttatttgtttgtactttaatttatttaagcagaatcatataatatagagggtaaacagacatgaccaatctctctcaatgaattacagaggtcttcaggtaatattgtaatcatagaaccggtgaaatggacatacaaagttactgctttccattacaattaaattataattcattttggctttttantacatccaaggttgtcaaagtcatagattctaaatatctaaatcgaaaaaaaaaatctcaaaagattgtaatcatgggactgtgtacataaaaattgtaaaaactaagcacgcgttgtgagaattgtgcgtgatttttgtcaaagatgtgggccgtggatggcccagtgggaattgtgcgtgattttgttatgggtgtgggccgaggacggcccagtctgggtgtggtctataacgcccttgctaaggaagaaataaggactagaaaaaaagattagaatagnttaattagagggatctaatagttagagaaactattaaatttaggttaattagatataggattggatattattgttatggtttaattgggcttcccttcagtgattagtagtattagtggggttgaattgtttgttttttcttcactcctttcttcttactacatcatctctctttatataaagagaacttctgaccacaaaagactcaattaaattataacttatcatacccactcatatctctagttgatctaaatctaacagtatctctagttgatcaaatccctttaattgacctaaatctagattaaatgattctaattgatctaatctctctcctaaatcgtatttcttgctccttcctccgcaagattaaaaacaagccattgaccactttagtatttttattgagttatgcagagtacaatagatattcttgctcccaaagttacatcgatagtttatttatttcataaattcgattagacaaaaaatagaaatcttaatttatgaaatagattgccttattcatcctcacctcttaggcatcatggtccctacatgtgccatgaactttattaatattaatttataatactttatttcctcttataagtaattacatatagtctagtttcattctaaatctgttatgggtgttgggcctaggacagcctagctagggctgatgtgaacaatatctattgtactctagcatgacgatattcttccattattcttgctcccaaacaagaccttaactctcttaatatattcctcaacttccacacatcataatggttggttgggtggtcggtaccattttttctttttatttgaaagaataatggataacttataattttggggaacaattatctgtcacaccatggtaccaagcacagccccatagcaaaggcacacaccaactcaactttggagatgagtgtgcataaccgagtgagcacccccagctccaccaggcactaagccaaccacgatatactaccgaaccaattcgggtccggaagcgaccaagcacacccaatcaatttgagacgacgcagtgggggatacaaggccagtttcatgtaaattagtcggatatatggatagctataacctgacacattttgcacaagttcaaactgttttcttgagacttgaacatataagctagggttgtatgcactaccctcgtccgttcctgcgttctttgtggctagcactggaaatgtatgttgtatgtaccattgtatttgcaaatgtagttgtgcaattctgcaaacaatgtcttgttacaaataatcaagtacaaaagttgtggaaaattataagccctcggcatacactcctccagtgtgtgtatcttttatgtaccaattgcagcaaatttcatagcctcataggcctagccactcatactacagtcgtgcaaaaactgattcagtcacgcccgttgcagaacatccattatccatactgtgtagtccagtaagggctgagactggaattaattgtcccagcagtggtgtattcattggaacgaattcactgaccgtggctcgacaacggtgtaagtaacatctggcaggcagtaagaggcctatattttctgacttcagaggcgtgggttaagaaccatcagcacacctgcatcttcattcttcactatgttgctcacatatacagccaggcaagggatttgcaaagaaagactcttctagctttgggaattcgccaggctccctaaaatatggagcacctattctatctttgtgtaatcttttcacttctgagctgaatatatcccaaggcactcttcctccatcgaattcatctatcaggttcacaaaattcatcctgcaggacaaagaatcagatattcagaagagaaaaaaagagacgaagaagtggatgaccgcttgtctacaacacaaaccacaaggctagatgttcattcggcgcaaaattaaattgaccataacagacccatctaacagtttaatgtattacctgtctggattaacagtctttctgaagttctcaaaacgacgatgtccttgtacagcttttgccatatttccatcataagtgtaaataaagacatcactctgaagagccacgatgtaatcaagaccagcaagcatattctgatggtttttgaagggtgcaagttcctcttctgttgccagcgtagaatgagaataaatattgggaaaatcgtccttcagagcattcatgcttccattgccaaaagcttcaccagcaaccaagtaaattctggtgcttcgagtgaaacccagtcctttgagtaaaagtgaagtttcccttggcgtcaaaggacagccaccaaggcttcttctctcagtagcattgatttctttctctttccagtgactgacttcataccgcattttacgcagttcctcctcttcttctgatgtcaagttatggctgcaaccagtaaaagctagcatgtccttctcgtacctgaaagaaatcaaaactgacacaaattaatcaaatgagcaaagcttgaaaagtactgcagcttactt

SEQ ID NO: 24202 - DNA, 1890 bp, Zea mays
ttttttttttttttttttttttttttttttttttttttttttttttttttttttttttttaagcactggaaatggatgttgtatgtaccattgtatttgcaaatgtagttgtgcaattctgcaaacaatgtcttggtacaaataatcaagtacaaaagttgtggaaaattataagccctcggcatacactcctccagtgtgtgtatcttttatgtaccaattgcagcaaatttcatagcctcataggcctagccactcatactacagtcgtgcaaaaactgattcagtcacgcccgttgcagaacatccattatccatactgtgtagtccagtaagggctgagactggaattaattgtcccagcagtggtgtattcattggaacgaattcactgaccgtggctcgacaacggtgtaagtaacatctggcaggcagtaagaggcctatattttctgacttcagaggcgtgggttaagaaccatcagcacacctgcatcttcattcttcactatgttgctcacatatacagccaggcaagggatttgcaaagaaagactcttctagctttgggaattcgccaggctccctaaaatatggagcacctattctatctttgtgtaatcttttcacttctgagctgaatatatcccaaggcactcttcctccatcgaattcatctatcaggttcacaaaattcatcctgtctggattaacagtctttctgaagttctcaaaacgacgatgtccttgtacagcttttgccgtttttccatcataagtgtaaataaagacatcactctgaagagccacgatgtaatcaagaccagcaagcatattctgatggtttttgaagggtgcaagttcctcttctgttgccagcgtagaatgagaataaatatggggaaaatcgtccttcagagcattcatgcttccattgccaaaagcttcaccagcaaccaagtaaattctggtgcttcgagtgaagcccagtcctttgagtaaaagtgaagtttcccttggcgtcaaaggacagccaccaaggcttcttctctcagtagcattgatttctttctctttccagtgactgacttcataccgcattttacgcagttcctcctcttcttctgatgtcaagttatggctgcaaccagtaaaagctagcatgtccttctcgtaccttagatggagagcaagatatgggcttcggtcctgacgcattcttgaaactagggtattaccaagatcttcaattgtatgagaatacttcaaagatctgtagttaactcggcatcttaatttctgaatgtaactaggaaggccattgttagcaaggcgagaatctgtatgtgtaaagtaaatgactttgtgtttcttcagaagggggaggatttcatctctgtaataatgcaccttcgaccaagataccggagctttagccaaaggttcaatgtcactgtattcagggggaagtgtttcaacaatatcaatgtcttctttcagtgactcaatgaagtgcctccagttgaaaaggtccttaaattcactgtcatctgcccagtaggatgtatgatcgagtcatctgcccagtaggatgtatgatcgagtgaaggaagaaccagagttgccttcaggatcttagcaacagcaaccatgtcacatatcccaaatctcatttgattcaaacctccatttgcatttatgagaatgtaaccattcgtatgagaatcttgctttttatgagagtttgaaacaatgcattggctgaaatttgtactgcttggctgagaccagatctcaggggcctcctgcccacaccgtcttctcttccaccgatgctagattccactgtcatcaaagtcctgtcactctcttttcctcccatgtatacga

SEQ ID NO: 24203 - DNA, 1598 bp, Zea mays
  misc_feature (5)..(5): n is a, c, g, or t
ctcgnaggccccccccgatgaacacgggcacacggatccggcccggacggcctcgtcacgcccaccctctccctcttcgggttccaggcttccaaagttgtcagagacggcgagagtagggggtttccaggaagcttcgccagggcgccggtaagttgactggatttgctgctaggcagtcaggcaagctcgagttttgccatttgagaaggagagggaaaatgatgacctcgtggcttctgggccgccggggcccctccggcttctcctggagttccaccgccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatggaattgagatgcagtttgcaactaatcatgttgggcatttcctgctcacacaccttctattggataccatgaagaggacctctcatgaatcaaatttggaaggaagaattgtcaacgtgtcatcagaggggcacagacttgcatatcgggaaggaatccgttttgacaagatcaacgatgaatcagtgtatagtagcattggtgcatatgggcaatcaaagcttgcaaacatattgcatgctaatgaacttgccaggcgatttgaggaagataatgtcaacataactgcaaattctcttcatcctggttccattatcacgaaccttcttcgctaccacagtatcctagatgttctccatcggacgctgggtaaattggtgctgaaaaatgctgagcagggtgcggcaactacatgctatttggcactccacccgcatgtgaagggcgtgtccgggaagtacttctgcgactgtaacctgtacgagccaagcgcgaacgccaaggacatggagttggccaagaggctctgggacttcggcgtcgagctcatcacctagctcatgcttcttgttgttagcgacttgttttcagacatggatgtaatgtaaatcccttgacagatggtaaattctgtaggccctcgaggagctcctgtgtggtaaactcattcacctcaatctatctacgtgtattaaggtggattagggggtaaattaaattaatttacactccaatcgccctcgaggagctccggtgtggataatgctttggttggatattttagtattcacctgaatttacgtgtattaagatgaattagggtgtaaattaaattaattacactccaatccatctcaatatatatggattaggtcgaatactagagtattgtaatacttcaaaatcctattttggataaattagtaaaacgtctttcatgattttaataaaaaaaaaaaaaaagaaaaaaaaaaaaaaaaaaa

SEQ ID NO: 24204 - DNA, 1816 bp, Zea mays
caatccctgcttactaatgcttgtcatctgtgctaggttgattggctttttggtaggcaaagcaaatcgatgtgcctgtgctgtgcaacttaacagcccgctgtagagctacaaccccactccactagtgcttacgaaagtttgtgatctgatctgtgccaggttgactggctttgtggtaggcaaagcaaatctagatttcaccagcaataggcaaagttttatgtgtgctgtgctgcccgtatcacgaaccttcttcgctaccacagtatcctagatgttctccatcggacgctgggtaaattggtgttgaaaaatgctgagcagggtgcggcaactacatgctatttggcactccacccgcatgtgaagggcgtgtccgggaagtacttctgcgactgtaacctgtacgagccaagcgcgaacgccaaggacatggagttggccaagaggctctgggacttcggcgtcgagctcatcacctagctcatgcttcttgttgttagcgacttgttttcagacatggatgtaatgtaaatcccttgacagatggtaaattctgtaggccctcgaggagctcctgtgtggtaaactcattcacctcaatctatctacgtgtattaaggtggattagggtgtaaattaaattaatttacactccaatcgccctcgaggagctccggtgtggataatgctttggttggatattttagtattcacctgaatttacgtgtattaagatgaattagggtgtaaattaaattaattacactccaatccatctcaatatatatggattaggtcgaatactagagtattgtaatacttcaaaatcctattttggataaattagtaaaacgtatttcatgatttaaataaaaaaaaaaaaaaaaaaaaaaaaaccgaaaaaaaaaaaaagtgaacgcgcccttgtattaaacattttttcttccaaaaaagaatcaagttaaactatctcataatatagatattacataagaaattatatccttttaaataaatatgtgaatattataaatttattttattgtacttctaaaatgtggctatctgtttgaattattttctttaataattattattgtaaaacatcttacatgaaatattcctactaattttcatttgcttaaatggataaattaattaataaaaatgctttgcattcatgttgagtttttgtttattgcaatttatggttgaaatagaaaatttaactcatctctaaattggacttcaattttaaatttaaaataaaaaacaaaaattagaaatataagctaatataatggatcgatgtatgcttggttggtttgttcgtacacgacgtccattaggtaaagttgatacaaattagaataatgtaataagatatttaagaaaatattcctttcagctcgtgtgtaacatccaaaaaattaattttaaaatttaaataaaaatatattctaagatttatttaaattgaaggactaatatgattaatacaaattaacaacaatattatagaaataaaaaagataagttagagtttctaacagatatgatatgatggtaatagataagtaccagattagatatgtcatgtaacggatttgatttcgagtttgttagagttcctaagagataggataaaattgtatcagataagaactagattagatctgcatgtaacagatttggtttcgagtttgttagagttcctaatatataagatattgttataatagataaataccagattagatctatcatgtaaccacccacctcccaacgtatataaatccggccaccataa

SEQ ID NO: 24205 - DNA, 1233 bp, Zea mays
tttttttttttttttttttgacgaagaaaaccaaagttttggttgacattttatcgtcaagtgaaaaatctgcttacagtgaataatgtaattggcattatggtaggatcttagataatcacgaagatgactagagatcagggaaataatgaaattcacaattgtgtctgcttcatatttctatttatttgaggtcgccaacttttcctgtgcaatgcctactactctatctggtaactcactgtgtgatccttccatataccactctcaagatacttctcgtacaagctagcttcgccatcatagttcactgataaaacggctgtgctccgtgtcccatagggcccttggtcagtttgcacctcaatgaagatggagctcagaccatgctcccagttgggatcacaaccagtgtttggcagtctatctttgtcagcctttgtggtgtcagtcattagcctctcaactatatccttcacttcaacctcatcagcaccatgctccctaagaagctccctgaagtttttaccgaggagaattgccttctgccaagggctatctagccttgcattggacagcacatggagtcctggtgacacgagttgaattgttgcaggctgacccttaggccggtttgacacataaaccatgatatttgttgttagatcagctagtatgaggttgaagccattgtattcatcagcttcttctgccacttcagttgcaacttcgagtgggctcttgttgctctgcaggaatttgagaggcagatctcccctagtccgtgcaccgggcatggcatctggttcaagcacattggtcaggaaggcaagccttccatccttggtgcaccccatccatgttcctccaccaagcacatccctgccaccaaggatcttctttgagccttcaccccaccatcctactgcttttgtaggcctgctgtggaactcatctctgttgagaagcaggaggagttggtgcacagggtgagcctgccaaatccatgcagcaatgcacatggcttcaggtggtttctacccttctgtttggttgtaagtaactcgcttgttttgcagctatcttagctgattgttctgccttgcacacgcctttgtatttataaggagaaggttgggagggaggagagcaaaagcacaaggagcccacagagtgtttgcattattggctgcaaccaggtgctctgcagtctgtcattcttctgccagagtt

SEQ ID NO: 24206 - DNA, 3294 bp, Zea mays
aattcggcaccgggaaacctcagagaatccacctctcccccaccctctttctctctctctagatctacgcaagccgcctcggtatccgcgatcgccaccgcccgcggcggctgatgcgtccgtgctgctccgcggaggtggcgctgcgctgttagctggcgcgagagttcgtccggcccccgaccgagtgatgggggcggcggggggcggccggtgcgtccgcctcggggcggcgccggtcctcgtcctgctgctgatcgccgctgccacattgccgcggctggcgcgcgcggtcaccgacgccggcgacgtttctgctataaatggactttatgtttcacttggatcaccaaagctgccaggatggtctgctagtgctggagatccctgtggtgagagctggcagggtgtcacatgtaccggctcaagtataacctcaatagttttcaatgctgcaaatctgggaggacagctaggcagcctggggaacttcacttcaataactgaaataaatcttagcaacaacaatatcggtggaaccataccagaagatctacctgtcacactgcagaatctgtttctctcagataaccaactaactggaagcattccaatgtcattatcagaactccatagtctaacagccatgtcactgaatgataaccatctagatggaaagctaccagatgcatttgattccctcacgggacttgtaaatctggatatttcttccaacaacttcagtggtccattaccaccttcattgggaagcttgacatcactgactacattgcacatgcaagataatcaactatctggtacccttaatgtcttgcaggatctccccctcaaagacttaaatgtagagaataatatgttttctggaccagttcctccgaagctgctgaacataccaaacttcaaaaatgatgggaatccttttaataccagcatagctccctctacctcaccctcttcaacacctacaggctctagaccaacacaaacaccatcgtcttcttcatccccttcaggatctccgccaccatctagtgcagcatcaaactcttctagtggatctactgctcgaaatagcaactctccatcatccaagaagaacaagtcttcacccctcagaactgttggatatgttcttcttgctattgtactattcatagttctagtgctgttggtaatcttttgcctgtccaagtatcaagaaagacagtctagacgtgattattccacgtctcaattaggtagggtgcaccagagggttgaggagccaaaaagcaagcaagcttcggtgcagtctaaacatgaagccaaaaaaggttcatctgaggttcctgaaagaaagaagccccgagaaataaatttagctgtaccagttgccattgagaagcctcctgaaaagagacaagagcgtgtaattaatttggaacgaacagaatcagagatctttgctgcagcaccacctccacctccccgcccccaccaccaccgcccccaacaccgccaccgccacctccgcctccacgactgccatcaccacctcctgttgaaaaagtaactgtaaatcccattgtacttccagaaaaaagagttagcaccccgccaaggactggtccctcgacatctgcaacatccttttcggtggcatcacttcagcaatatacaaatagttttcaagagcaaaatttgataagggagagtagattggggaaagtgtatttggcagaacttcctgaaggcaaattactggaagttatgaagattgataatgctaatggaagaataccagtagatgactttctagagttggttgctcgtatatcagatattagacaccctaacattcttgaattagttggatattgtgctgaatatgaacagcggttactcgtgtataactacttcagtagaaaaacattacatgatgtactacatgaaggggaggatctagatgaaccattatcctggaatgctcgcctccacattgttcttcatgcagcaaaagccttagagtatctccatgacacctgtgaacctcctgtagtacaccagaattttgaaccagccaacgtgctcctcgacaatagatgctcagtgcgtgttgctgaatgtgggctggcacaattgatggcgtctggttctgttacacagctatcaggccgtatgagagctctactcaattatgaagcacctgaaatccatgaatctgagccttttactcgtcaaagcgacgtatatagtttgggtgtggtgatgctagaacttcttactggtcgtaagccatatgacagttctcgtccacgtgatgaacaacatcttgttcgatgggctaattctcagcttcatgacatggagtccctgtcaaagatggttgatccttctatccgaggagagtgttctgtgatactgttgtcacgttttgcagacatcatcagtcagtgtattcagccgggaccagaattcaggccagcaatgtctcaaatcgtccaagacctagctaggattgtaggtgctagtggtgcggtatcagagtgacagataaagggggaacagtaaacatctagcttgactgtatgcacttgtggagacgccagaacgtttgtttcctttatctaaaaaaaaggtaaaacatctagcctcagtcgtgtggccagtgaagattcatacatcctcagcgcagtgccaggggcactctcagtatttatattggacgatatcgcggctagtgtacatgccattttggagccccatttgcttctgaaagatgtagtggtactgtggtagtatggcacaaccagtgactcagtgagatatggcttctcattgttgctagcagatattcctgagctcctctagatatgataatttcacctgcaggcagtatctcttgtaactaattccaattttttatcactttattactacattacagcaagttatgtcaaccatggtgcttttagcatgtcttgagacctatgtttctcctgggaaaagaactggcttgctgattctttgcagaggcaaagcaacctttttctgacctgtacatgaagattctcctccttgaagcgaaagcacctctgctaggtatgcgtggtgtgcttggttccttacttttcttcgtgtgatttcttcaagatgtagaataagttatgacagtgttcaactatgctgattggggattagatgaacttttgtattgatccgttcttaactgatgaaaagaacggccaaaagaaaaaaaaaagacccccaaaaaaaagaaagggcgcccgccga

SEQ ID NO: 24207 - DNA, 1749 bp, Zea mays
gaaaagagcatgtaattaatttggagcgaacagaatcagagatctttgctgtagcgcctcctccacctccacctccgccctcaacaccgccacctccatctccacctccacgattgccatcaccacctcctgctgaaaaagtaactgtaaatcccattgtacgtccagtaaaaagagttaacactccgccaaggactggtccctcgacatctgcaacatccttttccgtggcatcacttcagcaatatacaaatagttttcaagagcaaaatttgataagggagagtagattgggaaaagtttatctggcagaacttcctgaagggaaattactggaagttatgaagattgataatgctaatgggagaataccagtagatgactttctagagttggttgcttgtatatcagatattagacaccctaacattcttgaattagttggatactgtgctgagtatgaacagaggttacttgtgtataaccacttcagtagaaaaacattacttgatgtactacatgaaggggaggatattgataatccattatcctggaatgctcgcctccagattgctcttcatgcagcaaaagccttagagtatctccatgacacctgtgaacctcctctagtacaccagaattttgatccagccaacgtgcttctcgataatagatgttcagtacgtgttgctgaatgtgggctagcagaattgatggcgtctggttctgttacacagctatcaggtcgtatgcgggctctactcaattatgtagcacctgaaatccatgaatctgagccttttactcagcgcagcgacgtatatagtttcggtgtggtgatgctagaacttcttactggtcgtaagccatatgacagctctcgtccacgtgctgaacaacatcttgttagatgggctgattctcagcttcatgacatgaagtccctgtcagagatggttgatccatctatccgaggagagtgttcagtgatactattgtcatgttttgcagacatcatcagtcggtgtattcagccgggaccagaattcaggccagcaatgtctcaaatcgtccaagacctagctaggattgtaggtgctagtagtgaggtatcagagtgacaaataaaggaggaacagtaaaacatctagcttgccagtggcgtggccagcgaagatccctagatccatagcgcagtgccaggggcactctatctatcagcatttatattggacgagattgcggctagtgtacatgccattttggagcctcatttacttctggaaaggtgtagactggtagtatggcacaaccagtgagatatggcttctcattgttgccgagcagattcatgtgctcctctagacatgataatttcacctgtaggcattatttcttgtaactaattctaatttttattactttattacattatggctagctatgttaaatatgatgcctttaccctgtcttgagactcatgtgccgccggttgctaactccgtatggtttgttaatcatagaagtctactgttattgagattattttcagaggcaaaacgacattccaacttgacatggacatgatcatcatagtgacctggtgtcttctgccgaccacatgaaggttctcctccttgaagcggaagcacccctgctagagcaagagcatatcacgaaactgcgagagtttgccctgcttcctatcttgttgggggaaatggttggcgatgttatcttgccttcagg

SEQ ID NO: 24208 - DNA, 2366 bp, Zea mays
  misc_feature (5)..(9): n is a, c, g, or t
ggggnnnnntttttttttttttttttggttgaaacgaacaagctccgaaacagatagttcatgccaacgttattctacccgttcctaactggagtcatatactgtgatgcacctccggaagaataatctcagccggctgccttttccgcctaagaaaaattcaactaccaatgtcacttgacagcatacagttatacacaatccacattttcattatcttagctctaatctgggtgaagacaatctactcatctttcaacagtacatctcatttcaagtaacagcatgaaatgtcagagacgctctatcgtttccttgatcgcctgggagcggcctcctcttcgctctcgctgtcatcgtcccgaagggcgcttctaccgtacctgtctccagactgggctctggctccatctgctccagggtttccagtgttatcatggcccctgctgccctggtctaatgctgatgctgtttcaaacctgtcccctcggtcaccccctggccttctctgctcccgcttcgcagcacggttatttggaggtggcgggggcatgaagggcgccatacccatgggacgattaggccgtccaggcccacccattcccatgcctcccatcagcggaccacggccaggacccatcatcatgtcaagacccagagggaaaggctgcggaggtctgccagggaaacccatccctggcatcgggcctctagcaaagtcaccagggaaccttgggccaacgaatggtgggaagccgcgtggcatgccaaatggatcaggcatgccgaaaccgccgccaaaaccaaagccatcacccatcatgttgggagggaagccacgccctgccaacattgccccacgcatcatcggcatttgaggcggccacatcatcccccttcctcttccccttccctgagactcttgggcgttgccttcttcctcctcgctttcctcttcctcgtcctcttcattgtcatcaaacagcacaatatcttgattatcagctgcctcatcagcactcactccctttgctttttcctcctctcgcttggcctctgctgcaattagcatagccgtgagttcactgtctggctccagataaagcagagaagccaactgctcaccaacgaaaggttctagttcctggcaatctctgctgatcttaacagggaggttatcattgtatggatttcggagatgatgggttttctgaaatgacaactcacaaagcttaagccactgcatagagaagttccgaccaaaatgcgctgttccatgagcagatttccaatttccaccaccaatgtagccaccaatcctagaagtcatctttgcacacccctggaaattgcgagttctattaattgagaatatcaaaataacattctcagtggattcaaaagcttcattgagtttagcctcattactcctctgtgtggcccaaattccttgttgaactgatatttccagattctcccgattgcaacttttaacaatgaaatacctagatggtccttgtggaaggggtgtggcgattctagtggcctgatggccatttgaaacaccttgggcctggtcatttgtatttggcttctgctgctgctgtggtggctgttgattcagcgtttgtgcttgttgtccaccagctggtggagctgcagcagtagcattttctgctgagttttggttaggcaacgcagaaccctgtggatgttgtggcctctccccttgctgattataattactatttctattctgactgtatctgttaaaagagcgcatctgcaaaatcttctgaagaacttcctcaacagaaggcggtggcccaggtagcttgatatgcttgtaccggcaattaggaccattgggacaaaaccccatcttgtacatgttgcactccttgacgtcgtcgtacgagtgcttgtacgcgcagtcgggctcgcggcactcgccgaagtcgcggaagaaacggcagacgggcatgcgggccttgtcgaactggtgcaggaacccgcacgcctcgcccttcatgcataggccccgaagccagtggcggcacaccgtctggcggtagctcccgcgacctcggccgcgcccgtgcatacccggcccgtcgccgcctcccgcgccagggtcagtggaggacggcacggggcccccggccgccggggcagagtcgaggccgccctcgaagtcgaagctcagtccgccgtcgccgtcgtccatgagagatgctagggtttgggatcctttttttttccttcgatcgtatacaactggggagcagaacagttcttgggctggttgcttgagatccagactccccacccacgcgtccgcatcggcaatctcatccctcaagttg

SEQ ID NO: 24209 - DNA, 856 bp, Zea mays
ttttttttttttttttctttttttttttcatcaatttattcgcattaattaactgctgagacaggtacacagtaagtgaatggacaatcatgtaaaatcagcaaggcgaataacgacacaaatatctccattacatcactgagatatctaattatctatggcttgttgctagcagaacatgtcatgaaacatacatgggcagttttgaaagttttgatgatcctccgtaatgacagtagcagacggagcaatgaacaactgttgttctttgctcatttgcaaagcttgagcttcttgaagaaagaagaaacctgcgactttgggcagggtgctgtagctatgcatgttgggatgttctcaggctgctctatccacagcttgtaccggacaccagctgctgccagcttctcagccaggttattcagctgtgtctctcctttcacctccagtgttaccttgtgcattcggtcgaggttgtcgggcgcgcagtaggcggcggtgtccgggtggtcccggtgcgcccacacggcggccacggcggcgtggcagccctgcgccacgacgctccccagcggccacgcgtccgccagatcgcgccgcaggaccacgtactggaccagcacgtccacggcctccttcgcgccctcctcgccagtggcggccgcagcagcgtccggagcggaggaggcggcggcagcgttcatgctggctccctgcgtgatctggcggagggagaccctggtgcttgccgggaggagcaaggcggcgttcgggagtgtggcggctacaggtagcgagaatggcaagcgaaggggcaggagtgtcagcatacctgtggctgtgactgaacttgggt

SEQ ID NO: 24210 - DNA, 818 bp, Zea mays
tcgggcattgggtacctcccggccgggccggagagcacccagcaggccagggccagccggccaaaacacagaaaagctaaacccgacctccgctcgccggcgcccggcaggatggcttcgtcggcggcgtaccctgatgcggacgagaacctggaggccatcatcacccgcatagagcagaagtcccgaaagatcgagacccttctcaagcagtcgaagccggtggaggccctaaagacggcgctcgaggggtcaccgctcaagacccgcgacgagcgatgcaagtcggcgaactggatcgtggtgcaccgcgcgttgatggcgattagggacgtagacggcatgttcaactccctggatcccgagtactacgacatcctcatgaagtacctttatagaggtttatctacaggggataggccaacatgtgaccagtgcctcaaaattcatgaaaaactgactgagaaggcaggcctaggctgtatattgcgatcccttgctgatactgtaaacactgtatgaactttgtctctgctgctgatggtggatattgcaaagttctctcctgctctttacaatcacatcaggcaaactacctgtagttgttaactagttttgcattgtgtctttctttgccattaggcaattttagttagcgtatcattgtaccttactagaatggccgaacaaaatgtgtattatgttgattttcaagtctttgtattaagggtgacaccggactctaaattttactctataaaatttaaggatgggattatgggctctaaaagacaaaaaaaataaaaaaaaaaaaaaaa

SEQ ID NO: 24211 - DNA, 2766 bp, Zea mays
  misc_feature (20)..(20): n is a, c, g, or t
  misc_feature (22)..(22): n is a, c, g, or t
  misc_feature (24)..(24): n is a, c, g, or t
  misc_feature (26)..(26): n is a, c, g, or t
  misc_feature (2568)..(2568): n is a, c, g, or t
tatagatagatatatatatntntntntgtatatatatatatatatatatatatatatatatatatatatatatatatataggactcccccccccagtttttttttttttttttttgacaaaagagaagagaaaaaagattgggaaatcgaatactagagtacagtggacatattagtgggctgggccgggggtgactcgctgcagtgcaggtccagtccaactgatgttaggtggtagtagtgactagtgagtgagtgaagggaagtgaaggctggatgatcagtgtgtcctgcctttttgctcctgcggcagcaatcccgggatgaacggcaccccgaacttggggatgaactgctgcccctggatgaaggtctctacggtgaactccttctgtgcctcctcgtaggtgacggtcttgatgcctccccacttggcgcgcttgctcatgtcggcgccgtcgccgcggttgtccacctccgcgtagaagagtgtctcgaggccgaagtcgccgttccactcgagccagcccttggggtcgatgaagccgccaatgtcgttctggatgtagatcgtccgggagtactccttccagggccgcgccaggtacgtgcggatcttcccgccggcttcctccttgaagtccgggtggggctcgatggtgcagttgtgcagcacggtgccgcccacggagcgcttgtcccgccgcccctgcgccgtgatgatgttggcctggttcgccatgggcttccggggctggatcaggcagttctgcagcaccacctgggagttgccgaagatgaagtcgatggtgccggtcacccggcagtcgcggaagaactgccgctgcgcgtgcgtgtacagcgtgtcctggtagccgtcgaaggtgcactggtagaacacggccaggtcgctctgcacacgcagcgccacggcctggtggttctcgggccccgccgtgttctccacccggatgtcccgcatgaagaagccgttgccgatcgcctgcatggtggccgtgtccttggtggtcaggttcatcttgaagttcttgttccccgtgatgatggtcttctcggcgccgtcgccgatgaaggccacgttcgtctggggacggcccacggtgacgtactccttgtacgtgccggccttcacgtacaccacgtataggtccgcgttcttgacaggcaccttctccagcgcctccatgatcgtcttgacgtcgccgctgccgtccgccgccaccgtgacgttgggcttgaagtccggggagcccgcggggctgtcggcggccaggagccgctgcctggcggggtcggctggctccgacacccagctgggcgtgagcagcaggcggcggccgatgctgagccctcccagcgtgtcggagaactggtccaccaccgccaggatgtcctccgtcagctcctgcgacgcgttgagcgccttctgcatcttggcggaggcctcggtggtggtggcgttcgcgaagccgtccagggcaggtgtcctggtacgtgagcgcggcgctgagccacgtcttgaggtcgtccacggccttgttgaagttggtcatctcgaagccgcccagcttgtcgaaggacgacttgagctcgtcgatggcgtaccccagcatctccttgcagtcgtggagcgcgcccgacgtgcgcgggtcgttcttgagctcttccagcgtcgccgactcgctgatggccttgtggatcttgtcggaggtgaccttgaagatgaccttggccaggtccgacggcgagctggcgttgcccgccgccttggacagctccgcctcgcacgtctccttgtagtccgcgggctggcagaaggccttcaccgacttcaccgacatggacaggttctcgtcgccatcgcccttgccggagttgcccttgaaggacaccacgcacacggccgcgaccaccgccaccacaaggacggtcgacgcgccgatgatagcacctttgctcattactaatttgattggattgggtggatggatggaaagaagaaatggaatgaaatcaaaccgaaactagctagaggtggtgcatgtgtacgcgcgtacgtggatcgatctatcgaccggccgatgcatgcatggacctggaccgagagtggcggccggagggatagccgcgacctcttatagctagcctagccagcgtgtcgtcgtctagcgaagacgttggccggccgttggttggttgcatgcatgcgatacgcccaccgcacactcgtgtgagactgaacggtgggacctaagaggagacgacgaccggaccgaccattgcggcgaggggagcgcacagccccacccccacgacacgacacaattgacggcggtcctgtcctgtccttgtcaacccacgccatcgtttcgtttcaccagctggacaacaacgtacaagctgtccaagtatggtcaacatggttcaggcgcaggcgttctggatgcaacaaagccgtgccattccatggtgatctgatggtttctgaagaagatggcctctgctctgagccgcgtctcaactctgcagctcattgccgatctcaantatactctgcaactgcgtactacaacgacaacaatatcctgatgaatcaactatactctgcaactaacaacattgaatagatcaaaactcaagagcaaaaaccaactactacagtaactgtgttacgatggtacacaatgcgacacgaagatcagataaaccagtatggttgaacctccctaaaaaataaatttaata

SEQ ID NO: 24212 - DNA, 4319 bp, Zea mays
  misc_feature (15)..(15): n is a, c, g, or t
  misc_feature (37)..(37): n is a, c, g, or t
  misc_feature (41)..(41): n is a, c, g, or t
  misc_feature (111)..(111): n is a, c, g, or t
ccaagacaaaatcanctatatcccatgctgaatacancacnttcctagaacaacccacactgaaaaaatagtggggggctgggcagtattcatctggtagttgccgtagcntacatggttgcatccaaaatgtagggccacctgcatcaaatcatttgcacggccaaggaagccgatagtcggctgaaaagatgaacaaaaaaatagacactgcgccaaacaaatattgcgggagaaatactaaacaaactgaactgataaacggaagagagaaaagagcgccatcaccacaggaactaaggcacctacggagtgtgtacatgtctgcgtgtttgttaggctgctgaatgagcttcagctgtagctggagcagcttccttttctttctctagtgatacagctgctgagagccaatctgaagctggggcttggatttcaggctccacttgcccatgaacattcagaggggtgaccgatacaaatccattctccaaagctctcaaatcggtatcctcatctaaaccttgatgttgcctctcgacaaactcagcacggaataacttcttcactacttctcgagtctcttgtttaccagcagttgcaacagactcaacctcgaccgcctttcgttgaccactaactctacgtgcagctgctgctgcagatgcatccttcccaagctgcgccagctgaataccaaggctttggtgcatgcccatgaagtgagtagcagatgagggcctgcttgctgacacagcttgccaactttgagcaggactatatccactctgtttggtcaacttgaaacccttaattgcagatggtgcacttggaactccaatattcaataggcatcctctgaggaaagttcctttctcaatgtcatccaaggcagcatttatcaatggtaagcatgcctgagctgcatccttgaagtcgctgtctttggtttcatccttcttccaattcaatgagattgcaattgaaggcaccccatacactaaggcctcccttgcagcagcaatggcagaagagtgaaacatctcatacccacagtttggtcctgtgttgataccgctgatcaccaaagcaggagacgaccaaggaaacaacctcccagataaggccaacgagacacagtcaaccggcgtgcctgatatctcaaaagctttagcacctgtgaaatccaccgatgtcgcagtgatggtttcacggatggtaattgagtagccacaggctggcttgtccgattcgggagcacacacgtggacgtcgcagcgggcgccggtaacgagggcgtcgacgagcgccgcaagacccgcggaccggatccccccggcacaggtcagcagcacgatgggcctcgccggcgccccatctccagagggggcatcctcgggagccgaggcttcagcctcgccggctgcggcggcggtgctgacctcggccgcggccgggcggcgggcggcaagcacagactcgaggttggagacgagcgcggacgggagcgggttgcgcttcggagcgtcttcgccggaagtcgactccatcggcctcgtccccggagaggttatttgccgcctcgcgtcgtcagggatggctgggcagaagaggcgaagagggcaggagagagggagagagagagggatgtacggagggaggaaggaaggaagcgccggtgttgacggggacgattggacgaaggtgggaatggactgaaatagcctcgtgggctggccccgcgttctttttaagcctcgttcgtttgtcccggatccatccaggaaccaatccaattgaccaaaacctatataaattaggcaaacaaatcagctaggaactattccaggtgatggttccgtaagaaccgaacgggcccttatggatttcaaggccggaccgccggacccgcttcgtttggttatggttggattaagatgaaattaaatttgtattccaattccaatctatcttaatgtatgtgaattgaggtgaataacacccaaatatatgtgaattgaggttgtatgtagggtgagtatcattttctgcctgcacagatttggggaatatgcggttgtgtcgtcatttgatgattagtcgttcatttggaacttgatgaaacctaaaccactgtcaccgaaggtatcctatgatttggggaattgcagtgtttgaaacagagtaaagaagtagaggtcgcggcacttcacagttgggataaaatgcgtcttacgagatgtgaaatccacgctcgaaatgctttggaaaaacaataaataaataaataaatacatatgtaggttgtttgtgggcatgcacattagtcctgagaccaaattcaacttgcatttacaaacatgtccccgttccagcatttacgacacgacgtttggttcgtcggcaagctagacggcaacgctgacgcagcatccgaaaataaaatatatacattcgtgtactcgttcgtcaaaataattaaagtataggatgctatatcgtttggtacgcccgatggcagaataatggagagtactactggtacgtacgtgggggcgcacgcatgtactgtatgtaccgatcggttgtatctgcgcccggatcgcataataaaattgggatccgaaggccagcgacgacggtggtggcgccggccggccgccgggccagggcatcgccatgtgatgactgatgagcatgagcccccttctgggcgagccagcatgcagcagcaccgcgcgacagctagctagcggccggggccgttgagtaggagtcgatctgtctgacgtcggcacgtcgccgctgtctgacgtcggatacagtaccggccgcgcgcgatggatagtctccgccaggaattgaaggcgggcagccggcgcggcgcgggcgctagaggcacaaccgaagccgatcgatcgcgttgacgcgttcgcgtcgggcgcgccgttggctcgttccaatgccgcccgagccgccgccgccgcatgcaggaccaggcatgcacggtcggcggcttttggggcacgggcctaatccactcgccacgcgcggtctgctgatttctacgatacaggtgccatgcacgcatgacgcgtcaaaaggtgccaagttaacgcgcgcgtaaaaagagcgagccgattcacagttaccgcacacatgcatgcatgctgaatggatgagatttgacgaaactttacagtataccgttcaaacgtcccactgggatgggaacacgaacatgggaccatcttgctctcttttgctttcagtcctgtcctcgtgttctcttttacttcgtcaccccctcgagctgctgctggtggcctggtgccgcacgttcaataatgaggcttggccagcattatcatgtctgtactgcagcctgtactcctcgcgttgtacagctgggagttaacactcccggagcattacgaagatttctgcacagttatcgcatgtaccgtaacgtacgaaatttcatcggtttatcttttttttccacaggccagagaacacaccagctgttaaagtgttaaccccggccacgggtgccttgtttggagctagctaggccgaccggtgcaactatagccaattaaacagtggaacctagctgggctacggatccgagacatggcgcatgcacacgtcacatccacccttgaaagcagccaacgccgagacctgatcgacctacaggctgcagggggcagcgccgcgtgccggtgccggtgccggtgtcgtacgcacgtcgtcggaagttattgcttgaggaaaaacgaacgcgcggcgccgacatggctagggcggcggcgatggtggtggtcgccgtacgtggtggcgctggctgcagtgccgcgcgcgggaggccgggcagcagaactgcatctgcgagctagctagtgcatgaatgtcagcaacctggcgggagcagacgaagcacagaaggaggatgcccagtctggcgccatagcggaaaggcggcccagacgcagcaaacgtcttccaaagcccaacgccaaatactacggcccataatgggataattgaacccatttgtaatagattcatatataaacccttgtccgattcggtgaacagtaggctgtacgaatacggcgaactggcggcggccgcgatccctgatcgtcggtctgagataacgagtgaattaactcgtcgtgagagaaactaccttgtgtgatcgcgtgtgtttacatttggtattcagagctagagctggatccaccacacgagcactggacacggctccaagcgaagacgacggagatggctccaccgcgccccgacgaccc

SEQ ID NO: 24213 - DNA, 1817 bp, Zea mays
ttttttttaagattccaattcctacggggccgtttttttcttttcctgtaaagtgaagggatccatacggccacatttggttgccatggttcagacgggagcaagacaaaatcaatcacataccccatgctgaatacaacaccttcctataacaaaccacactgaaaaaaatagtgggggctgggcagtattcatctggtagttgccgtagcctacatcgttacatccaaaatgcagggctgcctgcaccaaatcatttgtagggccaaggaagccggtaatcggcagagaaggtgaacaaaaaaaatagacattgcaacaaacaaatattgagggcaaaacactagacaaaccaaactgacaagaggtaataaaagatcgacatcaccacaggaactaaagacacctacggagtgtggacatgtctgcgtgtttgttaggctgctgagggagcttccttttcctcagctgcaacatcttgttggtcagctgtagctgaagcagctaccttttctttgtctagtgatacagctgctgagagccaatcagaagctgtggctccgatttcaagctccacttgtccatgaacattcagaggggtgacagatataaatccattctccaaagctctcaaatcgatatcctcatctaaaccttcatatcgcttctcgacaaactcagcacggaataacttcttcactacttctcgaatctcttgtttaccagcagctgcaacagactcaacctcgactgcctttcgttgggcactaactctacgtgcagctcctgctgcagatgcatccttcccaagctgtgccaactgaataccgaggctttgatgcatgcccatgaagtgagtagcagataagggcctgcttgttgacacagcttcccaactttgagcaggactgtatccactctgtttggtcaacttgaaacccttatttgcagatggtgcacttggaactccaatattcaataggcaacctctgaggaaagttcctttctcaatgtcatccaaagcagcatttatcaatggtaaacaggcctgagctgcatccttgaagtcactgtctttggtttcgtccttcttccaattcaatgagattgcaattgaaggcaccccatacactaaggcctccctcgcagcagcaatggcagaagagtggaacatctcatatccacaatttgatcccgtgttgataccactgatcaccaaagcaggagacgaccaaggaaacagcctcccagataaggccaacgagacacagtcaaccggcgtgcctgatgtctcaaaagctttagcgcctgtgaaatccacggatgacgcagcgatggtttcacggatggtaattgaatggccacaggcttgcttgtccgattcgggggcacacacgtggacgtcgcagcggccggcggcaacgagggcgtcgacgagcgccgcgagacccgccgaccggatccccccggcacaggtcagcagcacgatgggcctcgccggcgtcccatctcccgcgggggcatcggacgcctccgcttcctgagcctcagcctcagcctcgctagctgtggcggcggtgctgacctctgccgcggacgggcggcgggcggcgagcacggactgtaggttggagacgagcgcggacgggagcgggttgcgcttcggagcatcctcgccggaggtcgactccatctgtctcgccgccggagaggttatttgccgcttgtcggggatggcgtggggaagagagagatgtaccaacgaagcggcggggccgagttttcgattaggatgttctaggtaatggtctcgtgcg

SEQ ID NO: 24214 - DNA, 1788 bp, Zea mays
gtctacaattcaaattggtgcaccgcaggcaacaaggtacggtaaaggcgagattgatctccgtgtccatcatcgtctcctgtttgtatagtgaagtttaaaataaggagtaagataaatagtccgctcgagatagttttagagccggccaaccttggtaccaagaggaaagaagctcacccttgcacggacatctgtcttagaccggtttgctttacataggagtggtggtggtgagcgccctatttccagggaacaggagggtctccgtcttttttttttcctttattcaccggcaacacgtagaaacaggaggagaccctcctccccctctccggcgcgcgacgctcgccgccgcgcctcccctcccctcctccgaacgacgtggctgccgtgcgcccgaccggccggtgacggacacggcagctgctacgagaggaggaggatatatactagtatatagctagagcaattattagctggtcgtaagcatgaatcgacgattggacatgatagacaacatcgacggccgtcgggtaaccaagaacaaggcgcgcatccaagttggcgactcctcttcgtcggacgaaagcgacagggagaaggaggaagatgaagaagaagcacatgaggaagtggccaaggcgcccccgctgggttggaatcatcacaatcaccacgaagcggccggcggcattggcagcaacagcaacaggaggcggcttctgtcgaagcagctgtccatgaaggagaccaccagggagatcaaatgggagaagcgccggcggcagatactgcggcgcagcagcctggtggtgtcgttaaacgacgacggaggaggaggatgctgcggcagcatgaagagcgccgccgaggaaccggaacggcactgtcatcatcacgttacgaggtcttcgtcggagcgcgtaatgaggtgcctgaccgacgaggacctggacgagctgcggggctccttcgagctcgggttcgggttcgacgaggagtccggcggcgcccacctccgcgacacgctccccgccctcgacttctacttcgccgtgaaccgtcagctgtccgaccccgccaagctgcggacgctgtcgtcggcggcgagcctcacgtccacgccgtcggccgtgtcctcgtcgtccacgctccccgacgtcccgaacgacccacgcagccccaacgtcggcgcaaccgccgcgtctggcggcggcgccgacgcatggaagatttttacgccaggtatatactgtacacacgtacgtaacgtacgtacgtactcggattctgacggacacgcatctcttgcttgccgctgcaggtgacaaccctcagcttgtgaagacgaggctgaggcactgggcgcaggtggtggcttgctccatcaagcacggctgataagacgacgcgcggacggacgatgtcctgtgtagtcgagagcaatatgttatataggtgggtggccaaattaaaatgtgaaactcttgatgaatgaattaataaccagcaaccaccaagaatgatcgatgtctaaacacgcgtggtcgccgttgtcgtctgtcattcctcgtgtacagaagaagcttagtgcctaacacatgaattaacggtacactgaatctatcacatgtctcgcctatatatgttcctgttggccgtccatcgacttggacattttggaacccacaaaccacacagagcaatactgaaaaaaatgtgggtttacagagatgacatggcgtccaatatatttgcagatgccgaaatgttcagatcgtgcgc

SEQ ID NO: 24215 - DNA, 1915 bp, Zea mays
  misc_feature (1181)..(1182): n is a, c, g, or t
tacggcatctttgagtcgcacttctaaaaaaaaacccggaaggattgaatgacatacacgagtgcctgcattactcgaaatttggttgaccacgtttgaaaatttgtaactcagtttttgctagtttgtactaaatcaaacctatattaagtttctaccaaatctgaagggaaatttgtccaggggtctgttttttttctttttcctcttcttacttagcatagggatgaacaatatagctagaaatatatcagaaagcacggggagcaatctctagtatcccatcatcagttggcaatctcaagaagcccgaatataccagaaactctcagcaatttaatcccagaaactcttagaaatttaacagtgctttctagatttgttctggatgccaatggcctcagtggagataataccttggagtctaagcaactgtcctcttcaaaacttgaacctttcacgcaatagactcactggtccaatacccaaagagcttttttttagcatctacattatctggtttcctgctcttgggctgaagcaaaaacttggcagaaatccgggagacaggacctgaagcaagagcttggcgtccatgtcatgtatgttgacggctcaaactcaacaagaaaggtcatgtattattgtacgtcactggattgatcagccaggttgagcaaattcatccaaaacctcttctctggcctgcaggctcctgccagcacgtccttcagcctccccatggaggcaaaatgcaacctctcttccagcttccccttcacatccgggacttgctttgttatccacataatgtagagcgctgaaagctctgcttggacacgcgactcctcaaactcatccacaggatcatgcaggcactctgacagcagttgtatctcctggatgacaaacatatccatctgggatgtcgttgcgggccagtttccttcaacagtgagcaagtgttgtatccacaagtgtgaaaggaaccgacggtggttccataacgactgcagcaatacatcaccacagctagtataaacaaaacacacacccgccaacaagaactacaagtggaagaacaacaacaggctaattttcaaacctctctcccctggtagcgtttgatcagcatctcatcccacctaagctcctccttcgtgccgtatgcaagcagcccnnaatatctgactcccaactaagggaatcctcttcattcccaaagaagttgtctagtagcgcaagcagcaaagatcttcgatagtggaagcagcagttgtcagcaacatgtagctcactccatcttgttgactcattcagttcatccagcacttgtttccttgtcatgtaaggaataagccaacatcgatgcctccatgcacgatagttcattttcgatttctctgctatctctttgaccagtatggattcattccctataagctccaacatatcttgatgttgctcagcaacttgttttatcacccatctcctatggctccatgtgctctcgttctttggagagtaggaaaggatcaaggctcacaattgcagttcatgccttgagctttgtgaaatcatacaacgctgatagcaccattttcctggagttccatgcagtgagtaggtcaggacaaagtatgagcagtgccttggtgtgcctcatgagattagtgcgcgatagtggggcatcccttgcgttgtagtaggcatcccgagcagcatggtaaagctcggggaggatctcggcggagatggcaagcttgtggtctctgcaccagaagtatcttgcgcaatggaactatgagtgggtcatcgtggaggatttgctcaaagtagaggaggagattttcggggagcttttcctctcccccttgctgttgttccactgctgattcttgctgttgtaatttca

SEQ ID NO: 24216 - DNA, 2427 bp, Zea mays
gaaaaaaaatggcgagaccgcaacggcgcaacgggcttctcccgttctccgtcggtcgcggtcttttcccgtccgccccgcctccagctcccgtctcccaccccaacccggatctcgcgcgcgacgccgcgcaggcgaaccccacctcctctcagaagcatctagaagttcctcacctcgctcccgcgcggatgagtggcagctcgggccccctcccctactcgatgcgcgatgtgggtgctggcggcgcctacaacaacgccaagttccgccaccggtctcgcctcaagatggttctacagttcttggctactaacagaagcaaataccattgtggaaagttcactgttggtaaattcttgagcctgttgatggtttctggcttattgtacttatttatgcacaaaggctcagagggtattgtatccagtgagcttcatggcaaagaagtacagaataaaaatgttaggagatctcccagtatacgcacattctggagaaaaccaccaaggctgcccccacgcctccctccaaatgaaatctacaaaaataattctctgcttcagcagtctccatctgagtggacatcgaggcagaagaaagttaaagaagcatttgaacatgcatggtctggttatcaaaagtatgcaatgggttacgatgagcttatgcctctgagccacagaggcacagatgggttaggtggtctaggagctactattgtggattctttggatactgcgataataatgggtgctgatgatgttgtttctgaagcatcaaaatggattgaagacaacctaatgaaaagaattagtgagaaagggcaggttaacttatttgagactaccatccgtgtcttgggagggcttcttagtgcataccatttgagcggtggtgatcatccaggggcaggtgactccggagtaactgtaacatataaaaaggctaatccagagcgacttttggaagtttcaaaggatttagccgacaggttattattggcttttacatcaagcccaacagctatacctttaagtgatgttattcttcgtgaccatactgcacatgcagcgcctgatggcttaagcagcacttcagaggcttcaacgttgcaactagagttcagttacctcagtaaagtattaggggatcctaagtacgacagggcggcaatgaaggtgttagagcatatacatacactcccaaaggtggagggtctggtgcctatttacatcaacccctcctctggtcaatttagtggtgagaatattcgattaggatctcgaggggacagttattatgagtatctgctaaaagtgtgggttcagcaggaggaatatcgtcacagtagtttaaagtatctatttgaaatgtatactgaggcaatgagaggggtcaagcatcttcttgttcggaaaactgttccaaatgggttggtatttgttggggagcttccatttggacgaaatggtgggtttagtcctaaaatggatcacctggtgtgttttcttcctggtacccttgctcttggtgcaactaaaggtatcaccaagagaaaagctcttgagactaatttgttaactgatgaagatatagaaaatctgcagcttgctgaagatcttgccaaaacatgtgttgagatgtacttcgtgacctctaccggccttgctcctgaaatagcttatttccacattgagggtgatacagaagggggggctgatggtgggaataaaagctccaaatatatcaatgatatcgtaataaaaccacttgaccgtcacaatcttctacgcccagagactgtggaatcactatttgttttgtatagaatcacagaggattccaagtatagggagtggggttggcagatctttcaggcttttgagaagtacacaaaagttgattctggtggttacacatcattggatgatgtcacaagcctacctccttccacgagagataaaatggaaactttctttcttggagaaacattgaagtatttgtatttactgtttgatgaaaacaataccctccccctagataagtatgtgttcaatacagaggcccatcctcttccagttatgcggtctgcagaacaggcttcacattctgtgtagtttcccaagtttatagctgttgtactatggtgagaagtacagatctgtgacaaatatacttgacaacatagttggaggaacgagaaattgagaatcccttgcatgactgttcttggaggcaagctcatggttctggaatctccatgcctgatttgaggatttgggggttttacttgtatttactggaaggccatacaacctttgtactctgtactgtctgtagtctgtaatacctaacttcaaattttgaaatcggctagcagttataccaagatttttatcttcagagaaaaaaaaaaaaaaaaaa

SEQ ID NO: 24217 - DNA, 3012 bp, Zea mays
cggacgcgtggcgctagcgaaaaagcatccgcccacctcccctcgtctctctcgcgctccgccgccgcgcaaaactgtctggtgatgacgaacgccgccggtacggcccctcacccgactccgccgacgccgctccaacaacaacagcatcagccacccaaggaccagcagcagaaggcgctggccttgaacgcattccgcctgaaggggatcggcgaccgcatcaggttccacctgaagggcatgagcgtgcccccagtcgccgagttggcccacctcatctacgcgttcgccagagggattgacttcgcggtctcagctggtgatattcctctgacagccggtgacatacccgagattctgagaaaggtatatgagctgaggaaagaaacaattatacaatcttcgcttatgatactagcgatctcttgcaagaatgcttgctccaataaatggtttcaacctgcagattccagagacattcttagaatggtcaatgagctctctggcaacttctgcacgtccacaggccaggcagctagtgacagcactgtgcttgaaattatatcacaaataatgccaaggtattaccctcggttgaagtttgagcgcctaatcacttctattgaagcaaaggttggctatgatatattaatggctgacttctttattgagaggagcctatctcgagatgaaaagattagactaattgtcgtacaaaaggaaaatttagatgcctcatcatgtgtctcaagtccaccacatgtgagctttttggtcaatgggaagggtgtggacaagaggactaatgtttcaatggaacaaggaccccagttacctactgatatcaccaaaatgctcaaatatggggctaacattatccaaggtgttggatattttaatgctaattatatcatagctgtagcagttgtgaacgatttgacatccttcagtgctccaaaactggatgactatgcacaacctatcactgtttatcctgcagattctgatgtacttgagggaccatcaagagtttccctaaattgtcctataagttttaggcgcataaaaactcctatcaaaggccgtctttgcaaacactatcagtgttttgattatgataattacatggagatgaactcaagaaaaccaaactggcgctgtccatattgtaacacctcctcaagcttcactgacctacgtattgaccaaaagatgatgaagatactagaagagactggagatgatgtcactgatgtccttgtatttgctgatggatcttggaaagttgttccagctcaggatgaaaaatctgatagacatagaggtgacacaattcagcaggctggagatgctgtagaaactggttcaccttctcgagatgtcatagatctgataaatggcaatgatgatggtgatatgcaaatggattgggcatcggctccagaagattcaaagcctgtgttgaatagtcaagatttgtctgtatcagactatcttacagatttccctatgacagctcagacagaagatctgaatcgaggggatggaaataatgggggaagcaacatggcttccacttcacgtcaaaatttgttactacctcctactagtgggctgggctcaagttcattagggaccttggaatctattctacctcaaaatgttctgcaccctgttatcacagatgcagtctctccttctcttgaaacctcttcagcatctggcatgcaacatgtttcacaggaaacacattgtggaactgtacagctgcagccacaaataggtccagtacatgggtcccgaagtgagaaggcttcctatacctagaaatcccaggagagagccaataggagtacaggggttgacggttccaccacagaatcctgggtcatcaacaaggttgcagccaaatattctcaattgtccacctcctatcccgctatctagtccatcctcttcaacttaccaagcacatcaagtgaagaatccagacagtgtcattgcttcaaggaacagtggtagtgggccattaccaaggactcctagcgtcgctgctgcatcattgcacctacagtcgacagcacgggatattcgcaacacatcgagccatctacccagtcgagttgttggtctgcctgcgccacacctcatgggtgcacgaccaccaccaggaatttcagtgcaggctggaggagcgaacgcctacagaactatgcaacagactccaactatggatccactgaggcacacacggatgagcatgaaccaaacagcactggctgctgccggccaaaccaccgctgccgcgtatgtccgaccaacccaagcagacatccaaaaccatctctttcctgtgcagcaaagccaggcaccacgatcgcaacaagtgccacgaacaacaaccccgcctctacagcgggcgccaccgcacctgcaacctcccagtgtaccaccgactgttccaagcacacctcaggctggaccttcgcatggtcttccaccggagctccctgtggatgatagctggcgccccacgggacagatgagagggagtctgacaggcaatgcttacagttctgcaattaggcactatcggggccattctgagcagcagcagggcgagcctcggcctcccaacacttcaggtgcgcgaaggcctcagtaactgccagacattgcggcgttgccctgattatcaagcagggcttgggcagctaatttaccaagagattttaatttattatcatagctaatttggcgctatgatgatctatgttagtgtaggtaggggagcctagtgagtagtgatagtgctctgcttgtctacaacgcactctgatgttaaattagtagtatcaggtgaaccatttgtgtacccaatatggaacgtggattttttatgctaatgttttgcctgtgtaattggaccgattttcatgtgaaattcctgaacgattcccatgaaaatgaacaggtaacttgcatacgaacaatgtagtgtagtccagt

SEQ ID NO: 24218 - DNA, 2650 bp, Zea mays
ccttcctttttttttgggtttttgaaataaactcgtgctctatttttttttttttttttcgatcaataaaaatgatagttttctcattcactttctcattttacattcaatgtttaacacttcccatggaaagaactatctgtattgatgtatatatctcactggagatcggaccatcgacatgtattcgagaatggagccgcgcgccattcgattctgtaattccgttgaccaaaagaagaagaagaagttacaagttgtcatgctcgatgacctgcgccgccttccactcctcgccggggttgacgacgacgggcaccaacatggacgccatccccgtgcacagaaagtagtccttgccgaacttgtcgtacatgcctcccgggctgcagaggtacatgtcgtcgaaccccatcctcaccaacctgaacccgagcccgctatactgatcgatggtggtgaacttggacggcgcggtgctgtagacgcgcttcttcctctcctctggcggcgcggcgtacacccggctcaccttcttcttgagcgtggtgtagaggtcctcctcgacggtccagacgccctggcgcagctcctcggcgccgccgaaccagccagggtcctcccgcttcatggcctcggccggggacaggaggctgaaggctgcggccggcggcgggtaggagcagtaggggcagccacggaggccctccacggccgtgccgcctcgcttgtcgaacttgatgtggctcagcaccgcgcctgtcagcgccaccggcttgctgcccgtgttccggacgatcaccgccgtcgccatgctcagcgagtacagcgtcaccacgtacgagatgtccagcttccctatggtgcacccgagctccacctgcacggcgtcgtaggagtcggagtcggcgtccctgacggcccactcggcgccgtcgaccagcgacggctgggcggacgaggacgtcgcgtcgttgaggacgaggccgacgccgcccttgcccgccacggtgtgcagcacctcccggcacccgtcgtccttccagtacaccttgggccggtaggacgtgacgaggccgtcgccgaggcggagatgcagcgagctgccgttccgcacgctgagctccgcggcgaggggcccgccggccgggtcggccacgaaccgcaggcccttccgcccgaacgactcctccagggactgcgcggtcgtcgccgccaccgccggggccgcggaggcgcgcgcggcggtgctggtgctggtgctggcccggcgcgcgcaggacaggaggtggagcgggagcacggaggaggtggccatcggggcgggagtgggattgaagaggaggagcagagccctctggagacgcggagcggcgttcactgcagcctcacatcctatggccttaggatagatgacgatactttcttcctcgcctcattcctttcgttctcgcgcttttttgtgctcttttccccctcttacagcctcatatcctatgccaacgtgaaagagaagtcgttatatttcacgttcatgagtttatggatttttagacgagtcttatacgatcagctagtataattacaaacataactcttgagcagtggagtagacaagagggctggcaggagcctgacctcctaaaatttgtacaaacatataaatacatactaattactgcttaaatagttaagtatataaaaatagtgattgatttgataaatattggttatttctttgtttatgtgttaataaaaatatgtagtcaattaagttaaatttaaactgaaatcagacacttatatattacatataatctattaaatgttgtttatggtctctccatataatttttttggctacgtctctgctcttgatagacaagtttagagaaatagagggtatttggtttcatctaactaagggcccgttcgcttgtccaggaatgaaccgggattcattccagctcattaaaattaatataaattagaaaagtaatccggctaagaactattccagggctccaatccgtgaaaaccgaacagagccttagagagcccgtctgttggataggagtatatagctttttgtttaagcttttttttcaatttctgatcaccagaagatgtcgcaaaactgttaaacatctaactttttaacctgtttctataagaatcattttagtcaaaattatctaaaatcaatatgaggacagaatcaaccgagtccttatgaaaaccgtcattttctatatcctaaatcatataaactattttatctttcttcacactttatctacatgaaactgtattccctacaaccatatttttctggcagtcagattctaaaaaaaatcctcacaaaaaagttgaaccaaactcgcgagccacgggcccgcgtccggcgctgcacgagctgtgtcacgcctcccggcctcccggggtccagccaaatagggctctacatgtgcacagggccagatttcacgtccgccgacgtggttacggcgtcacatgatcacatctggctcctccgggcccaggcgccagtgacgccgtgcccgcctctaaatagcgcctctctcccgggctgccggcggaaccgaggcggtcaggctccctcctccttcctcctccctgcaaatcctgc

SEQ ID NO: 24219 - DNA, 541 bp, Zea mays
gagaggatatagagaggaagaacacctcgtccgagaccattaagagcagcccacacctggtgctgatcctgtgcctccaggccgctctggtcatgggcgttttccccgctttggctaaaaaaaatgccctggttgagagcaaggccattgacatcaacccggggcagctcaagtgttgcaccaactgcaacttttccttttgggggctttacacctgcgacgacgtcaaaaaggactgcgaccccgtttgcaaaaagtgggttgtccccgtgcacgcctcctactcgggcaacaacaagttcaggtgccccgaccccttcctcggcatgtgcggccccaagtgctagctaaaaaggaagaacgcgcgctgctgctagctgctaaagtttggttcttccccccccggccggcccccggccggtgcatggttcacgtactgtgtgttgtgctactacgtactggcttcttgtgtgttcggttcttgttgttctctcgacagtgccccttgggcgccaacaataaaccgttgtttgccatgaat

SEQ ID NO: 24220 - DNA, 679 bp, Zea mays
  misc_feature (11)..(11): n is a, c, g, or t
  misc_feature (13)..(14): n is a, c, g, or t
  misc_feature (16)..(17): n is a, c, g, or t
cctgcgaaaananngnnaaaaaaaaaaaaaaagcgccggccggtccaaaaacgaagcttgcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagctagagaggaagaacgcgcgctgctgctagctgctatagcttcgttcttccgccgccggccggccgccggccggtgcatggttcacgtactgtgtgttgtgctactacgtactggcttcttgtgtgttcggttcttgttgttctctcgacagtgcaccttgcgcgccaacaataaaccgttgtttgccatgaataaaaaaaaaaaaaaaaaaaaaccacaaaaaaaacaaaatcaaactataacaaacaaaattaaaggccccta

SEQ ID NO: 24221 - DNA, 1763 bp, Zea mays
ctagctcttgcttctacgagaggatatagagaggaagaacagctcgtctgacgaccagctggtcggcccccgccccgttgctgtcggaagagcagcccacacctggtgctgatcctgtgcctccaggccgctctggtcatgggcgtcttcgccgctttggctaaagaaaatgccatggtcgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctattagcttcgttcttgcgccggccggcccggtgcatggttcacgtactgtgtgttgtgctactacgatacgtactggcttcttgtgtgttgggttcttgttcttctctcgacagtgcaccttgcgcgccaacaataaaccgttgtttgccatgaataaatagtactatgaagttatttgcaaaaaaatcgaggcccttccggtcgcccacgaccccgcgcaacgaagcttgcttctacgagaggatatagagaggaagaacagctcgtccgagaccatgaagagcagcccacacctggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagcttcgttcttccgccgccggccggtgcatggttcacgtactgtgtgttgtgctactacgatacgtactggcttcttgtgtgttgggttcttgttcttctctcgacagtgcaccttgcgcgccaacaataaaccgttgtttgccatgaataaatagtactatgaagttatttgcaaacaaaagaaaaaggtgacgcggatgggcatgcaacactaaaaaaaaaaaaaaaaaaaaaaaaaaaaaaaaaaaaaaaaaaaaaaaaaaaaaaaaaggggggggaggtatttaaaaaaaggaaacaaaaaaggggtttgggaaaaaaaagcccaaaaaaaaaaaaaataaacttcgtaaaaaaaacgcgccaaaaaaaaaagtaaaaaaccctctgaatgccaacaaaaaaaagggcaaaggccaaattgccccccccccccggggtttccctcttcggggggcaattcccccccccccccgggaacaaaaatttttgaatccccaactaatccgccgccgccaccccggggggtaacccgggaaaccccccaaagaagggaaccgccaaaaatttccaaaaggggggcctccccacccccggaagggggttaaaacccttaaaaatcccccggggttgggccggggtaacaactttccccggcctaaaagggttgggaatcccccccccgcgaatgggaatggccccggggggg

SEQ ID NO: 24222 - DNA, 784 bp, Zea mays
gccggccgggctgcgatttaggccccctcgtcgacgccggccgcccgggcgctaacacatcaacgaagcttgcttctacgagaggatatagagagtaagaacagctcgtccgagaccatgaagaacagcccacaccaggtgctgatcctgtgcctccaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagctagagaggaagaacgcgcgctgctgctagctgctagcttcgttcttccgccgccggccggccggcgtgcatggttcacgtactgtgtgttgtgcaactactgctggcttcttgtgtgttcggttcttgttctctctacagtgcaccttgcgcgccaacaataaaccgttgtttgccatgaataaatagtactatatgaagttatttgcaaacaaaaaataaaaggtgacgctgatgggcatgcagcattaatattaaaaaaaaagcccccaatgtttcttccttgtatttaatatagcagcggatatacatgtgcggatgcacgtcgcgcaaaaaaaaacaaaaataacgcccctaa

SEQ ID NO: 24223 - DNA, 1298 bp, Zea mays
ggtaccgggccccccctcgagttggggagcggttccgggctttctttggaagttgaaatgacttgtaataatctagaatagaaggagtagccattaaccactcttacattggttttcaatgtcaacaacagaggtgatctcccagttggcctcggtactctattcggatttattaattattatgcaaagattttgcagcacaagagtacgacaagcgctatcagagagaagcagccccgtctatccacctttgataggcagcaaatacttcaaatggcagatagtccgatggaacatggccagccccctttattgtcgcaaacaatatattgttctcgtacctaattgagtacccagcaatctgattctccaagtaccaagggtgccatttctcgatttccttgtagtttagtttctttagccactccaaagttgaagtaaaaggaacaagcaaggaatggtctccactgtaaataaacactctatatcctttggatgttatgttcaagtgatactctatcaatgttagaatatccctcgtgtacagaacacgcttggggcacctcttccatggtcctgatacttcaacctttttggcatgcaatttttctctacctgatcttgtatcaaagagtttctcaagggccaactcttgatcattgcattctaaaccatgcttggaggttttcgaaaggctctcaaacatttgaccagaatcatattcaatgaattgattggttatccccatcttgtatcgacacggcggacatagaatatgctccatgttaatacctttgatttgagtataaaattgctccatgttctcttggcatgatggattggagttattccaatactttccattacatgtagtaactaaactctgaaacaattcatctgaaatcaaacccattcgaaatgcatatggaacatgtgcattgttctctatgtcaacatcaatagcgggattacatagtgaatatcccttgaagttgatcttgaccccaccggattcttcatttctctttataatttcgtgtgcaagtacaggtactatcactccactgtacgagcatccagctacgtagaaaggattcgacagaaattctgcgtattcagcgaaccactttgacagaaagtcatacaggccccgtgccctgcttgtgtcatctgtggtgtagtcatcttcatgatcagcgtacgagtagcccacacctgctggcgagtcgaccaagaggaggctagccatctttgtccatgagtaagtgttcagggctactcgtggatcgtcgttgata

SEQ ID NO: 24224 - DNA, 1969 bp, Zea mays
ggcgttgcagccctgccatccgctcctgctccggcgttgcagccctgcattcgtcagcagcaccgtccgcccctgctccgccgtcgtggctctgcctccgtcagcaacgccatcggccccctgccttcgagtgttgcggccatctgttcgcaagttctgctctgccagattctatgtgtatctgagccgagtgcgacttggctagatctgttgatctactgtgactgggcacggtttcgtccaagactgcagccggcgtatctactgttcatccgctgcacccgctagggtttcttttatttggtaccatcaagccagtctatttcagatctgttattcttcattgttttattgctcctcaatatgtcggtcaacgctattgttgtcaatattgtgcttgatgggcagaattacccagaatgggccctttgtgtccagactgcattaagaggtcacgggttactatttcatttgactgaagattctccagttttagcagctgatagaagcaatgctgctgcaatcaagacttggcagatcaatgatggcaaggtaatggctgcaatggtcaacagcactaaaccaactatgattatgagtctgtccaaatttaccactgctaaggctatctggtcacatctgaaggatcgatttgttcaggatagcggtgctcttctacatacccttatgcagcagactcatgtgattgagcaacatgatatgtccattgatgaatattattccgcctttgatcggcttatgagtgcattgacctccatggtgcccgcttgtacagttgtgccttgtccagcccacaagttctgtgagaagttctttacctacagatttgtcatggggagttcgacctgaatttgattcccttcgtgcaaggctgcttcacagttcagatactctcaccatggctcaggcattgtccgaattgcttgctgaagagactcgtctgaagtctatgtcctctattactggtgtgagttctcatagtgtgttggctgctgctcagaggtctaggaacacctccttttagccttgtgaacactgcaaaaagaccactcatcggtctgagaactgctttgctaagtttccagagaagctggctgattttcgtgtccgtcgtgctactcgtggtcgtggtacaagaccatctcctcgaggctcagttgcggttgctgctacttcttctgctggtgctttgtcatcatcttgggttcttgattctggagcttcctttcatgtgacatctgatcagtcacggctggcgtctactacacctgtcaccgagggtacttctgttcagacggctgatggtacattatgtcatgtcacccacaagggttctctttctgatccaacttttactgtcccaaatatattttttgtacctcagttatccatggatctactatcagttggtcaaattaccgatcacaattgttttgttggatttgatgactcatcttgttttgtacaggatcgcaaaacaggggatgtgattgggactggccgtcgccgtaaatcttcgcctcgcctctacatcttggacactttgcgtcttccttcatcccctactactacacctcatgtgctcgctgcttcgggccccacgacgtcattcgcccagtggcatcatcgtctgggtcacttatgtggatcccgtctgtctactctaataaagtcaggatgtttaggctctactcatgttgagtctagttttcattgtaaaggttgtcatcttggaaaacaaatacagcttccatattttactagtacttcccattctgctaaaccttttgatctaattcactctgatgtttggggtccagctccgtttgtttctaaggtggtcataaatattatgtcatttttattgatgatcattctcgttatacttggatttacttcatgaaacgccgttcggaattgcctttctattacagtcccttcatcgcat

SEQ ID NO: 24225 - DNA, 1988 bp, Zea mays
  misc_feature (1981)..(1981): n is a, c, g, or t
  misc_feature (1986)..(1987): n is a, c, g, or t
gagtagaaacttgttatcgaaaccttagtgaatcagctcgtgtttccatatctcttcctttgtcagttttttctggtaccgccctaacttttgtaaataagtgccgtctgttttgctgaactagcatcagcctaatagctgcattttgtttaaaaatattagtaattgtctagaaaatgagcttgtcaggtgcacttatatgcacctcagtacacgaaacccatccgaaggcttcatcgtttggcggacgctgccagtctctgtacacgcatagcgagcagctccctgataactatctccggttcgggcaggcgtttgcgaagtgggaaggatcgccgcagttaaagcagcagccgagcacggtgtcgcccgtcgctgaaacgaacatcccgccgtcagcgttacggcctctgcctctccggcctccgcctctccgtcctgcagatgcagacgcagacgcagacgcctgcctgctgctgccgcgcccacggcggcctctccccgtaccattgtccacttcgtcttcccatttgaagaagccacagccaggatcttgacatttgtagaacctcctccccctgttagcctctgtattagcaattcgtgatatgcaaagcgctccacatgaggtgcacagcacttgacctgcatctgatgcattacttggattttgggtatgggttgaacggaaaccttgagaatgcataaccgatgggttatcattattaagctggcttgccggacgaaaaatagtatgtaaatcctgtcttggagtcccctgacccacaccatttggagttggtcctcttgctggtgttgcagcctggctgcgacttccaaacctacttatctccataaggtctttgaggatatcatcacaaccaccaacacaacctaggtgatcaacatcgaaatttggtggaatatccctccgacggaacttgaattgaatcttataaacagggcctggtgcgcagataggacaaacttgattagttacagccgcttctgaaagagatcctgggagccataccacgtttctacattgtggataacttcggcacccaaccataaattcaccactcgcccttcgcttaagcaacatttcagatccattgcatgcaccacaaggcctcacaacctctactggattttgagtttcatttataggcctattagaccttgcaaagaatgtccccattgcatcaaggagttttgctttcttcacccttgcgtcaagaaaacaggccttcatctgctgcaaacaactctcaagtacttctgatttactcttagtacccacgctaactgatttcatatcagcttccatcattgatcttaaataaggcttccaaagctcataccccatttcatcataacccatcaccaatgcctcaccaagatttgtcggggagaaacgtgtgttttcatctttggttgcataacaacggtcaagcaacttttttatgtgatcatgcatggttgcatcagtgccaattcctgctttatccatacagctaagaaggtcggcttcagccagaagaggcggtggccgagtcactccagaatcaagtgttaaagttgtcggaacaaactgctgcccaatgttgtatgttggaagtaacgttccaccccatgagtcaaagcggtaaacatccagataatttttagcaagtatgacacgccctgatgcattaaactgttcaccagctatgtcaatttccacagttgtttcagctccaacagccggttgagagcaacatgcaaggaaatgtcggacaacaaactcatacaatctagtgtggtctggactccagtttctttcaccttctgaaaatttggttggatgaataggaggatgtgccttgtcatcatgaccaccattactgggattcctccaaagtcttgcttcaggatttagaagtcgctgagcatatggggggggggggggggggggactcctgcagcccgggggatccantgttnng

SEQ ID NO: 24226 - DNA, 2746 bp, Zea mays
gcacgagcgcaaggcaagctttccgcttcatttttcggattgggatcatcagcggctgtagcgtggacccgacgggggtgcccggaccacatccctatttcatcttggtaccccgtccgtctccgatttcagaagcacggcgggctccccggcagcctctaccgagcagaaagctgagttctaccccagaaccgaggcatggaggacgaagaaaacatcgagggagaactgttgctcgtggagtcacaactccacgacatccaaggacaaattaaaacattactcgatcgccaagaggagttgtatgaacgccaggcacagttgaaggctttgctcgaagcatctaaattgaccagaaatacaacaattaacacatcttcagttgctccggaagattggtctgggagcttcccatgggatctggaggctgacgataccaggttcaatatatttggcatttcctcctaccgatcaaatcaacgagaaataattaatgcagtcatgagtggaagagatgttctggtcataatggcagctggtggagggaagagtctatgttaccagctcccagctgtacttcgtgatggaattgcactggttgtcagtcctttactttcccttattcaggaccaggtcatgggactgtcagctttaggtataccagcatacatgctaacttcaactaccaacaaggaagttgagaagttcatctataagacacttgataaaggagaaggagaactaaagatattatatgtgacacctgaaaagatctcaaaaagtaaaaggttcatgtctaagctcgagaaatgccatcatgccggtcgtctttctctgattgcaatagatgaggctcactgctgtagccaatggggtcatgattttcgtcctgactacaagaatcttggcattttgaaaattcaatttcccagtgttccaatgatagctttaactgcaactgcaacaagtaaggtccaaatggatttaatggagatgctccacatcccgagatgcatcaagtttgtcagcacagttaacaggcccaaccttttttataaggtgtctgagaaatcgccagttggaaaggttgtcattgatgagatcacaaagtttataagtgaatcatacccaaataatgagtctggaattatatactgcttttcaaggaaggaatgtgaacaggttgcaaaagaactgcgcgaaaggggtatttcagcagattattatcatgcagacatggatatcgttaatcgtgagaaaattcatatgcgttggagcaaaggtaaatcacaggtcatcgttggaacagtggcatttggaatgggaatcaacaaaccagatgttcgatttgttattcatcacagccttagcaagtctatggagacatactaccaggagagtggtcgggccggacgggatggattaccttcagaatgtattttgtattatcggcctggtgatgttccacggcagagttcaatggtgttctatgaaaactgtggcctgcaaaatctttatgacatcgtgcggtattgtcagtctaagaggagttgtcgtcatggtgcattctttcgccattttggagaggtgccctcaggactgcaacggaatgtgcgacaattgtgcttccactattgagcagaaggatattgatgtcacctgtatgatttattttgcgtcagtttaaaaattacaacaaatgaccaacatttattcactttatttcagggggaaaatgttttttatttcatgatattctcacagtaattttttctacttcctgtttagaccatacaaaaattatagtttcacttcttcacgatatgcaacttaatgatcaaagagctacactactacagctggtggataagttcaagtcaaagtggaaaggtttaggtagtttcaatgaagctgttgatcttagaaaagaagaagttgagcagttgatagttaaccttatactcgacaatgttttgaaagaagaatttcagcacacagcatattcaaccaacgcttatgttaccttaggagcattgtggaagccagcactacaaggaaacagagtagtcaagcttgagattgctattgcttctaaagatagagatgttagatccaagggcgcaaaacgaggtcgcatgagtgatttggaagccaaactagatgaactgcgtagggatctgtcatccacgggtagcgatgccatatttccccatgcagttcttactgcgcaacaaatttcactactgagcagccagaagccaaccactccagctgagctagaaaaggttatagggaaggtgaagacaaggaagtacggcagcaagatcattgagctgatgaggtcacatgacaattcaggaagtggccgaggcaaggaggctggcgatgaacacagagctaagaagatcaaaacgaaggatgaggatgttgtttgtgttgagagtagcgaggaagaatagaatatgcccttcacatacttggctttttagtctatcatctcatggttaattattttgccaatcatttcctccgacgtcatctttctgtaatttagactttcacggattaatgcacagtcatatttcttacagagaaagcctcgagcatccttttgaccggttcatagtcttttgcttcggtagctttgtatcttgttgatgatcggattaatgtgcgaatacttgggattaatgtgcgaatactttgtgtcaaaaaaaaaaaaaaaaaaaaaaaaaaaaaagggcgg

SEQ ID NO: 24227 - DNA, 2393 bp, Zea mays
gagaattgcgcagggttttgaaaatccacgactacgacgcgcctaggcgcgcctagtcgctaggccatggcctcccgcctggactaggggggtaggcgggctgctaggcgttgggagcgcctaggcggcgccaaggggcgattccacggcgattccgcgcgcccaggagccaaggcggcggcgtaggcgtgctaggcgcgcgtgggaaaaaaggcgggcgggaaaagtcgtgcgcgcgcagaagaaaagcgcgcagagaagaaaagcgcgcagaagaaattggcgcgcgggaggatagcctggcgcgtgcagagaagaaaaaagcgcgcagaaaaaagcgcctggcgcgcgcagagaagaaaaaagcgcgcagaaaaaagcgccgcagagaacaggcgcgcagagaagaaaagcgcgcagagaagaaaaggaagagcgcagagaagaaaaggacgcgcgccagagaaaaaaattgacccctgcttgcttatctcctgtacgcgggacttccttctaagcattagagggcttggactcaaaagtgttgagtgcgttcgtctcttgacgctacatcatatggcttttccagtggacacaaatgttggtcggatatgtgtgaggcttggatgggtgccgcttcaaccattgccagagtctcttcagttgcacctattggaaatgtatcccatgctggagcacatacagaagtacctttggcctcgactatgcaagctagatcaacgtacattgtatgagcttcactaccaaatgattacttttggaaaggttttctgcacaaaaagtaagcctaattgcaattcatgtccattgagagctgaatgtaagcactttgctagtgcatttgcaagtgctaggcttgctcttcccgcacctgaagaaaaacgtttggctacatcggaggatccaaatgttgtagagttttgtcaccaaacatacataaattcaggggctgttggcgaacttgagtggagtgcgaactatcctaagcatgctgtttgtggtaacctgcagccgttcattgaggaaccactgagcccagaacctgaacctgaaaatgtagaggcgaaggacggtgcaatagaggatttctttaatgaagaccctgatgatattcctactattaatcttaatattgaggagtttacacagaacttgaagaactatatgcaagcaaaccatgttgagattgagtatgctgacatgtcaaaggcattggttgccatcacccctgaagctgcttccattccaactccaaagctcaagaatgtcagtcgtcttaggacagaacaccaagtttatgaactgccagattcacaccctcttctggaaggatttgaacagagagaaccagatgatccctgtccatatcttctttccatatggaccccaggtgaaactgcacaatcaaccaatgcgcccaagacattctgtgattcaggggagactggtcaactatgtggaagtttaacatgctttagttgcaacagtttacgagaaatgcaggctcagaaagtcagaggaacactcttgataccatgccggacagcaatgagaggaagcttcccacttaatgggacatattttcaagttaatgaggtatttgctgaccattgttcaagccaaaatccaattgatgtcccacgaagttggatatgggacctcccaagacgaactgtttactttggaacctcagttcctacaatatttagaggtttaacgactgaagagatacaacaatgcttttggagaggattcgtttgtgtgaggggctttgataggacagtaagggcaccaaggcccctttatgcaaggttgcattttcctgccagcaaggttgttagaggcaaaaagcctggagcggcaagcgtcgaagaataataggtacatcgaagaaatatagaggagctaacaaaacggatggatagccctaaatgagatgctgacccaataagtcgccgaatcacctccaagttctaacccaatttttgaggcgacatgacctgttaaattatgttccatctatggtaacagcttagatgttcttgtgagtcgcatattctttactctgaaattcaatatagcaaatgaaaaaaaacacagtgcatagtctagttctaattgtacctgtgagtggaatcagttgttgtacaacatgaagatgggcctatttgtacaatggtcatacatgttctttgatcatatactataaacaatgtaacctcatcggccgttatttgattgtttcaaaacaaaggaaaagccttttcaattcaaaaaaaaaaaaaaaaatatactatagttacaaattgtatactatacttaatcataactatgtataattcttgtgatttatatatggattttctcgattt

SEQ ID NO: 24228 - DNA, 2663 bp, Zea mays
gtttgaaccatatgggtaaatcattccacacaggccctgataaagtgaatctttccagtgttacacagtctgaggctagtctttaccctattgatcctttagaacaaggcgacttttcaccactcattaaacaaaacttccaaccattacatagttcagacgaagtgccatttttcaaggagcactcttcatgtaatgatttttcgaggaacaaaactgaagctcattttctggaaccacttgtctgttcaaatcctcaagaggtgtacacaacctcaacagatcaaatgggtgctgaacaatctcaatcaggatgtggccaaaagtacaatgatgccagagttcagacagcatcacatgaaaggcatcagtcttcaaccttgtgtgataaccagaactcttgttcggtggtgttgcaaggagttgcttcagtactcaacacagaagttcgttgatactcaaaaggggccgtcaaaagctcgacaaaatggatcaaaagctaaggtacggggccgacctaaaaagaaaactgatgactgggacagtttacggaaaaaagtgctttctaatggtggggacaaacaaagaagtcatgatgcaagggatactgttgattgggaggcagttaggcaagcagaagtacgggaaatatctgaaaccatcagagagagaggaatgaataatatgctagcagaacggataaaggaattcttgaaccgattggtgacagaccatggaagcattgatcttgaatggctaagagatgttcaaccagacaaagcaaaggacttccttctaagcattagagggcttggactcaaaagtgttgagtgtgttcgcctcttgacactacatcatatggcttttccagtggacacaaatgttggtcggatatgtgtgaggcttggatgggtgccacttcaaccactgccagagtctcttcagttgcacctcttggaaatgtatcccatgctggagcacatacagaagtacctctggcctcgactatgcaaactagatcaacgtacattgtatgagcttcactaccaaatgattacttttggaaaggttttctgcacaaaaagtaagcctaattgcaattcatgtccaatgagagctgaatgtaagcactttgctagtgcatttgcaagtgctaggcttgctcttcctgcacctgaagaaaaatgtttggttacattggaagatccaaatgttgtagagttttctcaccaaacatacataaactcagggagtgttggccaacttgagtggagtgcaaattatcctaaacatgctgtttctggtaatcatcagccaatcatcgaggaaccactgagcccagaatgtgaaactgaaaatatagaggcacatgagggtgcaattgaggatttcttttgtgaagaatctgatgaaattcctaccattaatcttaatatcgaggagttcacacaaaacttgaaggactatatgcaagcaaacaatgttgagattgaatatgctgacatgtcaaaggcattggttgccatcacgcctgatgctgcttccattccaactccaaagctcaagaatgtcaatcgtctgaggacagaacaccaagtttatgaactgccagattcacaccctcttctggaaggattcgaacagagagaaccagatgatccctgtccatatcttctttccatatggaccccaggtgaaactgcacaatcgatcgatgcccccaagacattctgtgattcaggggagacgggtagactatgtggaagttcaacatgctttagttgcaacaatatacgagaaatgcaggctcagaaagtcagaggaacacttttgataccatgccgaacagcaatgagaggaagcttcccacttaatgggacgtattttcaagttaatgaggtatttgctgaccattgctcaagtcaaaatccaattgatgtcccacgaagttggatttgggacctcccaagacgaactgtttactttggaacctcagttcctacaatattcagaggtttaacgactgaagagatacaacgatgcttttggagaggatttgtttgcgtgaggggctttgataggacagtgagggcaccaaggcccctttatgcaaggttgcattttcctgtcagcaaggttgttagaggcaaaaagcctggagcagcaagagcagaagaataatagtacattgaagaaatataggggtgctaaccagacgaggatggatagcccgaaatgagatgctgacccaataggtcgccaaatcacctccaaattctaacccaatgacttccatctgtaatgaatggcaataccttgaaaacctgtgatggagatgttttgtggcgacatgatctcttaaattagattccgtctttggtaacagcctagctgttcttgttgagtcgcatattctttattctgaagatcaatatagcaaatgggagaaaaaacatagtgcacagtcgagctgttctaattgtacctcttgtgagtggaatcagttgttgtacaacaggaagatggacctatctgtacaatggtcgtacatgttctttgatcatagtataaacaatgtaagcctcatcagccgttatttgattgtttcaaaacaaaggaaaagcattttcaattcatctgttcaaaaaaaaaaaaaaaaaaaa

SEQ ID NO: 24229 - DNA, 2116 bp, Zea mays
ccaggtctaaggcaaaagccataaataccccatagctccaaacagcccaggaactgcagttattttgtttttttttttgtccacaaaaccatttaacacggttgataagaccaggtaacagccaactagtcaaaatacagatattttgatacatgaaacccagtacacatccacaaagtacataatgaagccgcaatagcaaaactacatattaggcaataaaacgatatgatccttcaagaaagttcctccttcaaatactgctacaaaggcatctggttcaaatccagttgtaaaattcaacagcaggaagcctttcgctacattttggcaccaatatagactcaaaagccatccgaatgcaaaaccacatgaacgaaccacggaccacagatgccaaactaagatacaaggaaaataatcagatggctagttctgtcaatatccaccctgaaaaccagtgcctccgacctgagaaccaggcacctggccctgcccagatgccccagcctgataaccagcagcagtggcagctgcggcagccgctgccgctgcagtgcttgtctgggtagttgcctggccaacctgaaacccaggtggcccttgaaagccaggaggagctccacttccttgatatgcagctgctgctgcttgaacacctgctgcatttgggaaagcggcacctgctccaaacgacggtgtcccaaaaccctgagctccaaaacctgtaagaccaactgtgtgtgcctgctgcccccctgcacccaatgcagcagcggcgaaggctgggttcatagcagcaagcatggctggactcatccctagcgcagctgggttctgcattgctgctatcatggcaagcattgcattgggttgagtgaatgcctgttgctgtgcacctaatcccagcatagcagcttgctgtgcaaaactcatgtcaggaaccacagtagcactatatgctgatgcatcatatgggctgatggcaacactggaaggagcagtcatctgggcggcgaccacagatgcagtagtgggattggagttagtatttgtattcattccagatgagcccttggtcctcccatctatggctttctgcacattgagtgtctttccatcaaaattctttattggctcctccaaagcacggcgagcactctccacagacttgtaaacaaataatgcaaatccctttggtctgccagtgttcttgtcaaagcccaacgggccctcttcaatctcaccaaattgtgcaaaatactcatataggcggtccacgtccacatcagcatgcacattaccaacaaatatcttgcgctgtatattgtcagtttgtgatgatgaggatccagcagcgttgctcgtggagttagagttagcattggggttggcgttggagacagggttctgagactgagaagctgggggtgcggggcctgaggcggcgaggtgacagaaagcaagacgaccaccgatttggagctgagggcggttgagggcgcggagcgcagagcggcgggagcggaagaggacgaacccgtagcccttggatctaccagattgcttgtcagagatgacgcggcagtcctcgagctcgccgaagcgtgagaaggcggagcggaggtcctcggcgccggcaccccatccgagaccgtggacgaagagcttcctgctggcagggtcggcctcaacggcgcggcggacggccgccatcgtggcggggctcgcctccgccgccgtgcggagcagcgcaacgagctgctcccgcgacagcggctcaagtagcttgacaatgtcctccgcgtcgtcctcgtcgtcgccggcgccctcgtcctcgtcctcttcggcggcgttgggttcgggcgggtcgtcagtgatggggaagtagatggagccgcgtggcttgggctccgaggacgccggctcgtggcggtggttggtggtggctgcctccacggcggcgggggactcggcgggatcggccttgcgcttcttcggcgccatcgataggcaagctagggtttaggcgcaagctgggagattgggatttgcgacactaagtgattcacccggccgggccccggggcgccccccgcccggcctcgaggtaccc

SEQ ID NO: 24230 - DNA, 769 bp, Zea mays
caggttgtgacgaggtggggccccggagccttgggtggtggtattggagttagagttggcattggtgttggtgtgggagctagggttctgagacggagaagctgggggcccgggccctgaggcggcgaggtggcagaaagcaagacggccccccgattttggagctgggggcggctgagggcgcggagtgcagagcggcggcagcggaagaggacgaacccatagcccttggatctgccggactgcttgtcagagatgacgcggcagtcctcgagctcgccgaagcatgagaaggcggagcggaggtcctcggcgctggcgccccagccgaggccgtggacaaagagcttcctgctggcggggtccgcctccacggcgcggcgcacggccgccatcgtggcggggctcgtctccgccgccgtgcggagcagcgcgacgagctgctcccgcgacagtggctcgagcagcttgccgatgtcctccacgtcgtcctcgtcgtcgccagcgccatcctcctcgtcctcctcggcggcgggctccggcgggtcgtcggtgatggggaagtagatggtggcgcggggcttggtctccgagggcgacggctcctggcggtggttgccggcggctgcctccgcagcgtcggcggactcggcgggatcggccttgcgcttcttcggcgccattgggaagcgagctagggtttaggcgcaaacttgcgaaggtagggaggggagacagtgatttcccggccggcctcgagggtcccaat

SEQ ID NO: 24231 - DNA, 3349 bp, Zea mays
gatatgttcgatgagccacctgtgcaccagtaatcagcttactcttggaattcttcactcttttacttgggattattttggtcttgtgtcttggactttgctgagtgtatgttgatcttctttgagtcttttaggtcttcatttgaggtgttgcatcctcagagcctcattccaatccacttgacatactgtgaactacaaaacacaaactctagtgaaacattagttcattagatatgttgttcattaaacaccaaaatccctaacaaatgggttagggtccattttccttacagagtgatgacagagggagtggtatggtgggttggagatccaccagagagtgagtttatccgtgccacccaaaattcagatcatggagcacctcaaccacaacgggagacaagaagcggtcaacgtcgatcggtttcccttcctgttgacgatgacagccagaactcaactatccacctccactcgaccacgccaacaacccttgcacatggccaacacctacacgtgaagtacaacaatcaaacatgtacgtgtttggacaatgacccctccaccctcatatgcatatatgcaaccaccaccacttgagcctacacatggacaatcattttttggtattataaacatgaatccatatggttccatagccttccatgtgtattatttttgtttggtcattaactgtttgtttgtcattcatgttatctcgctagttttatttcatatatttgtatagaaatatatatggaattggcccatacacaaatgtttcaaacgtgcctaaatattatgtctcgaggtaaatatatggatactttatcattcaacttgtttgaacatatgtgttatgaaaaaactttatatgagcatatatgtcattattgtgttccattccaatcacactttctatttgcatatgtgttttatatgtgattttggtgatcaaattatgtgtgaatctatagtattcattatgcaacgtgaattaaataagttacaaataaatcttgtcatttttttaattttcaagctcatgtaatatttatcactggaaaacactaataaaccggtcattaagtataatttcttggttggtttatacgaaaccgtttttaaaaagaaattggtcggtaaatttgaaaatcgctagttctggcttgattttttgttttccctaatgaccgagatttaggttaaaaatgaatcaccacttccttccgctccccaaagccttcgcggcttcgccacatgttgacaggcaacatcacaacaactatataaccaaaggtaaacaacagtataatacccaaaaacccattacatggtctctcaaagcaaattatttttgaagttttgatgtaaaaccatagtgttggagagtaccatggtatttttttaccaaaatatctttagttatcttaacatagtatttttggagtatttgaaacttcactccaacctaaagttttttgtctatgactagcttcttgcacatatatactaaataccataatttgaggtactttatttccaaacaaatattgctaacaatgctgtaaaaaatactatagtttactttatttccaaacaaatctttactaactattaagaaggtaacatagaccacttttgtgcccccgcctccccctctgctcgactcaattgcgtgcaccctcgcctgtcccagcgtccccgcccccgtctcctggtcgcgtccgcgaccgccgccatgctcccctcgccccgtgccgcgtccgtcgtgacagggatccgagaacaccccatggatgtgtctgggattcgaggcctcccccctcccttcccctcccccacccccatcggcgatgcctggatccgcgaccgccaccgtccaaccccggcctccgtctatgaccgctccgtcgtggcgcaagcgctggaggcatccacagggggctactgatggctgggacgggttcgtgctcaccaccgatgactgggacgtccatcgggggaccttcctagcgtggatggtgtcttcacacggaaacggcagctcgctggtgctgctgaacacccgtccgggtccggctgcggacagcgcaggcattggcagagcacctgaagctgcacctggggcaggtgagcctacggacctggtcgagttccgctggctgctgggtggcccgctggaccttcccgtccgactacagatccagcgccttcttctgcgaccgttttggcgtttgcacgagcaccggcacgtgtgcctgcgtcgacgaattcgagccttcgaaaccctgcgagtggcagcgcgggtactttgtggacgggtgcaccaccaggtctcacccgctgagctgcaccgcagacgatagtggcccccgcccgacgacggagcaggacgactcgtttctgctcctggacaacctgcgagggctcccttacagttccatcccacagcgaagggccacggctggccgcgcttcttcacggcggccgcggcgtggggaggcatcagctggatctggtgatggatgaagagcggaggggcccgacgccgcgtcctctgctcctcgccacttgactgtctcgctttctacagcaacattattgccaagaacatttttgatgatgtactgcattccatagcagcattattgtccgtagcagatgatggcaattcgctgctagcactagctgaagcttccttaacttgagcgggaatatcaatcttaactgaaggtctgattgctcgaattggagctgccagtgattcctttgggccttgggtttgcgcatccttcaactaaatcggtatggcaactgttagtgatccacaagaggctagcgttatgtatcataatttactaggacagaaatcacaggagaagttgagctcttccttggttggtattgtacatcctaaaaaaaaaaaaaaaacacagatggaactgcttccttccttgattgatcttgcatgcccgtgtgcgccgtggagggcaggccggagtcttggacgatgctggccgtggcagccgtcgacatggaaggtgctgtgtctggccgatctctgctgttcttcttttaatcgattttttgttttattaaataggcaaaagacattttaacgtatgcgtcttttttgaaaatagcatataagcgaagtcttttaaaataatggtaaattggcgaaactcacttgccataatggcaaaattctaaatttctcctcacgcaagtcttcggcgccaggtcgcaaccgtcacgtcacctcgccgcctccccccgcccgccctccagaaatagggtcagagcagaaaatatctctcttccctggtcgggtgatgagtta

SEQ ID NO: 24232 - DNA, 3512 bp, Zea mays
  misc_feature (783)..(783): n is a, c, g, or t
  misc_feature (2261)..(2261): n is a, c, g, or t
ttttgttccttttttctagagattaggcattgttctgaatatcccaccctttttttattagattgttggagatatgcaaggggctgtgtttggtggcttattgaacagtcctctgcggcccacagagaaaaggaaatatcaggtaagccatagataaattgcacattatacttgtgcataatagatacaagtaatgctgcatgtgcatacaagttgccattctctcatactaattaccattactttcttattgaccagggaacaaaccagacgtttgtgttcacaacaatacatggtgaacctagacttttcagaccaactggtaagtacaatttatacaagtgttcacaatggtatatcataaacttagacttatctaaccattgtataaaaaaactcgacctgcggggtaagacagtccttgagcattgtattaagaagacctcacacacgttgagggaactcctgaacccctaccccatccatacacagcggcaaagtaacctatgtgagaacgaccgcgaccggccgggccttagacctgtgcttcggtgtgggacaaacgaagcgaatttttaatcccagcctgaaatttgctcccacaaggagtcaaattcaggatctaaggagtgctacctagaccacctaactaactcagctggaggtctttttgctatctgactaatgtatgaatgagtgtctagaaaattgttgaattgtttcacaagtcagcagctatttactgttgtcgctgttaaaattaatcttaacatagacagtccntgaacattatcaatttatttgagccactagttagtggcgcatgaagactagtactggaatggtcccaccttgccttggcgtttagtctgcagtcaatcagtgtaaagtcatccttcatgaagatccggagcaacatcatccctaaaaattcaacggatttgtttgtcctacctgagacacaagcttctatgcgcgtatggctaagtgccagcgaagcgagggaggagaagaggagggagggtggccagcgaggttcgggcaccactgtgtgctgtgtgagcgagctccacccatggccctgccgcccttctccgtgcatgcaagctccaccccaggctttgcaaggattaaccgtgtgggcgagctctgccctccagcgtcgctgtatgggctttgggcctggccctgccctggacgctgacacgtgtgtggagacgccggaggacagtgagtttgttgacataatgaggggatctgatgagacatactggataacgtgtgcatatgaatgttttacaaacgcaacttcatagtgtgtcaaaattacttggaatttactattgattgaactttcaagtttgtatatgtctgcacccttttcagaattttttacactagaacaatatatgtaaaaaatattggttcaaagagcttatttgaaagtatatccaggtgcaaacagattctactatttgtgcttgaataatgctttagcatttggaggtggtggaagcttcgcattgtgtgttgatgaagatctgtaagtttcttatgctggaatggacttttgctctgtggggaaaaatatccttatgtatctaaattctgtttgactaggttacatggaagcagtggatcatgtgagacatttggaaactcatgtttggcatatagtccagagtttgaactaaagaatgtggaggtaagattgtttttcttatttcagttacatatagacaaggtttttaaatagtgggcaaagccattcagtggcagcttcatatatttagttataaaaggctatagtggatatagtagaaactatttcatttaggggtttaatataaaacatgaaatcattaattaatgatgcatagaatatgtaactaagaaaattccatgctaactacattatagggcataggagaacatgtctccaggtccattacttaacggtcactaaatcaatcatcatactcacggctacaaccaatgttcatattcaattgacgttcaataatcatttagtagttgattacttcatttattaactaaagaacatagtcatatgcagtaaagaatgaatatttgcctcaattaggattagtggcgctaaaattttttgtggctaagccaaagagtggtgtttagtgaagctaaagcgatggcaacaataccggaatagttggcgatggcaactatagcagactatttagaaccatgcatatgaacctgcatatgcatggttctaaataggntgctctagctgtggggatttagagccatgcatacaaaaatagcttacacatttgtctctgtagcctgtacttgatttggcctgccttattgttattgttggcttggttgacatttcttttgttcagttatggggattcacacattcatggagccgatcgacataaccgatgctagttgtcttcatttgtgacctggcaacagatggaaaggggcatgaaaatgctaggtggaactgttaggggaattcactgtcacttggggctggtttggtttcaagggaattggaggggattcaccaaaccagccctcggagatttgtactcccagttctcttgtttggcttgtggattgaattaaatattgagagctggacaaggaattcatatccttctgtttggtgagtgggatttggagtggtgccgtaagtcatgatgcgcacacatcttccacttaatgcccaatcaccacctatctctgtctaaacttctcatcacgtcaatattttcaaacccattaaacccttgtctcgaatctttccatttcctcccaccaattacctctaaccacacacaacgtggttaatccactgtacatgatcattgtaatgtctagtattcattcacttgattaacacatttcatatttgtacatgcctctctgttcagtgtaattactttgaatcaaaagaaaaaaaaaaagccgtgtgcctgaagtgcattcttcagcatggaaaaaaactgtgatgatagatattaaaacgaagtattgtgtgttattcagtgaattcatgcatatctgttactgggattcgacatgtttagggctggaaaccccatttttctaagggatttatattttctgaaattagttcattttccttggaaaaataggaattctttggaatagtgctaagtattaaatttgacgtggcctagggatggcaataggtgggcacccggtatgtggagtaaacattcagctgtactgatatccattacatcaaaatacacctattgacatccattacatcaaaatatacctgcacccgtaatgtctaattggcgtattttcacacatgcgctcacacgcgttgggcatccgttgggtggttgacatatgcaaatattacaatcttagaaaggtagcaccacacaccacactacaaataaaatgtaaaaacatacataaaatatataggtagtcaatttattaacacatatcttgtaatcctgtaatccgttgataattca

SEQ ID NO: 24233 - DNA, 2578 bp, Zea mays
gaaattggaccacacaattctaaactccaattcagtgacatccaaataatagaattagaattacatctcatttcaattcaatatcgacatccaaacggagcataaggttcttttcgcccactatgtccagtgtccactgaccccttgttgaactgtacatgactacagatacaaagaatccttcagcaattggatccaaaaacattgctttaactggccactaaaatgttaagaacagcaagtagatacagggcagaacgccagaacttattagctctgtttacaggaggaaagctaggcaggggcccactttgagaccgagtggctcatacagtattgtatctagtcttctcgctcaccgtccacacatttgcagcatggtctggggaaaaaatatgcggttgcaaggagtaccggcaaatgcggtcgaagaaaaggaaggggaaatggttgtcaaaatcacgagaacgtggtcgaagaagcacaagcgcgaaggagagcaagtgtctgctccgcaagagcgcgtttcctggcttgcttcacccactcggtagctatctcctctgcttcagttccatgtagcccttgctccaaggcatcggccgctgtactcaagtctccattgacaatcatgctttctactttgtttataagggactcaatgccatctccagagttatcgcctttaatcttgattgaagaagcaacacgtgcaacagcgtgtgccaggattccaccaccacctgctggtagaaggctgagatgtctgatagtttccttcaaggagttaaactgttgcttcaaccccatcctggtatctgatccataatctaaaacatcttctgggagtgatgaaaaagccaattctaacagtgaatctttgtcaatgccttcaacagattttcgcaatagccccacttctgatcggattggtgatccactggataaagcgtgttctaaagcaagagtgcccagagcaagtttatgaactgaatggctctgcctagcttcttcagatcgcgcatagaatgccatacacagagcatcaatattgagatttgcttcagcaatctgttcaatctgggatgctttctcttttgcaacagctgcagccagttcagcttttgctatctcttgagccttctcaatctgttggattgtttcttcacccttcctctgcagctcatcctgcaacgtttgttcagccttctcttgcagttcctttatggcagcagcattcttcagtttttctttctttagctccttatctagaattgctgcctcctctgcatacatcagttccctggccctggtgtctttcagctccttttcatacttctccttcaactttcttctctcttctgaatacatgtatgcatctacatctgcctgcttcttttcggcagcatgaatagcctcaatgatatcaagtacaatcttaccatcttcagaatttttttctcgaacaacttcatccccgctcttttctctttaatggttgcgtctttccaaagaccaggttcatcttgcagtaaataagtctcagcaagagatttctgctcaacagcaccagctattgtgagatcctttggtgagtctggatctgtggggtgatcgtaagtactaactgttgttggggttgactgtacaggagtaactgtgccatctatcttatcagtttcctgttcatgaggaacttcactagattcagtagcatcgatggcaactgtccttatatcaacagctggagaatcttcagatggcatttcagtatcagatccaggttcatctggaactggaattgtctcatgggctagggtttctgatttcttttcttctgcaggaacaagctgatccccattaattggaagctctggtgcccccaccccaccatttcgaaagtcctttgaagtatgagtctcattattgttctcttgaacaatctcagtgtttggtcctgacatgttttgtgtctggtcaaccttctgttcagaaggaatcttcagatcttcatataccacctttccgacatcttccttctttaagctaaaaggcaatgtcttgtccttaaattgaagatctatataaccaagttgatgtgcacctatagctgctgcaccgaccacaagagttccaagagcaagctttgaaacattacttcccgactgagaaggttgtccttgaggacctggggcagcattctgtgtagaactctttggagatgcctttgttgagttgcttctacatttaagaaatgttggactctcgccgaagatcggtctggggaccctcgcgagagaccgcagcgggcgcagatcccgcatgcaccggcgcagcatggtagccatggtaggcgatgtcagtggagaccaccgccggaccgtcccttgttcttctcgccgctgcagtgatgatgagggaggcggaggcctggaggagcagacgagcgatgcggtcccgatcgctcttgcacggccaccgcccagtgccgagcggctcgttgccggacagcttcctgaacggacgcttggagaaaaagctggggataatgccgaagcacgagcccggcccggccggc

SEQ ID NO: 24234 - DNA, 1740 bp, Zea mays
tcctaatcgacacgacgtgtcccacggaccacagcgacccacccacccagcgggggcggcgtcaggcgtgtgccatcaaccaagcttgaaacttcttcccttctctttcccttctcctcccgccgccctcgcgctctcgcttcctctccacgaccgtcacaaccaccgccaccgccacctcctcgcgcgggggcaactgtgaggtgagggcgaggcggggcgatgctggcgtggaaggagaaggtggcggaccgtctcgcccgcctgctcgccgactcccctgtctctccctcccctgctcaggccgccgtcgagccatcgcaggctaaatcttttccaccagaacattttactccccccaagacatcatcattatcttcgtatgtattttcccttctaccaacctcaaacacagggcatgagcagaattcaccttgttcagagactttgagaccattacctcctgaatcacttcctaaaaaatggagatggagtgatgtaacttggaaagatcctcccgtggaattgagtgaggagtctgggtctgaaagtgatagagatgaaaggaatgggaattttggtaacgacccagtccttcagtcatataggcccataaataactcaaatggcaatgaggaaacatcgacttcagattgtgtgggcactcttcgttatctaactgaaaagtctatgtttgtgtctccaaaactatttgcattctttcaatcttctctccctgggactttgaaggggtgccactgggtattgctatatagcacctggaagcatgggatatctctgagaacacttcttcgtagaagtgagaatattcagggtccatgcctattgattgttggagatatgcaaggggctgtgtttggtggcttattgaacagtcctctgcggcccacagagaaaaggaaatatcagggaacaaaccagacgtttgtgttcacaacaatacatggtgaacctagacttttcagaccaactggtgcaaacagattctactatttgtgcttgaataatgctttagcatttggaggtggtggaagcttcgcattgtgtgttgatgaagatctgttacatggaagcagtggatcatgtgagacatttggaaactcatgtttggcatatagtccagagtttgaactaaagaatgtggagttatggggattcacacattcatggagccgatcgacataaccgatgctagttgtcttcatttgtgacctggcaacagatggaaaggggcatgaaaatgctaggtggaactgttaggggaattcactgtcacttggggctggtttggtttcaagggaattggaggggattcaccaaaccagccctcggagatttgtactcccagttctcttgtttggcttgtggattgaattaaatattgagagctggacaaggaattcatatccttctgtttggtgagtgggatttggagtggtgccgtaagtcatgatgcgcacacatcttccacttaatgcccaatcaccacctatctctgtctaaacttctcatcacgtcaatattttcaaacccattaaacccttgtctcgaatctttccatttcctcccaccaattacctctaaccacacacaacgtggttaatccactgtacatgatcattgtaatgtctagtattcattcacttgattaacacatttcatatttgtacatgcctctctgttcagtgtaattactttgaatcaaaaaaaaaaaaaaaa

SEQ ID NO: 24235 - DNA, 2452 bp, Zea mays
agacttattcagtgtccactgaccctttgttgttctgcttcttgtcctcttccgcaaggaatccttcagcaattgcattaaaaaaacattgctttaactggacactaaaatgtcacgaacagcaagtagctacagggcaaaacttattagctttgtttacacgatgaaaaacttaggcagggcccccactttgagacccagtggctggctggctgctatagtattgtatctgatttttctcgttcaccatccacgcattttcaacatggtctgggaaaaacaagctttttcacagagtactgaaaccggcaaatccaagcaaacaaaaggaagaaaaaaaaagtctggccaaaatcatgagaacgtggtcgaagaagcacacgcctgaaggagagcaagggtctgttcggcgatcgctcgtttcctggcttgcttcacccactcggtagctatctcctctgcttcagttccatgtaacccttgctccaaggcatcggccgctgtaatcaagtctccatccacaatcaacctttctactttgttgataagagactcaatgccatctccagagttatcgcctttaatcttgattgaagaagcaactcgagcaacagtatgtgccaggattccaccaccgcctgctggtagaaggctgaagtgtctgatagtttccttcaaggagttaaacttttgcttcaaccccatcatggtatctgatccataatctaaaacatcttctgggagtgatgaaagagccagttctaacagtgaatctttgtcgatgccttcaacagatttacgcaatagctccacttctgatcggattggtgatccactggataaagcgtgttccaaagcaagagtgcccagagcaagcttatgaactgaatgactctgcctagtttcttcagatcgtgcatagaatgccatacacagcgcatcaatattaaggtttgcttcagcaatctgttcaatctgggatgctttctcttttgcaacagctgcagcaagttcagctttagctatctcttgggccttctcgatttgttggcttgtttcttcatccttcctctgcagctcatcctgcaatttttcttcagctttttcttgcagttcctttattgcagcagcattcttcagtttctctttctttagctccttatccagaattgctgcctcctctgcatacatcagttccctggactggtgtctttcagctccttttcatacttctccttcaactttcttctctcttctgaatacatgtatgcatctacatctgcctgcttcttttcggcagcatgaatagcctcaatgatatcaagtacaatcttaccatctttagaagttttttcacgaacaacttcatcacttcttttttccttaatggttgcatctttcgaaacatcaggttcatcttgcagaaaatatgtctcagcaagagatttctgctcaacagcaccagctcctgagagatcctttggtgcatctggatctgtggggtgatcataagtactaactgttgttggggttgactgtgtaggaggaattgtgctgtctatcctatcagtttgctgttcatgaggaacttcgctagattcattagcatcgatgggaactgtctctatctcaacagctagagaatcttcagatggcattttagtatcagatccatgttcatctggaactggatgtgtctcatgggctagggtttgtgatttcttttcttctgcaggaacaagctgatcctcattgattggaacctctagtgcccccatcccgtcatttagaacgccctttggagtatgagcctcattattgttctcttgaacaatctcggcgttctgtcctgacacgttttgtgtctggtcaaccttctgctcagaaggaatcttcagatcttcatacacctttacgacatcttccttctttaagctaaaaggaaatttcttgtccctatattgaagatctatataaccaagctgatgtgcacccatagctgctgcaccaaccacaagagttccaagaacaatctttgaaacattacttcccgactgagaaggttgtcgttgaggacctggggcagcattctgtgaactctttggagatgcctttgtagagttgcttctggatttaaggaatgttggactctcgccggagataggtctggagaccctcgcgagagaccgcggcgagcgcagatcccgcatgcaccggcgcagcatggtgggcgatgtcagtgaagaccaccgccccttgttctgctcaccgctggggtgaggatgaggaggtggaggggcagtcgagcgttacggccccgatcgccttgcacgggcaccgccccgtgccgcgcgtctgcggcggcggcggcggcggcaaggaagaggcgggggagcggcgcgtcgccgggcagcttcctgaatgaacgctcggagaaaaggtcagggatagt

SEQ ID NO: 24236 - DNA, 1118 bp, Zea mays
ttggccgctttttttttttttttatgcaaccattttgtgtagaattctaagtctcccaaactttaaagtcgcatttgccatggaacatatcgaagtcatcagaagcaaaacccaacaagacgagcgcatcctgattcctgaacatactagaacccatcctcctacagaatccaacaagacagtgtatcctgaagaacatactaaaccctatcctcctaaacaataacagctgccggtatccttttaccgggccttcctcactcctcgtcttcgtcatttagatcggtccagtcatctatgtttgtggcattcggagcggcggtctctgatgaacgcagctcttcgatctcaataaggaggaagggatcacagataaccttccctctttctaggaccctaggacagcctgcaatagggcactgcggtggttttttggtccttatatattgcattacagggtccttttcatagatatgcttgcaatccacacagcgaactggattcatcaattcaatcacaggctttccagttaatgggcatgtgacatttaagatgctcatctgagtgctagtcatgacaatgtcctcctgttcctcaccaggcataggctgaccagcatggtgaacattccagacagactccctgaactgccgaaagagtgggtggttctgttgtgatgccgatgacgcttccctaatcttgctagcctccaccccgatcaatgttttgaaatccgttggctgatcagatgactgatacactccaggtactgccttaattgcctgggccatggccgcgcagtcctcgtacgaagccaccaactccagaaccgtctcctcaagcttcttcaccttatcggactttccgtccctctcgaagtctacggcgagggacttcatggtgccgatagccttccgcatgtccgcgactagggcttgcgcgtccgacgactccacctcggcggtgttgaagagcttcgtggccatcgacgacatctccggcaatcttccgaagtcacgtccaacgagagagcgggtagcggggtaggaagagtttagagcgaggagaagagtgggtcgcgttgggacgcatcgggcccggcctcgaggtacccaatg

SEQ ID NO: 24237 - DNA, 5282 bp, Zea mays
  misc_feature (1060)..(1060): n is a, c, g, or t
tgtcatagatgcatattagcacatgacagtttcagagtcatatactcccaacacttcaaacgtgtagatgatcatgacgaaaaggctcatatgcaactcgacaaagaagagagatagttttatatgtgctcacatgagaggctcccacaaaacaaatgaagttaatagcaggagttttcaaaaactaagcccgccactcatggcacgacacatcttgtcagcatgctcaataacttttattcctacacattatgtaattttttatgtttataaattatgtcaatttaatttactatttataaactatgtaatttgtatttgtttttattaactatataattgtatttgctttgttatatacttagatggacttttttataaatcatcgtgttttattttaaatatgagtttgtaaaaaaaacctaacgagggggtgactagaaaaactatgctcttaatcatagcagtagatatagaccggcgataataaatatagaccggatgataactaagggcatatacattgatgtttaatatagaggttcttgagatgtttaaaggagcatttgtaaaaaaatatggagccatctctccgcgaagagactcctctagctcgtaacgcatgtagcaacagacacatcacttctcactgtacgaattcgtcgtctgttctatcgatccgatgttgtccaaacacatttaattatatatttattaatatactacatttatagactttccattatataataaagtttcttaattatcttttgtaattgaataaaactctattatataataaagtatttaattgtcacttgtacttaaagaaccgttttagtgtttctctactgtacatgccctaacgtgacgatagataatggtagtgacattagataaagctagtcgctcaagtaaaagcatctacggccgtgggcggaacgcctgatgatcccgcactgctcgagaagcgtcaattgaagaatcaaggctactttcctcgtttttggcgttgctgggtgaagtcctcgtggaaaacgacccaaagggtgccgaatangcgaataccgagtcggacccgcccatttgtataagaacatccaacgaactttatcaggtcacgagatcctgtagccatccataaagaaatactactacccggcaaccgcagcaaaatcctgcagtatcagatgcaatgcaaggacaaaaagaaatgctctatgaatatacaaaacttcgactatgcgggagagaatgcaagtggacgataaaactattcagataatccacatagaaataccaaagctagcagtactcgtttttcatagctttgtcctgttgctccatttctttccgttgctcctgtgtcctgtccgccagtggcaagcaagtactgttgcctccatacacagtcaagcaagtagaaacaccagagttcagttttcacacaccactgtcactaccagtagtcactatactcggataagcccatactgttacagcacgcccggttaatcaattctgcagagcgagcgtgcaggacccacctttaatggcgcagtcccgaccgcacgactttaccgttactggcccactgcgccttgactcctgctgccatctttatcggcagtcccagccagggcaggctccacagaggccgtagagttgtccccacctgacagtcacatgggctgcagccacgtcaccacaatggggctccgcacgtcgtgcccgccaccgtccgaccagacgaggaacccgtacaccggcgccgctgcgtcctgagcagacggcgcagtcaccgtcaccgcgaagctctgcttcttggcgcccggggagaagacgagctgctgcggcttcacggatacggtcacgccgccgctagacgccatctgcacgcgcgcagtgtacgttgccgaagcttgggcgccgacgttggtgaccgtgcgggtcaccgtcctggactggttgccgccgcggagcaccacggagatggacgggtagttgaggtcggagcccgaggggctgcctctggccttggcccctctcgccgtcgcggggcacgtcacgggcttgtgcgtgaccacctcgatcgcgttcggctcgtacccgatgctgcacatgaacgcgacgtagtcgtcctccccggcgtcgtagaccaggccggggtccagggccttgcccagggtgatgtggccggcgccgtagtcgaacggcgtcgcgccgcgcccgggctctgcctcgtcgcccacgggcccgccgcggttgtccgtcacgatggccgtagtcatcagcgcggaccgtatcgccgccggcgaccacccggggtgcgcggaccggagcagcgcggcggcgccgctggcgtgcgggcacgccatggacgtcccggacaggatgttgaactccgtgcggcgggtatcgccctccaggccggtcggacccgtggcgcccgtccacgcggcgaggatgttgacgcccggtgcgatgaagtccggcttgagaatctccgggacgagcccgttgggtccacgcgccgagaaggaggccaccacgggtgccggcttgacgccgacgaccgtgcccccgaagctgattgtcgccatcgggctggaggcgttcgcggcatacgctttgaccgcgtcgccctccttctcgcccaccgcgcaagcagggaggacgtgggcgtctccaaccagtccctcgccgttggcctccccgttagtaaggaccatcgccgcgccaccagcttccttgacgaccattcccttggccacgcgcgggctgctgccgcggtcgcagacgacgatcttgcctttcaccagtgaagggtcgatggagttctccatgcacagcgaagcggagagcccgccagtcctcccggggtagtacagaggcagcgatgagttggtaagaggcttgccggagtacagcgacacgccggacaagcgtcggccgtcgcccagcacgatttcagccgggaaattacggtcgatggtgccggcgccaacggtggcaagccacggggcgaggttggtcaccgacatggaggccggcccttcgtttccagcggaggtggccacgaacaccccccgggagacggctccgtacgcgccgatcgcgatcgggtcgaggtagaacggagccgtgacgccgctgccgccgccgatcgagacggagatgacgtcgacgccgtcagcgacggcgcggtcgaagcccgcgaggatgtcggagtccatgcagccggcgcccttccagcagaccttgtacgcggccaccctggccttgggcgcgacgcccttggcgaccccgggcgcgtagccctccatgctggcgccgtacgcgacgctgcccgcggcggtggtggccgtgtgcgtgccgtggccgtccgcgtcgcggggcgacatgaactcgacggagccgttggacgcggcggccgaggcgccgaagcgcgcggcgtggccctgcgagaagaagcgcgcgccgacgagcttcctgttgcaggacgaggccgggaagccggggccggcgtcgcagccgccgcgccagcgcgcggggacgggcggcaggttcctgtcggacaggctgcggcgctcgggccagacgccagtgtcgagcaccccgacgatgacgtcggagccgtagtccgcgagggaccagaggccgaggcgcgcgcggaggcccatgaactgcggcgaccgggtggtgtgaagcgggcgggcgcggtcctcgaacgcggcgagcacggccgggtggcgccgcagctcctcggcgcgggacgccggcacggacgcggagaagccgtggaagacggtgccgtagacgtggagcggccgcagcggggtggcccccggtgccgccgaggcgaacgcggcggaggcgtaccagtgcgcgtgggtggggaacacggacggcttggcgctgtggtccacgcggaagatgtacgtcttccgcgcctcctcctcctcgccggcgccgccatctgctcgcagtagcgccggcgccgtcaacgccaccagcgcgaggccgaggaggaggacggggaacgggtagcgaggaggactcgccattggtgggtgagcaagcgagcgagacagtgtgtgtgtgagtgagtgggagtgggagagtgatggcaccgtgtgccgatgccgaggacgagcggtggaggcggcagcagtgcgcggggagttattaattgcggggtagtgggggtgttggggcagcagcagttttggcctttttgcgccgcgctggccgttcgacgtgggcttgggttttcgtacgtacaacgacagcggcggtagtaaagtctttcgccccgctgccagtaccaacgtccccgataaatggccgccgtgggttttcagtcagatgggcgtcagggtggggaaaaggtctgggaatggtcgtggggcgctggtagctgccgccgtgtgctttccgtgcggatcagccacgtctgcggttgtgattgtgagcaggggagagtgggagcgacgcgaccagcaccagctagcgagaccgtgggtgggcgtcgccatctcttcaaaaatgagcggtgcgacgtggcagtaccgcagggcgcgggttctctctcgtgttagctgtgttgatctgatcgttctcgaacatctgggccagtttctatatcggcacaagaggatacagctgctagctgcatgaatatatgctggaggtcgcgaggacctgtcactttgctcgtttgtgatgatactgctgctaagctccctcggggtcgtatcgtagcctcgtagggtcccaggcgatggcgatacccatgtgtggctttgcctttgcgacaacacgagcggggacctccggacctgaactgagctggccgcaaacgacgaaggataaacgtggattaggcatatgtgctgcattaacgtgggcatcggtcctaaacccgatcagggagcggagacgggagcgtgctttggcggtaaagcgagctttggggctctagccacgctcatttttcccagtggctatggcatctatcgaaaaggcgttactgaatgatgaggtccctgcccaccgaagtggtgaccgcttcattgactccgtttctttgttccctgccggtcacgaggcgccccaattgtggcgcaaaatcggtgactttttggttggaacgggcaggggccggccgacggggccctccctcgatgtcacttggtcagggtttacaaaaactggtacaaaaacctagttttcggtacagtttctcgttcccggttcggtttccaaccagtattttaaaa

SEQ ID NO: 24238 - DNA, 1492 bp, Zea mays
gcgtgacactaattcatgcctgtaaaacttatagcagggcaagaacatgctttggtagtttggtgaatcagaattaagagaaactctaccaaacccttatttaaacactacagatttaaagaggaccttatttgaaaactccagcactgggatgttccgatgttcggtgtggtgcccattagttttgtgcatcactatagcattatgggagacctaacctaatgaatatttgcaaaactatttaatgtttgttatgttatcccaaaaatacaaatctaaaaagttctagcacagttgctgtagttatcgcaaaactacagatttaaagaaattgtgatcagcctttctcctgcttgaagtgatgcatgatctgtgcagccaagatgtcgacccaagtgtccggcacgccaggcaggcaccaatgcatgcagtcctgtccatagacagccaccgcgtccttcttgccgagccagatagctggatgggcgtcagcacggaactcgctcatgtaagtgaggttgagcaactggatttccgtgccagccagggcttcctgaattgctaaattcacggttctcgcttctttgttcactcccccaaactggggatcaaaccaagaattgagctcatgctcttcaagacgtctatcagatacacagctgccattgtgatccggtgcccctcttggaactgcctgggcgtctgcgccccacctcatgctcttcaagacgtctatcagatacacagctgccattgtgatcccactcacctccatagaagtgcctaggtgactgcgtgcgccacagcttcagtgttttcctaggaacctccctttcgatgtaagaagcaatacttttcaggactactttcagtccgttgtgcatgtcaagtggaggttcaatcggctttccccctttgtagaaaacaaggggagtgtcttttgggaatttatatctatcccacctgatatggagaaatcagaaatgtgtaaagcgttacaactggaacaataatgacaaattagtatattcatgaccaacatattcatcaagaaaatttacagtaacaattgaaaataactgaaggctgttcttgttcaagaaagacccttttatgaatgagcatgacatcaatatgaagctgagagctggaaccgtactactgtaagaaacatttgaacaatctcattgcctccaactaaggtggtgtttggttcgccgaaatgtaacgtaaatagattacatagggtaatggataccgatacttctgttcggttgagctttttctagtaatactatatactactatccaatctaattataactagtaactattatcgccggtaagagatctcattaccattcccttaacaaggtctgaaccaaacagcacctaagcaagaaatggtattttgactttactagtaagaatacttaagttggggaaaacaaactcaccagtgtccagtgttgaaaattagaacatcatagaa

SEQ ID NO: 24239 - DNA, 1144 bp, Zea mays
acataaacaagagcctttatatttttgatacacataaagagagcgacaacctcggtgcggtgacacaaaaatatgccgtgccatcctcttaacttgtccaagtatgagcatgcagacctgatgctatttctgactcatggaattcatcttacattgtacaaggcaataataatataggaaacacatctgctctaggctatgtaagtttcctcatcaaataactgcacaagtgtgtatatcatgacactatacaactctcccgaacagatatttccaacggaaaattacagcactttcggaaatcccctgttactttgttagtttcaacttctccatcagctccttgtattgacgataatgttcccgcttttatctcatgtggataaagttatgatgtgtgtgtgtgtatgtaagtcatcatcctataaccaaccaaccgtctcgtcatcctataaccaaacaagtgtttttgacatgaagcagaagatgctctccgcttccaaactctactgctgtgactgtggccactggccagttttgttatcagaagtgtcacactctgctttccaagtaatcaagaatcaaaaggatccctccatccttcatcttcccttacagccctgttccacctctccttgaacttctccagctcagccgatgattgtcttcgtatgtgggtcctcaaatccaatgatcttcgaggtgtctgcgtcaacaagatgtcagtagcggcacatgcaaattttattgaacgatcatgaattcatgacacctaacattactatcatgcaggtatatgccaactagggtaaaagaaaagcacacaaggaaaatcgatgctctggtagtttttttttcaaacaaagtttggatgaatcagtacacttcatccttggtcctaccggactccaagtttctaaaaaaatagtttgttgctgagatgtcaagcaccttgctgctaagtgatggccctcctaatgatggtatcccttgatgaactacatactcactgtcaataacaccaactttctctgttcgatcaccctgagcgcaatatccaagcttcatgtcaagaccccatccatgaataagatcattcctgtacatggaggtcctttgctctcgtcagaacaattcatactag

SEQ ID NO: 24240 - DNA, 1463 bp, Zea mays
gtgtttttgacatgaagcagaagatgctctccgcttccaaactctactgctgtgactgtggccactggccagttttgttatcagaagtgtcacactctgctttccaagtaatcaagaatcaaaaggatccctccatccttcatcttcccttacagccctgttccacctctccttgaacttctccagctcagccgatgattgtcttcgtatgtgggtcctcaaatccaatgatcttcgaggtgtcttgctgctaagtgatggccctcctaatgatggtatcccttgatgaactacatactcactgtcaataacaccaactttctctgttcgatcaccctcaatagtcaacagacatcctatcaaaatatcttttaagactgttaacatatattgagaacctgagcgcaatatccaagcttcatgtcaagaccccatccatgaataagatcattcctgtacatggaggtcctttgctctcgtcagaacaattcatactaggccgattgtcgtatattctcctgtgaacttttgccatcttattacggattgtgattcgatggtggatatcagttgatagatcagggtccagagcaggttgtgttatttccaagccttcggacaccattatatcaagattcttctagggttgaagttctccactccaaggtcttcatcccatagaaaaatgaaatcatagatagccatgacatcaggatgcagaaaacgcttagcaaaccaccattttgtttggttgtgagcaaggatgtgtatggccttatcactccactcaagatgacgccatccatctacatttccatcataatggaagagcatgactgcatagttttccttcagaaacttacgggccatagtgtcaatgttttttatttgggagatgccgactgccatggcgaggagagcactgtagtcactgtttttattcttgtgggtggaagcagtgtcgtcctcccagagcgggcggagggacatgtcggagtggcggtggacaatcccgcgcggcaaggagtgggcgccgttcctgtcggggccccagcgaatgcgattgcggctgcggatcgcgttattctcttgcgtggcagaggcaaagccggccttgccgagatccaccttgaggtggtggtactggatctggaggcaggcgaggaggacgagtgcgacgaccgccgccacgacgccccagcggcgcggcggctggtgcttcatgtcgtcaagggcggggccggcggagagcttcggggctggtctggtctgggctggtcttcaaggttctggagggagggttctagttctttctagaaggtgaggaaggtggcgctccgtctccgcaggggagaggggcaggggccggggacgaggaagaagaagaggaaggtccccctgtccgcaaaaattgttcccccccggccccgtcgccccccggtccgtgatgagtgaaatgaacc

SEQ ID NO: 24241 - DNA, 1158 bp, Zea mays
  misc_feature (1144)..(1144): n is a, c, g, or t
gggtaccgggcccccccgcggcccccccttttctttttttttttggataaaaccaaatggtgacggatttcattgcttccataattctcagtcaacaaatgggacagatttcttcttattcttctataggtactaaaataaaccgacttctagaatcacccttgtaagtagtagtagatcatggaaacagatttcacataattcaatatcgtaaataagttccgcacgaattaactaaaactacagcaaacaagcaacgcaggctacacaggattggcatacataatggtagcgatgcccttgtcctactcccaggtgctattctctgtaaacatggcgacgtatgtctgtctgataaaacacacactggtttacacgcaagttcaccacaaaactttgcccaccttttaaggtaaaaaaatggcgtgccatccctttttttttttgcttcaaaggctggagcatgcctttattgacgactcacttgtttgctatcatacgatctggattgggtatccttatgccgttcaagatataaccgccaaaagcattcatttgcatgtgtggatgggtgcgagatggaaggacctggtattcacgtagccagggttcagaaagctgcaatccaatagccatctttgataactgcaagctgtgcatgcactttgcaagaggctccacatgctggtgatatatagcaaatggggctgaataagacaaaagtggaagcatatcagcaacaagacgctctacttcgtggccaggggcagcaacaatcaaactactaaagccatgttccttccaatatttcatcttttctggtgacggtgcttttccaggtttaggaggttttgaagcatttaaggtaccgtcgctgtctttgccacctaatgaagaattctcatcttgaacaagatgctcatccaaagaaggctccgagacctccatatcacttggctgatctgttgataactgtgccttctcatctggcactgctgtgtccacttgctgtgccaaagatgattgtgcatcctcatctacagcaggttctatcatctccccttcagcgctactattgacaacagaaggggtattcccagaactttgcattgaacatagggcactaattggcgcctgaacaatnctgcggacgcgggg

SEQ ID NO: 24242 - DNA, 2968 bp, Zea mays
  misc_feature (2384)..(2384): n is a, c, g, or t
  misc_feature (2432)..(2432): n is a, c, g, or t
gctgtggttctaagatatagaaagtggtttctaagtaaatggttcttaaaaaataaattagagaatgaaatttagaaagactcttataggtgctcaattcattctatcttattatctaactcaaacttcttttcgtaaacaatattgtctacggtgtacaataacgtattacgtgatcatttacacgatcaaccggcggagaccatcttaatgcagaaaacaacatacaaaatattttctgcatacaaaagatcaactggagaccgtcttaatgcagaaaacaacatacaaaatatcttctgcatacaaaagtgcaaatatggtaacaaactagctagtagcacgcacaggatcactctctcgtcgaactaagcctaaacattcagctgaggaagaccgcccagaagccgccggcggcagtggccacagccgtcgcccagacgagcgcgccgacgacgggcggcatcagcggcgccaccctagacgcgaacatggccgagagcagcgtcgtcagcgtccacaccgcggctctgatgatcccgacatccctgcccctgccggcggccccccgcccctgcagctccagctcacggaggcagaggaagagcagcacgaggatggagtccgcggagagcacgaacgcgacggagctcgcgtcgccccaggagttgtagatggcgaggcccgagttgaaggccagcacgcccaagcctgccttggtcagtccggcatactgccggtcgtccatgtcggtgtaggcgacgcggaggagacggtggcgacgatccgacgacgcgagagcatcgggtcacgcctgccgactgggttattgaagattgttcgaccgaccgaggcattccggccgggtctggtaccatgtttatatagcagtggcatgagaggtaagaccgtaagagagaatacccgtacgcgccagctcagggatgacacagacacagatccggacacggcgccgccacaccagccgcgttgaagccgccagggttttcatttgacgaagcgcgatgcgtgttcaaacttcaaacggcattcgtcctcctgatccgtataccttgtttgcccgtatttacgagtaatgaagacgggatacaagaatctgtgactcaccaacagtgccctaacaagtaccttatattaaaataaatgcaagacttggaaaaataaagtccaacagtgtcttgttttttttaaaaaaaataatagagcaccatttacagtgtcgagacagatgataactgattgatgtttgacaaccagtgctaggaatatgggtcagaattttcgggtcaccgtgcatgggccaaaaaatagaaattcaaaccacggtccgacacgatataatatgagtcgggctaacacggtccggtgggtctaggccaaacctcaaattgttgtccgtcaagcccggtatggcccgcgccgatgggccaggtttggatcgacacggctcaataaagcccatattgtttaatttctttaattattaagttatgtactttatgtggttgtaaaattttgattttatgtggtcaaatatataggccgacatggcccacgaaagcacgacatggtttagatccagcctgaatcactatttttacgcttcgagctagcataatataattcaaaagttttttgagaccaattctgaggactattcacatctattcggcccatgctccttgcaccaccagcccgcacacctgttcaagctttgattcaccgtcgccgccccaccctgccccaccgcagcgagtgagcagtagtggccaaggtcggaagcgcaacactctagaggattcacagattctagcgaaggggcgatagtaagcgccaggcggcaataggcatctttttaactaggcacgacagtaaatgacggttggtcgataaaatcgtaacggttggtcgctaaagacctttagtgatctataaatatgtcacttgactttagtgaccgacatctttttatcgaccatctattgctaatattgtatatttagcaaccaactgtgggttgttgtattatacatttagcgatcaaatataggtttttatactatatatttagcaaccaacagaaagttatcctatttacagttattattaataatgatatatttacaaaagcaccacaaatcatagatttttatacccataatcacatagacataaaaaacagaaggagtcagcaacagtaggcgctcataaatctagggttagtggggaacttttgttgtaatggaaatatagaaattatccacatgagctcttggtggatattgggggaggggcagcagcagagagtgagcagtagtggccaagctcgggaagcgcgacactccctaggggttcacagattntggcgaaggggcgatagtaagcgctggggcggcaataggcatcttttnagctaggcgcgacactacatgacggtttggttgctaaaatcataacggttggtcgctaaagacctttagtgatctataaatatgtcacttgactttagtgaccgacatctttttatcgaccatctattactaatattgtatatttagcaaccaactgtgggttgatgtattatacatttagcgatcaaatataggttgttatactatacatatagcaaccaacagactgttgtcctttttacagttattattaataatgatatatttacaaaagcaccacaaatcatagatttttatacacataatcacatagacaaaaaacagaagtagtcaacaacagtaggcgctcataaatctagggttagtcgggaacttttgttgtaatggaaatatagaaattatccacatgagctcttggtggatattgggggggggagcagtagagaatgagcagtagtggccaaggtcgggaagcgcgacagtctcgaggggttcacagattctggcgaaggggtgatagtaagcgctagggcggc

SEQ ID NO: 24243 - DNA, 2295 bp, Zea mays
ctcgagtttttttttctctcgtgtttttttaatctggaatactgggtgcaagcttgtcattgcattcgaggcgtaggaacataacaagctggtcgacgtttccacacaacaacgtctggcaagtaagttttgagataagtacgacctacgaaaccagcaacggcacatgtcgaaactgaggatagctctcccaagatcaatgagacatcagaaaacggtaagtttcaatacatgatatgacgaagtttacaacaagcaaacgcatggtaactggaaacatctggatcccagagatttcttcagggtcagtcagtcaaaactgagacgagaatgtaaataaatccggggatggccgagtcttctatttgcggcgcttgtatcttgctttgctattaaaagcttttgattttttgtgcgcgaaattgttgtttttcttcgaggagcgtccctgtttccattcactcatatcattctggaacagctcacgcatctcctcatgcctgttaggagtcttctcagaatattgtcttgcattcttctctttctttcctttgcttgcaccaggaccccgtttgctagccgccttcaatgactttgcctttcggtaagcagcatccactagagactggcctttcttcagtttcttccctctatcactttcctttgcttcctcgtcatcttcatcctcatcttccagcatctctcgctgggcctctaatcttcggcgtttcttccttggtaggtccttctcatgctctcgtctctttttctccttcagacggaggtcttcagcctgcttagcactaataactccagaggtactcttaccttgacccaaagattctttagcagctgctaccaaaagcttcttttccctttcagtagcaaaccaggttctctttggccgtgagtatatctcatccttatgagctatcatattttctgcctttgcaatttccatttcagcttttctcgcttctctttccaccctttcttctcgaatgatgatggaaatctgatcttctagttgctcaatcagttgtgcacactcagccacaggtttctctgcaacaatgcggcttttcagttgtgaaccagccttctttgcaattgctttcaagagggatctatcatcatcggttacaaatgttacggcatagccttctcttcctgcccgtgctgtgcggccaacacgatgaagataagttttcacatctcttgggcatgcaaaatttattacagtctgaacaccaacaatatcaatcccacgagcagcgacatcagttgcaatcagaaaatctacttcttgtttcctgaaaagttccagagcctcaagccgctgggcctgtgtaaggttgccatgaagttcagctgctttcatgccagagagaccaaatattatttttaacctgtgtgcggattgctttgtgccactaaaaatgataacacttcgcttgaaagtcttcaaacagagcgcaagaagaaccgcttcttgatttgactcacgtgctcgtcgtatcctaacaacctcttcagtcaatgttgcaggccgcttcagagaaggatcagcttcaagacgtacaggtttgtttagtgaaagttttataagttcatcaatttcttctgtcattgtagcagagaaaagcatagtctgcctccttttaggacacatacgaatcagttcttgaatttcagcactgaaacccaattctagcaagcgatcagcctcatcaaggatcacaacagctagatcttcaagcccaacagaaagagaattgcgcagatgatctattatgcgcccaggggttgctacaactatgtcaggcattgaccttagagcaacttcttgaatcttagttgaaagacctccaacgatgagacaacatctgatatcagtgaattgggctaacttctcaaccatactatgaatctgagcagccaactctctggttggagtaagaataagcaccctaattgcaggtacacgctttggacgaaaaagtagacgttccaacacaggcaaagagaaagcagctgtctttccagatcctgtaatagcactaccacagatgtcccttccagttaatgccagaggaatgcaagcagcctgaatcggagttggtttctggtagccaagtgcttcacaagctcgcactagcggacgagacaagttaagctcaaggaatgaatttgcatgaaatgatgcccgatccgaagaagagaaaaaattagaaggatcaactggtccactcgtgtcattctgatcgaccgtatcttcttcctcatcccggccgg

SEQ ID NO: 24244 - DNA, 839 bp, Zea mays
cgccatcctcatcttccaacatctcacgctgggcctccaatcttcggcgcttcttccttggtagattcttctcatgttctcgtctccttttctcctttagacgaaggtcttcggccttcttagcactaataactccagaggtactcttaccgtgatccaaagattctttagccgctgctgccaaaagtttcttctccctttcagtagcaaaccaggttctctttggccgtgagtatatctcatccttatgagctatcatattttctgcctttgcgatttccatttcagcttttcttgcttctctttccaccctttcttctcgaatgatgatagaaatttggccttctagttgctcaatcagtcgtgcacactcagccacaggtttctctgcaacaatgcgacttttcagctgtgaaccagccttctttgcaattgctttcaagaggcatctatcatcatcggttacaaatgtcacggcatagccttctcttcctgcccgcgcagtgcggccaacacgatgaagataagttttcacatctcttgggcatgcgaaatttattacagtctgaacaccaacaatatcaatcccacgagcagcgacatcagttgcaatcaaaaaatctacttcttttttcttgaaaagttccagagcctcaagccgctgggcctgtgtaaggttgccatgaagttcagctgctttcatgccagagagaccaaatattatttttaacctgtgtgcagattgctttgtcccactaaaaatgataacacttcgcttgaaagtcttcaaacagagtgcaagaagaatggcggcggggcctgcctcgcggcctcgtcgt

SEQ ID NO: 24245 - DNA, 1546 bp, Zea mays
atagaaaccaaataggcctaaaatttaagatggtacgaactacaaaacggcaactctttttttttttttttaagagaccccagaaaacggtgagtttcaatacatgatatgagaatatgtttaaagcaaacttgaattaactgcaaacatctggatcccagatatttcttcaggatcagtcagtcaaaattgaaacaagggaatgtaatataaacccggagatggccgagtcttctacttccgcttgtaccttgctttgctcttaaaagagttccttgattttttgggcgcaaatttgttatttttctttgaggagcgtccctgtttccattcactcatatcattttggaacaggtcacgcatctcttcatgcctgttcggagccttctcagaatgttgcctttcattcttctctttctttcctttccttgcaccaggggcccgtttgctggctgccttcaatgattttgcctttcggtaagcagcatccactagagattggcctttcattggttgcttccctctatcattttcctttgttttctcgtcatcctcatcttccaacatctcacgctgggcctccaatcttcggcgcttcttccttggtagattcttctcatgttctcgtctccttttctcttttagacgaaggtcttcggccttcttagcactaataactccagaggtactcttaccgtgatccaaagattctttagccgctgctgccaaaagtttcttctccctttcagtagcaaaccaggttctctttggccgtgagtatatctcatccttatgagctatcatattttctgcctttgcgatttccatttcagcttttcttgcttctctttccaccctttcttctcgaatgatgatagaaattggccctcctggtgccccatccggccgtgcacactcagccacaggtttctctgcaacaatgcgacttttcagctgtgaaccagccttctttgcaattgctttcaagaggcatctatcatcatcggttacaaatgtcacggcatagccttctcttcctgcccgcgcagtgcggccaacacgatgaagataagttttcacatctcttgggcatgcgaaatttattacagtctgaacaccaacaatatcaatcccacgagcagcgacatcagttgcaatcaaaaaatctacttcttttttcttgaaaagttccagagcctcaagccgctgggcctgtgtaaggttgccatgaagttcagctgctttcatgccagagagaccaaatattatttttaacctgtgtgcagattgctttgtcccactaaaaatgataacacttcgcttgaaagtcttcaaacagagtgcaagaagaacagcttcttgatttgactcacgtgctcgtcgtatcctaacaacctcttcagtcaatgttgcaggccgtttcagagaaggatcagcttcaaggcgtacaggcttgtttagtgaaagctttacaagttcatcaatttcttctgtcattgtagcagagaaaagcatagtttgcctccttttaggacacatacgaatc

SEQ ID NO: 24246 - DNA, 2412 bp, Zea mays
  misc_feature (2408)..(2409): n is a, c, g, or t
atccgaaacggctgaaccgaggcgggcacgtgccaaccacgtgccttacccgccccgcccgcgtcgtccaggtccaaggtccaactcgcgacgcatctcgatggccgccaccgacgacggtgccgtggactccgcctccgccgcggccgcggccagggccgtcgaggaggcgcgcgcgctgctccccgccccggcgccggactacgacgacgaggatctcgaggagcgcgcgtacgaggcggctgagaaggtcatcgtgtccatctcgggcgggccggacccggaggacgtcgacggcgatggcgacggcgcggagctctgctcgtcctcggggtcgtcaccgccgcccttctcgtggcggaagctctggctcttcacgggccccgggttcctcatgagcatcgcgttcctggacccgggcaacctcgagggcgacctccaggcgggcgccgtcgccggggacacgctgctgtggctgctcatgtgggccaccgccatgggcctcctcgtgcagctcctcgccgcgcgcctcggcgtcgccacgggccgccacctcgccgagctctgccgcgacgagtaccctgactgggcgcgccgcgcgctctggctcatggccgaggtcgccatggtcggcgcggacatccaggaggtcatcggcagcgccatcgccatcaagatcctcagccgcgggtacctgccgctctgggccggcgtcgtcatcaccgccttggattgctttatttttctttcgctcgaaaactatggggtgaggaaactagaagctgtatttgcacttctaattacaactatggctgtctcatttgcattgatgttcacagacactaaacccaacgggaaagacttgttgattggtattttggttccaaaattgagctcaaggacaataaggcaagcggttggggttgttggctgtgtaatcatgccccacaatgtgtttcttcattcagcactagtgcagtcaaggaaaatagatcaaaataaggaatatcaagtccgtgaagcattgagatactattcaatagagtcaacaatagcattagctgtctccttcatgataaatctctttgttacaacagtttttgcaaaaggattttatggaagcaaggaagccggtaatattggtcttgaaaatgctggacagtatttacaagagaagtttggtggaggattttttcctatactgtacatctgggggattgggcttttagcagctggacagagtagtactataacaggaacttatgctgggcagtttataatgggcggatttctgaatttaaggttaaaaaaatgggtcagggcactgattaccagaagcttcgcaattgtgcctactataactgttgctttgttcttcgacacatctgattctgcactggatattttaaatgagtggctcaatgtgctccaatcaattcagatcccttttgcactcattccactcatcaccttggtttccaaggagcaagttatgggagtcttcaaaataggccctaacacccaagctgtaacctggactgtagccactctgctgatcactatcaacggctacctcttgatggatttcttctcttctgaaatccgaggtcccctatctggctcgcttctctgcgtggcggtcctcatttatgcctcgtttgttctgtatctcatattgcggggcaccgagctgtccgagaagattgccaaagcgatccgcggcagtttttcatgacaatagtcatcagttttggtcttacatagtgacaagaagtttctcagacagaagagacacgtatcgggagatactaccacacccggtctggtgactgcggactggatactacagcacaccggcgtacactgtacagtgattgcttggaagggtccacccatcagttgctgcgaggagcttgcaagcctgtagcagctgctcgttgcatctgctccaggccggaagtaacacatagagatgaacgaattgctgatgttgtacttgaacattcagagaagacaggttctctttgcaaacaactctctcttttttttaaccagtgaagtaaccagaggaagaggacgttgaaaaaaaaaaaaaaaagtcatttgtattctgtttaatttgcacaggagggtatgtgctcaaccatttttcagggaagccgttggattacaggggtgtttgaatgcactaggaagctaatagttatcggctaaaattagctaaagatatacaaacaaaactattagctattttagtaaattagctaatagttagctagctaattccactagcaattttttagccaactaattgtacgtgatttcattgggcttagagcaactccaacaacaccactaaatgtaatagccaaaatcttagaaataaaataggatccttgattatatgnnttt

SEQ ID NO: 24247 - DNA, 901 bp, Zea mays
  misc_feature (759)..(781): n is a, c, g, or t
  misc_feature (783)..(784): n is a, c, g, or t
  misc_feature (786)..(786): n is a, c, g, or t
  misc_feature (791)..(791): n is a, c, g, or t
  misc_feature (799)..(799): n is a, c, g, or t
  misc_feature (809)..(810): n is a, c, g, or t
  misc_feature (819)..(819): n is a, c, g, or t
  misc_feature (825)..(828): n is a, c, g, or t
  misc_feature (832)..(832): n is a, c, g, or t
  misc_feature (836)..(836): n is a, c, g, or t
  misc_feature (845)..(845): n is a, c, g, or t
  misc_feature (847)..(847): n is a, c, g, or t
  misc_feature (855)..(857): n is a, c, g, or t
  misc_feature (861)..(862): n is a, c, g, or t
  misc_feature (865)..(866): n is a, c, g, or t
  misc_feature (871)..(871): n is a, c, g, or t
  misc_feature (877)..(877): n is a, c, g, or t
  misc_feature (884)..(886): n is a, c, g, or t
  misc_feature (889)..(889): n is a, c, g, or t
  misc_feature (891)..(891): n is a, c, g, or t
  misc_feature (897)..(898): n is a, c, g, or t
  misc_feature (900)..(900): n is a, c, g, or t
ttcggccgggaaaaaaaatgatcctttcctttcctgcagcagaaagcaggtgatgacagcctgacactctgctcatcacacagaaaattctcagctcacctcccaagcttggaacatatacccggggtgcggccccggccggcatatgttgcaggttggctagggattgccgccccagctggctggttatatattaggctgtcgccgccaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacgcgtccaggttgcagcagtggagttgccgatgagaaatttaacagcttaaatgtgtgcctgatttatatatacagaagcattatattactaggcttgcttaaactgttctcatgacatctaatatcatattattatagatgtgacaaaaaaaaaaaaaaaaaaggcccctaggcaccnnnnnnnnnnnnnnnnnnnnnnntnntntaaancggcggcncgcggggacnncccttttgnctctannnnggtnattnagctggggnanttggcaannngttnnggnnaatgntcctcnaattccnnnatntncggagnnang

SEQ ID NO: 24248 - DNA, 1248 bp, Zea mays
gcacgagaccattacctagaacatcctaatcgaaaagctctacatacctttgagatcgagaggtgctcccatggtgtggtgatgatggaacgtgtgaactaactgcttcttttggttccaaactataagacggtttggtttttccggataaattgcagaaagcaggtgatgacagcctgacactctgctcatcacacagaaaattctcagctcacctcccaagcttggaacatatatgttgagaggaagtgggattggcatatgttgcaggttggctagggattgccgccccagctggctggttatatattaggctgtcgccgccaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacccgtccaggttgcagcagtggaggtgtggttgctgatgaaggatgccacagtggtaggggccggctcccctagctctgggaaagcagttgtagcctgttgagcgttctccatgccgattataggagtgggttatctcagggtgagggttggacgagcggggcgaggaggagccgtgctgctgctcggctggagaactcggcaaaaggcattgaaatttttcatgggagatgattagtgcaaggtatggcttgttcgattggacttatacagatttgtgcagcagcaaaggcaggagcctcattagtgtgcctaccaatgcccactttcctggcttcagtggtgactcattgaagatgtggattttcctgcagtgtatgtgaaatcattgctatctcagaggggttgatctcagctacctgataagaagcactgctccatttactgagcatatgtagaagctgcagcccctgctaaaggggatgatgtatccattccattctgtagcaagaaatatgacgacataattgtcctgtcaaaaaaaaaaaaaaaa

SEQ ID NO: 24249 - DNA, 1299 bp, Zea mays
caatctcgcagtcctttcttcctccgacctcctcagaccgcagcaaatcggacggtcggaccaggggatagggttccgccgcgcctctccaaccaggcgccactcgccagggcctaggctggtcatggaaggaaacgccgcagccgggaagaggtcccggacggagacggcgaacggggctgccggcggcgggaagcgctccaaagacatggagtcatttcaaactggtctatcaagcaaatcgaagccttgcaacaagtttttcagtacgattgggtgcccgtttggtgagggatgtcgttttctgcactttgtccctggcggttacccggcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagttacaggcgtcaagctctgtatccgcgaccacgagtctagccccaacctgaagaacattgagctggaaggcaattttgaccagatcaagcaagccggcgaaatggtgagggacctcatcgcgaccatcagcacgagcatgctggcgaaaaactcatctgctgccgtggctccatctggaggccgaggcggtggtctgggtggcaagagcaactacaagacgaagctatgcgagaacttcgtgaagggtgcttgtactttcggcgagcggtgccactttgcccatggcgagaacgagcagcggagaggtgctgtttgagagttgaggtgccaactctaggcatgacatgtcctgtgctctccatttgcttctctgaatttcctccttgtagcgttagacggttagactgtcgtattgcgatttcaatggtttcaactgagttcagctttaagaaaacgttaatctgttgtgcccctgaatgttgtgacttgtcagtaagttagcagctgctagccaatcttgtttggacggtcatacattcatcttaaatctttatgcattcatcttaattc

SEQ ID NO: 24250 - DNA, 1129 bp, Zea mays
tgggaccctcgggccggccaggcccacaatctcgcagtcctttcttcctccgacctccgcagcaaatcggacggtcggaccaggggatagggttccgccgcgcctctccaaccaggcgccactcgccagggcctaggctggtcatggaaggaaacgccgcagccgggaagaggtcccggacggagacggcgaacggggctgccggcggcgggaagcgctccaaagtacgattgggtgcccgtttggtgagggatgtcgttttctgcactttgtccctggcggttacccggcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagtcacaggcgtcaagctctgtatccgcgaccacgagtcaccccaacctgaagaacatcgagctggaaggcaattttgaccagatcaagcaagccatcgacttggtgcgtgatctcatcgcaaccatcagcgcaagcatgccagcaaaaaatccatcttctgctgtggcgccagcaggaggaggccgaggcagtggtccggggggcacgagcagcaactacaatacgaagctgtgcgagaacttcttgaagctatgcgagaacttccaacgactatgtatgagatattgtctcttattatgactggatgagatgtatcttatggctatagatgagacttttgtgatgtaattgatgagactatggatttaaatattggtatgtgattgtgtgtgagatgttttatgtgaaaaaaaaaaaagaaaaaaaaaaaaaaaaaaaaaaaa

SEQ ID NO: 24251 - DNA, 1058 bp, Zea mays
  misc_feature (1034)..(1051): n is a, c, g, or t
cccgggcccccgagcccccctcccaaattggcacgcaaaaaaaaactgactgttgctcctctctctctctctccctctccatttgggtcccccttctctttctcatggcggcggcggcggcgtcgacgccgcagggagtggcggagcggcggggcatcccggcagcggccttcgttgaggacgttgaggcctacctccgccaggtcgggctcgacgtcaattccgcgctcgcttttctccaggaaaggctgcagcagtacaaaatagtggagatgaagcttctagcacaacaaagggatcttcaggcaaagattcctgatatagagaagtgcttggatattgttacaacattacaagctaaaaaggatttgggtgaggcactcatagctgatttcgaattgtccgaggggatctactcccgtgcaaaaattgaggatactgactcggtgtgcctgtggttgggtgcaaatgtgatgctggagtactcttgcgatgaggccaatgccctcttgaagaaaaacttggaaaatgccaaggccagcttagaagtccttgttgctgatctccatttcctgcgagaccagcaaaccatcactcaggttacaattgctcgggtattcaactgggacgtgcaccatcggagaagcaaacaggccgtaaaagaaacctgattacttacatcacgaggccgaccaatgcgactgggactttttttttttgtaccttctgctacctctggcagattagcccgtcatagcaagcagtttgttgttgtatcggtttgttcagagttttacggtgtgggaacattagtagaaatgtcatttcactgccttcttttccccgctggatcgcatttcacaaaatatttccaccattcttgcagagaagccttgctatcgccaaactacttggaacattttgtcccgcctcggaactttaggacttttttccccgtgtttcttgcgtttttctagtaagaaaacgaactggttcaggtataattcctgcttttctaaaggggcttccttttnnnnnnnnnnnnnnnnnnaaaaaaa

SEQ ID NO: 24252 - DNA, 929 bp, Zea mays
  misc_feature (889)..(892): n is a, c, g, or t
  misc_feature (900)..(901): n is a, c, g, or t
  misc_feature (906)..(906): n is a, c, g, or t
  misc_feature (913)..(913): n is a, c, g, or t
  misc_feature (919)..(919): n is a, c, g, or t
attccagcaaaccaaacactccaaacacctctaagtttcaaactggccctaaaccgctgctctttgggcttgactctgcccgctcctctccaatctccatctccacttggtccctctcgcatggcggcggcggcatcggcgtcgacgccgcagggggtggcggagcggcggggcatcccggcggcggccttcgtcgaggacgtcgaggcctacctccggcaggccgggcttgacgttaactccgccctcgccttcctccaggaaaggttgcaacagtacaaaatagtggagatgaagcttctagcacaacaacgagaccttcaggcaaagattcctgatatagagaagtgtttggatattgtttcaacattacaagctaaaaaggatttgggtgaggcacttatagctgattttgaattatccgaggggatatactcctgtgcgaaaatcgaggatactgactcagtgtgcctgtggttgggtgcaaatgtgatgctggagtactcttgcgatgaggccaatgccctcttgaagaaaaacttggaaaatgctaaggccagcttagaagtccttgttgctgatcttcagttcttgcgagaccagcaaaccatcactcaggttacaattgctcgggtattcaactgggatgtacaccaccggagaagcaaacaggctgtaaaggaaccttaatcagttagatcacgaggtcaaccaatgtgattgggacaaattttttcgtaccttttggtacctctggcagattagtccatcatagcgagctctttgtttgttgatggtttctttgctgtgtaacaatgtatcggtttattttctttaatggtgtgggaacattagtagaagatgaaacattttactgcctttttcccannnnaaaaaaannaaaanaaaaaanaaaaanggggcggccg

SEQ ID NO: 24253 - DNA, 977 bp, Zea mays
gggacaaccaagcaaaccaaacacccaaacacctctaagtttcaaactggccctaaaccgctgctctttgggcttgactctgcccgcttttctccatctccacttggtccctctctcgcatggcggcggcggcatcggcgtcgacgccgcagggggtggcggagcggcggggcatcccggcggcggccttcgtcgaggacgtcgaggcctacctccggcaggccgggctcgacgttaactccgccctcgccttcctccaggaaaggttgcaacagtacaaaatagtggagatgaagcttctagcacaacaacgagaccttcaggcaaagattcctgatatagagaagtgtttggatattgtttcaacattacaagctaaaaaggatttgggtgaggcacttatagctgattttgaattatccgaggggatatactcctgtgcgaaaatcgaggatactgactcagtgtgcctgtggttgggtgcaaatgtgatgctggagtactcttgcgatgaggccaatgccctcttgaagaaaaacttggaaaatgctaaggccagcttagaagtccttgttgctgatcttcagttcttgcgagaccagcaaaccatcactcaggttacaattgctcgggtattcaactgggatgtacaccaccggagaagcaaacaggctgtaaaggaaccttaatgagttagatcacgaggtcaaccaatgtgattgggacaaattttttcgtaccttttggtacctctggcagattagtccatcatagcgagctctttgtttgttgatggtttctttgctgtgtaacaatgtatcggtttattctctttaatggtgtgggaacattagtagaagatgaaacattttactgcctttttccccactggatgtccactggatcacgtcgcaaaatattttttttcatgattcatgcataattcctgctttcaaaaaaaaaaaaaaaagctcaaa

SEQ ID NO: 24254 - DNA, 1295 bp, Zea mays
attaaagttttatagagtagtagagattatcatctctatatggatttcatccattacgtttggcccgagcggtctagcaaccattcccagccgggtgggttttgtgggccttttattgttagccgcccggtttgtgctcggccctgatatgtacttagttgctctttggttagtctgactgctgctcctctctctctccctctccatttgggtcccccgtctctttctcatggcggcggcgtcggtgtcgacgccgcagggagtggcggagcggcggggcatcccggcggcggccttcgttgaggacgtcgaggcctacctccgccaggtcgggctcgacgtcaactccgcgctcgcttttctccaggaaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattgtccgaggggatctactcccgtgcgaaaattgaggatactgactcggtgtgcctgtggttgggtgcaaatgtgatgctggagtactcttgcgatgaggccaatgccctcttgaagaaaaacttggaaaatgccaaggccagcttagaagtccttgttgctgatctccatttcctgcgagaccagcaaaccatcactcaggttacaatttctcgggtattcaactgggacgtgcaccatcggagaagcaaacaggccgtaaaagaaacctgactacttacatcacgaggccgaccaatgcgactgggacatttcttttttgtaccttctgctacctctggcagattagcccgtcatagcaagcagtttgttgttgtatcggtttgttcagagttttacggtgtgggactgggaacattagtagaaatgtcatttcaattccttcttttccccgctggatcgcatttcacaaaatatctctaccattcttgcagagaagccttgctatcgccaaactacttggaacattttgtcccgcttcggaacttggacttttttttcgtgtttcttgcgtttttgtagtaaaaaaaacgagctggttcatgtatggttcctgcttttctaagggcccgctcatttagttcagattgtgcccagaaactgttccgatttattaaaattatacaaatttgtgaatacaaacaacggggaatgattccggagggtcgttccgaagcaaccgaacggccctaaaggggctccttttttgttt

SEQ ID NO: 24255 - DNA, 1492 bp, Zea mays
tttttttttttttttttttcgatgctaacttttactttcatttcttttcttttcctaaaaagtacaatgagaaaattatgtatcttcttctatcaggtatggtgtgcaagtgcaagcagctattttggatgtaaaccaaacaaccgactgcacctgatactttgatattccccatatacaagggcagatcaaaggaacctaagatataattgacatcatccaaagtttatattccatcatcccaccgaggaaggtttgcactagcttcattgaccattttcactagagtaaccacactttctggtactccaggagggggcaatgtaagatttcttggtggtggcctatctgggaatgatcttttgtcaaatcgccattcaccaactttaccataggtcagttcaccctttagtgagtagtcacatccataagtgaagtggattataaatgtattctggagctttgtatcaaaaggtggctggatcatgaaatctttacgaaggatatgatgaactccatgcaatgcgctagcaacagcgtatgcatacatttccaacacccatccaaaaactttatctgtctcttcatcctctttcatttgaattgacacattcatccatgtgggggcaatcttctcaagaattgtcttcttaatgatcacaggagaattcccaatcggatcgatatctgtgacaggacctctttctttagcatagtatttcctgataattttttcatgttctgatggtgtaatgtaaaagaagggaaatgctgccggatcatcgtcatgggccaaatttggtagaggtttcacaaatatatggtctggttctgccattagtatatactcttcttcaatctttgctttctgaagccactgcacaaatgcccacggcctatttaggaccacatatccgtggtccttgccagcgggcagcgggtcgacgacgaaggtggggatctcgtccatgagcccgtcgggcttccccgagtgcagcacgcgcgtgaacccgcccatggcctctccgcccggccgcgcctgcatccgcttgtaccagaagtacatgacccggcactgccaccggctgtagggcgcgtccgtggccgtgagcgccacatggaacggccgccgccgcgcctcggtgtccgccgccgcgcgcatccacgctggcatggccaccacagggtccctcgtcccagcggtcgccgccgcgcctattccgccgccgccgtggaacagcatggtgaagaagttgtaggagatcaggaacgcccccgccgccaccagcgctagcaccagcgccggcgcgcgcgcgatgccggcgcccgcggccttccgcaccgcggcgtccatcgctctttgccccctctctgtctctttcctactctgtatccctcttaaagagagattctttttcgattaggatgttctaggtaatggtctcgtgcgagttcgggagggacttcccggccggcctcgagggtcccaatg

SEQ ID NO: 24256 - DNA, 2863 bp, Zea mays
ggcctgaacaaagtttttattgcttgcatgtagctacagttctatctcctacactacaactaaaatattgtgtctctaaataaatgttggattgggctgatgtaaaatatactatagttatatcataacatacagtaaattatgatattataaactgtgactttgaaaaacattgttgcgaaagaggcccaccctaagagtgagatgcgaaccatggagagtaaagttcggttatcccaactaaaacgccgatataaaacacgatagagtattcccgtatgttacaagttagggctgaagtcagtgcaataaagttaatgaaattcccataggttacatgttagggctgatgtcaatacactctagactctagtaggttgaatgttcttccgtattgaattcacaaaaacaaaatgggttcgccatacatgagaaaaacatcagttatcctggttgctcaagtggaattctggaagggtcatcctgattacttcagctagacctcagaccaccgacttcaaaccctaacagcggctgcgatgtcaggtggggggcaaaatgtccaaatggcaggatcacagaaaggtctcgactacaacagagattgcttgtggtcctcctcgctcaagaagggatagagcaaggtcatgttcatgccaactccgaagtccagctgctatcttctttagcgtgtccagctttatgtccggcaaccatgatggaacaaacttcaccaccaggaacataaactgagaaacatacgctttccaggtacccgggtcacagcccagaagaatgtgtccgtccagtacaccagctatgaaatccatgtggtttctcaccacccgtggccgcctcgagaggaaagacaatttcatgacaggagaactcctgtccgctccccaaagtaggctaccacagtaaaagagcatgttggccatggcgtaaccttgtagtgtgctagaaactggcccagggtctttcaaactctgttctctggctgacagcagcagtgtcggtagtgtgtcttcatacaacacctggaccacaagtggtccacctgctatgcataggagaccaccaccaagcatcgcgacctgatgcgccatggatgctgcacaagatagtggtgtccggcctgatttcaactgcggaggcccattgaaagaccatccatttgcaagtttgtgagcccattcaatcacttgcttgaggatcacttcactaacgaagtatgtgtcatggaaagttcgacatgttctcaggtagacgaaaccaggtgccattgggagcctaagaccttgatccgtgattgagtcccctaataaagccccaactccacggtttgcgattatgtcagaaccactggatgatgactgcagaaaggacgaaaagcagcttcggatgagctgcgcaactgcatctttgtctctgccaaatggagaacgcatacaagagaggacaatgaagtcatgccatcttcgcactttctgtgtccacaatgccccgataatgggcatgcttggccaggaacttccccctgcgcagttctctagtgcatgtccaatgaccccttgaatgtactccaaactcctatctagcttaaatgtaattgtcaagctgacaagtgcagccataggcaaaggaagcattggcggcacaccacgtggatagcagctgttaatctgaacaccagcagatgcaagaatttcctttacttcagcttcaatggaatgaagagaagcaccaggactgggccattcagttccattcattggaacaggtttccagattccccgtgtaatttctgctgagaagtagcttacaattgcagcaagagaagcaggcaaaaagtccacaagatcccttaagcttgtagtcaagtctcggctggaaagccgcccatgagcacatgctgtcagaacagcttcaagtacaaaaggaacagcttctaaaaattcccaagcaggaacagcaggcctttggtaagaatcatccgatgcacttacagaagaaccactaacgctactactagaagtagatgaaagattactagatgatactccacctttattcatttttcggcaaatcatattcaaaattttgttcgcaacttgatggacagggtttttgttgcaaagaccagaaagtgtagaggcgatgcaagcttgattctggaaataccaagcacttagcttggggaaagaatcaatataaatcggctgagcagagacctcattgactgagcccatactgttgtaagaatccctattaggggcagacgaatttgagaaaatgcgattattgtgcatcaacaacagatagtccagagtcagttccagctttactgagcctccacgaccagtaagacaatactcttgagggggtctataaaacttccacaagcgaagaagacaaagaaatgcacaggagaagaccaaataaacagatgtttcaccaagaatggtagacttgtgattaggtggcggtgctattgacccaaaagcctcacatagtggcattaaagccacggcaacatctggaaccattccatacaacgaaagaatgtggatgacatcaccataagacacaccgagtaagatttcgttcaacgtagacatatgagcaaggtagtggctcatgctcccaggagttgaagttgaggaatctgagggtaaagaagccgataatagcttgaccaccatactgaccacatgttcctgaatgttccagccacgaacaagtgatgcgccacaaagaatctttgcagcagctgttttttcttcttctgaaccatttgttgctacactgtataacttgtccaattccgcaacactgaagaaacaaatagcggacgcgtggg

SEQ ID NO: 24257 - DNA, 2319 bp, Zea mays
ccctctctcgagtttttttttttttttttttttttttttctctccttttaccgcagataggaaacacgatgcattgcaacaaaatatacagaaagttcactctagtaggttgcatgaacttcccacatgttatacatgttagggctgaagtacaccctagtaggttgcatgttcttccgtattggattcacgaaaaccccgatgagctcgccatacatgagataaacatcagttacccgggtagcacaagtgtaattctggatcaaaagggtcatccggattacttcagctagacctcagatcaccaactacaaacccttaacggcggctgctatgtcaggtgggggcaaaatgtccaaacggaaggattacagaaaggtctcgactacaacagagattgcttgtggtcctcctcgttcaagaagagacagagcaaggtcgtgttcgtgccagctccgaagtccagctgctatcttctttagcgtgtccagctttatgtcccgcaaccatgacggaacaaatttcaccaccaggaacataaattgcgacacatacgctttccacgtacccgggtcacagcccagaagaatgtgtccgtccaacacaccagctatgaaatccatgtgggttctcaccacccgtggccgcctcgagaggaaggacaatttcatgacaggagaagtcctatccgctccccaaagcaggctaccacagtagaagagcatgttggccatggcgtaaccttggagtgtgctagaaactggcccagggcctttcaaactctgatctctggctgatagcagcagtgttggcagtgtttcctcatacaacacctggaccacaagtggtccacctgctatgcataggagacctccaccaagcaacgcgacctgctgcaccatggatgctgcacaagatagtggtgtccgccctgatttcaactgcggaggaccattgaaacaccatccgtttgcaagtttgtgagcccactcaatcacttgcttaaggatcacttcactaacaaagtaagtgtcatggaaagttcgacatgttctcaagtagatgaaaccaggtgccattgggagcctaagaccttgattcgtgattgagtcccctagtaaagccccaactccacggtttgcaattatatcagaaccactggatgaagactgcagaaaggacgagaagcaactttggatgagctgcgcaactgcatctttgtctctgccgaatggagaacgcatacaagagaggacgatgaagtcatgccatcttcgcactttctgtgtccacaatgccccaataatgggcatgcttggccaggaactcccccctgcacagttctctagcgcctgtccaatgaccccttgaatgtactccaaactcctatctagcttaaatgtaatcgtcaagctgacaagtgcagccataggtaaaggaagcattggtggcacaccacgtggatagcagctgttaatctgaacaccagcagaggcaagaatttcctttacttcagcttcaatggaatgaagagaagcaccgggactaggccattcaattccattcattgggacaggtttccagattcctcgtgtaatttctgctgagaagtagctcacaattgcagcaagagaagcaggcaaaaagtccacgagatcccttaagcttgtagtcaagtctcggctggaaagctgcccatgagcacatgctgtcagaacagcttcaagaacaaaaggaacagcttctaaaaattcccaaccagaaacagcaggcctttggcaaggatcatctgatgcacttacagaggaaccactgacactacaactagaagtggatgaaagagtacttgacgataccacacctttattcatttttcggcaaatcatattcaaaattttgttcgcaacttgatgaacagggtttttgttgcaaagaccagaaagtggagaagcaatgcaagcttgattctggaaataccaagcccttagcttgggaaaagaatcaatataaatcagctgagcaggaacctcatttactgagcccatatcattgcaagaatccctattagaggcagatgaatttgagaactcaatgtgattattgtgcatcaacaacagatagtccagagtcagttccagctttactgagcctccacgaccagcaagacaatactcttgaggaggtctataaaacttccacaaacgaagaagacaaaggaatgcacaagagaagactgtataaacagatatttcaccaagaatggtagacttgtgattaggtggcggtggtattgacccaaaagcctcacatttggcatta

SEQ ID NO: 24258 - DNA, 1660 bp, Zea mays
ggctagaaattagaaaacgtgggaacgcgaaacacctccgaggccctgtgtcccatgcttcgcctctgttttgccacgtacccggattcagccgtaagagacagtcaaatggcaccgggccatagattggttaaaaaaaaaaccctgctagtgatgtctcatttagtacatcggagtcactgacgacggacggatggaaacggaagtatacgcatgacggtcttaatgccttttacgaagcagcactttcagaggacgggacgtagcagtacgcgtaccaccacaagcgccggcgatctcgtatctgcagagccgatcgccatttcctccatcgtacgtttatacaaggaggaagcggccgacacgtcactttgcctttcttctcatttaatacaaactcttgcacgggacatacattgaactgatgaataacccccaattgagacatccgtttgcactgcccgtccggttcgttgctagtgctacgccgcgggagcagtccgttcgttgctggtcgctctgccgtctggcatcaatgatggccgggcagaccaaccagcctttggcgatatattccctctgtccaggccttcctcggccgggcacatcagcacattcattcccccccaatcaccactcgctgcgacggaggagatcctctccccttttgcgttggggcaatcgatcgcccatcatctgccaggacgcgtcgatgcatggagaaaaagaccatcggcgtcggtctagagcccacatggcacctccttttcggcgcttcgccacccctgggagtggcgacgtcgacgcgccgggagacaagcgcccgccctggccgcgcgcttgcctcgccagcctcccctcccgctggtctccttccgacacgccggaccgcgcgcgcggcagctgggacggcaacgtgggcagccgcacggccgctggcgcgcgtgcacttgcgttgcgtgccggggaaattgttccggctcccggcctcatccagatcccaagagttaaatgcgaggagacggcgaccgacgcacaagcaagcgatacgcgcggcatggagcagaatcacatattttaacagcgagttttagttgcgcattgcaatatacttttgcaaaaaaaaataacacaaacgttgccttgcctggcaattctgaatgactacagatgcatcacagcgaatcaaaatccctcctcttttgggggccagtgcaacacaagttcagctcgtttccgctatggtcctaactgctatatgccgaaaactgcggttacccaagcttcccgagctccatttttttcttgatggcgcggtgaccatggtacacgaaagaatctatgatgccagcaaccgtgaagatacctgccagaagcacacagcgatgggttagaaatttagactcttgcttgttatcgattttacatagcaccaaaaaacatttcctttttttttggaggaagctcaaaatagtcgcaggtacagagttgtgacagacctccaacaatagcacatatgttcgtcaggaagtgaaggagcgacgtattttcctcagtaaaatcaacctgtcaaggaacagtcatacaaaccagtgactttaacataagaggatgaccaatacctgtacagatggagagcttcgcattttatcgaaaagag

SEQ ID NO: 24259 - DNA, 1543 bp, Zea mays
ttttttttttttttttttttttttaacagcgagtttgagttgcccattgcaatatacttttgcaaaaaataacacaaacgttgccttggcaggcaattctgaatgactacagatgcatcacagcgaatcaaaatccctccgcttttgggggccagtgcaacacaagttcaactcgtttccgctatggtcctaactgctatatgccgaaaactgcggttacccaagcttcccgagctccatttttttcttgatggcgcggtgaccatggtacacgaaagaatctatgatgccagcaaccgtgaagatacctccaacaatagcacatatgttcgtcaggaagtgaaggagcgacgtattttcctcagtaaaatcaaccttgattggtgaaaattcgtagaagaaatatacaccaggtggaggcctaggatagccaattgcctctctgaagtgctctgtcacagaaaactgatttgagtgaatcttgcgccccctgatatctgtgtagattgttggaacaacctttacaaaatactggtacatccccgttaatccattggagttatcctgtatccactcaactccatcaagaggattgactacacctgggaactcttccccaaaggacagcttatttatcttgtggcttatattgtaagtttctggttggaggttcaacaggtcttgcaggaagttgaatgactggtccaagcttttcccgggggcaaagtgaaagttgccagctactttattcacatttacaaatccatggatggtacaaccttccccttgttcatcttttaacctttgtacatagccctccctcttgcactgatcaattaattctacgttgttgacagcccaccctttctttcgatacgcatcacgaacttcttcacaggagttgcaacactgatcatccgactcctcagcaccataacaagatccgcagtaaacctcgttgtggtcaagcctaccgccatgcttctgtaatggtctttcaatcttaggggcaccaactccgtcttttcttgattcaattacattaccaagatgatcaattcttttctttattatgtcatgccttatatcataatgttgctctccactaacatccatcgtatcaacagcaactagagaacaaggaagggccgggaacgtaacatcaaaattgatatgtagtctttcccctctcgaggtatcaacagtgagcttactttccgtggcagaatatagataaagtcggatctcggagaagaagaggaggaggatggcgagggaggagaggatggtgatgaggccgccggagagggtgcggctgtagaagtcctcgttcactttcgggtaggcatccaggtttcgcagcttgctccagagctccatcgcttcagctcaccgccggcgagaccgccggagccctgcgacgaggaggagatctacggcgtggccgtggcccgtgggcgccacgagaaatgggaagggtatatcggactttgttcggtccccccggcctccctcagcgaaggggactaatcggcgattttgt

SEQ ID NO: 24260 - DNA, 3318 bp, Zea mays
  misc_feature (1537)..(1537): n is a, c, g, or t
tgaacgcggtgccggcctcccgcgcctcgcacagctcgtgcagctcctccatcatggtctcattcacgtcggggctcctaggtgaggccaccaggaacctcgcctgcttcttgacgaccgccggcaccggcgacactgtggcgacctctatgttgttcgcacggtccgagctaggtgacacgccgctatcgttggagttggagtcatcatagcccaggcccatgctaaggtggtgccacaacaggttgttcttgatgaccatcagcaagttttcgcgctcgtagtacctgttgtcccgctgcagcgacgtgtgcacgactttcaccctggggaagcagctccgagactggctctgattgatgatggaaaaggtcctgcttatgatggattgactgtccatgactgatgccaagatcgccagcaccaggtcattgtacgcttcccgtgttcatcacagaggcggcggaagatggatggagcacggagggattcgaggattgagcgcagaggacggatggagcatggagggagacggatggagtgcggagggagcgctggattcgaggatggagccgcgggattcgaggatcgagagcggaggacggatggagcgcggagggagcgcgatggcagaactgtgcaccatcctcgaatgttttttttttttttttttcccaatatatatttacttattaacaacgggtaatttcaagtgatctcatgaatcaatatcaaagttggcacaaccaaaattgatgaacacactaaaaataaccgattttgatgccctgtggatgtcaaagatcacaactccatcggcaacagcagctgtgtagcgcggattgcaaatgttgaccagaatgatggttaacgcatgtcgattgaagttaaaaaccagcccatccagatggctgctctaccttggccacaccagcgttaaatctttgggatgagctccgttgggcagctgccctgttgatctgtgtggtagcgcttaatgctgttgctggtgttctgaaattatcagtaccaaaaccccacgcatcgggggaagcacctgacgttgtgttcttggttatgttttggctcccattagttgcatgatcgacctttggtcgggcctgagtctttgtgtcagggaaagcctgccatgttttggcatcagaactggctgatgaggagttgctagcaatagcaagcatcccttgttcaagctcccacacagtgccttggatcttttcctttcgctgcatggagtataaatactatgcaagatgctaataaacttcaggagagtgaatatgctgtattagacatatgtagataaatcacctgagatccagaatcctgtgtccttgagctgactttgtttgagggaggcgttggctcaacaagagtgagcttcagctcttggatctcctgacgctgtgatcggcagattgcagataacttttcatgcttggttgtcatctcagccttttctaatgtgattttcttcaactgctcctttagattggagacttcaagttcaagttcngatgccttaccaacggcaatgttttttttttttttttcaaaatctgcaacaaagctgttaaatgggtctttctcacattttggctcgggttgaggttgttgtgctctacttttcccagaattttgtatctccgtgtcagagagacctctgaaaccattattggacaaagagtaattttgtgctttacttgtcagtgacatctgaccagaatgatcatgcctattgccaggaatactgatgctggtgtccacccaactttggttctgctttgatgacagtggtgccttaattgactccccatcaaacaaagggttcctattaactacagcttgagcaccttgtgcatgctctgtcgcccaaaatgcacctaaaggtgcatctcctgcctttgagcttccatgcggtaaaaaactattagattgctctcttggaggtggaggagggttccttctaggcatcacaggtgttcttttatgagcaccttcatcttgcgagctcaaggaaacggctggtgaaggtccatcaggtaaccttttctgtaactcaagcgacagtagctcattaacacgaaaccagacctagagtatcgtggagatgaatggtcaatcaatcaaagctcttgcctgtgtgatgtctggtctggcatttggtgaggcttccagcatattttttatcagccctgtgacagcaatgctatatttgggttgctcagggatatgataattgccattgagtacctgcaacttggattctccgtcaaatgcagacttgaagtagcatattctatatagaaggcaccccaaagcccaaatgtcaactttttcactgataacttctcttctgtagagatcccacatctctggggccctgtaggctggggttgtatgcttcctgatgacatcttcctcaatgcccatctcttctggtttgttaaagcatttatgattagttgatgtgcttccaaaatcacatattttccatgcaccatccaatccaagaagaacattttcagctttcagatcccctatgtgcaattggcagtgattgtccatgcatggcaaagacagcattgcagacatctctgaaaattaaaagcaccttcttctcctcatagtaaccactacctctgctctccattgcactcaccaaggacttctcacaaaactccattacaagaagtgcctcctttgtacggcccatgtcaacaacatcatgggcaacaagtgtgaccacattaggatgccctttaaggaggttcataacctggatctccttcatgacaagatcaagtgattctgagtcattgcaaataatgtgcttcaatgcatacatctttgatggatgtactgtgtcacatgccagatatacacaagagaagcctccttgtgcaatgacatttcgtactgagatcttcagacttctaacatcaatagtgcgcccatccagtccactatgtgctttacccccaaagggattacgtttccacattattggaatgccgagaccaaggatgaaatgctggtgcttattttgttgggtatggttctccaaatgtttcactagatcggaggtggaggcccgctatctccgtcggctccggcactggcggcgtcaggtgcggagtgcgatctcgtctggagattcggcgcgcccgggcgcactttggcgagtctgacggggaaggaaggaggaaggaaggaaggaagaaagggtcgagacgtggagcggtggagacatggcgatgacgaaggtggccgctggtggggtgtggacgtgtggac

SEQ ID NO: 24261 - DNA, 2612 bp, Zea mays
ccaaaaaagacaaatatgactagctctctgttttgagctcagaaggctcaagtctttgttatgagacggtatatcttggcatttagacattacattcatccgttcatgttcataatcaccatacacagaaacactcacaatactgtcaatacacatttacttattaacgggtaaagtgatcccatgaaccaatgtctaagttggttcaaccaaaatgatgaacacgctcaagataaccgattttgacgcccaggggccggccaaggatcacaactccgtcggcaactgttgcgtaacgcagattgcaaattttgaccagaatgatggttaacgcatgtcgatgtggagttaaaaaccagcccatccagatggttgctctaccttcttggccacaccagaattaaatctttgggatgagctcccttgggcagccctgttgatctgtgtagcagcctttactggtgctgacgatgttctgaaactatcagtaccaaaaccccacgcgtcgggggaagcacctgatgttgtgttcttggttatgttttggcttccgttagttccatgatcgacctttggtcgggcctgagtctgtgtatcagggaaagcctgccatgttttgacgtcagaactggctgatgaggtgttgctagcaagcatcccttgttcaagctcccacaaggttccttggatcttttcctttcgctgagatccagagtcttgtgtccttgagctgactttgtttgagggaggtgttgcctcagcaagggtgcgcttcagctcttggatctcctgacgctgtgatcggcagattgcagataacttttcatacttggctgtcatctcagccttttctaatgtggttttcttcaactgctccttcagactggacacttcaagttcaagttcggatgccttaccaacggcaatgttgagattgtgagtgtcaaaatctgcaacaaagatgttgaatggatctttatcacattttggcttgggttgaggttgttgcactttagttttcacagaattatgtatctccgtgtcagagacacctctgaaaccatcattggacaaggagttattcggtgttttgcttattcgtgacgtctgaccagaatgaccatgcctatcaccaggaatactgatgctggtgtccacccgactttggttctgctttgatgacaatgataccttacttggctcctcgtcaaacaaaggattcctattatctgcagcttgagcaccttgtgcatgctgtgttgcccaaaatgcacctaagggtgcatctcctgcctttgagcttccatgcgatagagaactattagattgctctcttggaggtggaggagggttccttctaggcatcacatgtgcccttttatgagcaccttcatcttgcaaactcaaggaaacggctggcgaaggtccgtcaggtaaacttttttgtaactcaagcggcagcagctcattaacacgaaaccagacctgtgtgatgtctggtctggaatttggagaggcttccagcatatctttgatcaaccctgtgacagcagtgctatacttgggttgctcagggatacgataattgccattgagtatctgcaacttggattctccatcaaatgcagacttgaagtagcatattctatatagaaggcaccccaaagcccaaatgtcaactttttcgctaataacttctcttctgtagagatcccacatctctgggggcctgtaggctggggttgtatgcttcctgatgacatctttcctcaatgcccatctcttctggtttgttaaagcatttgtgattagttgatgtgcttccaaaatcacatattttccatacaccgtcacaaccaagaagaacattttcagctttcagatccctatgtgcaattggcggtgattgtccatgcatagcaaaggcagcattgcagacatctctgaaaatcaaaagcaccttcttctcctcatagtaaccactacctctgctctccattgcactaaccaaagacttctcacagaactccattacaagaagtgcctcttttgtacgacccatgtcaaaaacatcatgggcaacaagtgtgaccacattaggatgccctttgaggaggttcataacctggatctccttcatgacaagatcaagcgattctgagtcattgcaaataatgtgctttagtgcatacatctttgatggatgtactgtgtcacatgccagatatacacaagagaaacctccttgtgcaatggcattttgtactgtgatcttcaaatttccaacatcaatagtacgaccatccaacccactctgtgctttacctccaaagggattgagtttccacattattggaataccgagacaaacgatgaaataccagtacttattttgttcagtacggttctccaatgtttcttttagatcggaggcagaggcgggcggtcgccgtgggctccggcgccggtggcgtcagatggggggcgcgatcccgtctggagattcggcgcccgggcgcagtctgacgagcccgagtgcccgacgggagaggaggaagcaagcaagcaaaagccgagacgtgggtggagccgggcgaggcgaggtggggcct

SEQ ID NO: 24262 - DNA, 2142 bp, Zea mays
ccggccgggagatttgggttccggactgctttatctataacaactcgttgtggcgcctaaattattgtgttggtggtgaggtcactacaatgtatcatttggatcgccctatgtacctattgggatatcttgcgaaccaaagtcgagtttatcttattgacaaggagtttaatatcattgggtacacattacttctgagtttgattgagtacaagacccttgtgatgcgtggggatttggaacatgcaaatgaaattttatcatccataccaaaggcacaatacaatagtgttgctcattttttggaatctagaggtatgttggaagaggctcttgagatagccacggatgctgactacaagtttgacctagctgtgcagcttggaaaattagatgttgcaaaggctatcgtcatagaagcacagagtgaatctaaatggaagcagttgggtgaactcgccatgtccacaggcaagctagagatggcggaggaatgccttcttcaagcgaaggatttaagtggcttgttgctattgtactcatctcttggagatgctgaaggaattgaaaagcttgcttctttggcaaaagaacatggaaaaaacaatgttgctttcctctgccttttcatgcttggtaaagtggaagattgcatacagttgcttgtagacagtagccgtatacctgaagctgcactaatggcgcgatcgtatcttcctagcaaagtaccagaaatagtagcaatttggagaaacgacctcagtaaaattaatccaaaagctgcagagtctctggcagatccttctgaatatccaaatttatttgaagactggcaggttgctctaactgtagaaaaaagcgttgcttctcagagggatcattatcctcctgctgaccaatacttgaatcatgctgagaagtcaggcatgattcttgtggaagctttcaaaaggatgcaggtcattgagcatgaggaacctgaagatgcagctgaggaaaatggagaacctgatcaacaggcatcggaagagaaggaaatgcataacacagatgatgctgatgaacatgaagagacagtttcagtaaatgggaacgagggtgaggaacagcaggtgctaactgaacatgaataggggccgagggaagcacaacgcattggctgcaaatgttattttttcccgagggtaacaaatgtggcccccagttttaccctgaagcaccggaaactggtgatgcttgtggccattggaggccacctgatgcttgtccgatctttctgagtgaaccccaagcttgacatattgatgcttgctacacttttggtgtcgatatgcttcttctgccaacaacataggcaattctttcttctcggatcatctgcggacccgatttctatgcgctcgaaccaatgaactgggtggggactgtggagccattttgtgatgaatagttcgaataatcagtatagaggtacgttgtaagatatgccagattaccatagccatcgaattctcctaggagatgacagtttttgttagccattcattgtaatgatgttacttgataaggaaggttacgtgtagtatatgattgcggttgcgggccgagggttttgcccatgttatacttatatatagtggtatcaatccatcggatcggaggctctcgtctactgatgcctaatcaatgccgatgactgcgagaattcaatgcctagatatgcagtgtaacagtgtctcgctgcacacctattcatcgtttcaaaccatggtccatggaatttattttgatgctggaatgctgcggcatgtccaactgacatatgtgtgctgtgccctcgcttggccgcggcgcctttttatgtgtttggatcacattcacgcgtacggagcacgtcgacgagtgaaccaacacaaagacaagagaaattaatttgtctcgtctattataattcttatattatcattaattgggtatatagataactaggctcccttcacttttggagttgttggcctcctcgtgaaaaattattacttgtccaggcgcgagatcgccatggacgccgcctacgggaaaggcagatggggcctggggagcgagagcgggggtcactggacgcaaccgcaccaagggtaccga

SEQ ID NO: 24263 - DNA, 2065 bp, Zea mays
  misc_feature (2)..(2): n is a, c, g, or t
  misc_feature (8)..(8): n is a, c, g, or t
  misc_feature (22)..(22): n is a, c, g, or t
gnaggggnaattgcaattaggngaaagtacatcaagaataaagattttcaataaatcgtttcaggagaagaaaacttccgcccttcattttcagcagagcgtatttatggtggggtattgttggcaatgtgttctagtgacttcatctgcttttatgactgggctgattgtagactaatacgccgaatcgatgtgaatgttaagaatgtttactgggctgatagtggtgacctagttgcaatagcaagtgatacatcattctacatcctcaagtacaatagagatattgttgcttcttaccccgttgctgtcgagcctgtggacgaagaaggcgttgaagatgcttttgagctgcttcatgagatcaatgagcgagtgagaactggaatttgggttggagactgctttatctataacaactcatcgtggcgcctaaattattgtgttggtggtgaggtcactacaatgtatcatttggatcgccctatgtacttgttgggatatattgcgaaccaaagtcgagtttatcttattgacaaggagttgaatgtcattgggtacacattacttctgagtttgattgagtacaagacccttgtgatgcgtggggatttggatcatgcaaacaaaattttatcatccatacctaaggcgcaatataatagtgttgctcattttttggaatcgagaggtatgttggaagaggctcttgagatagccactgatgctgactacaagtttgacctagctgtgcagcttggaaaattagaagtcgcgaaggctatcgccatagaagcacaaagtgaatctaaatggaagcagttgggcgaacttgccatgtccacaggcaagctagagatggcagaggaatgccttcttcaagcaaaggacttaagtggcttgttgctactgtactcatctcttggagatgctgaaggaattgaaaagcttgcttctttggcaaaagaacacggaaaaaacaatgttgctttcctctgcctttttatgcttggtaaagttgaagattgcatacagttgcttgtagacagtaaccgtatacctgaagctgcattactggcgcgttcatatcttcctagcaaagtaccagagatagtggcaatttggagagacgacctgagtaaaattaatccaaaagctgcagagtctctagcagatccttctgaatatccaaatctatttgaagactggcaggttgctctaactgtagaaaaaagtgttgcgtctcagaggggcaattatcttcctgctgaccagtacttgaatcatgctgagaagtcagacatgactattgtggaagctttcaaaaggatgcaggttgttcagcatgaggaacctgaagatgtggctgaggaaaatggagaacttgatcaacaggcatttgaagagactgaaatgcagaatacagatgatgatgctgatgaacctgaagagacagttttagtaaatgggaacaagggtgaggaacatcagggtacggacaatgaaggagctttatctgcctagaattcttggcaaatatgggaaccccaagttttgcctacgtgctaactcaacatgaataggggctgaaagaagcacagctcattggctgcaaatttttttttctgagggtaacaaatgtgggccccctgttttactctgaagcaccggaactggtgatgctggaccgcctgatgcttgtcatatagaaggtcgctatactttttggtgtcaatctgcccatccagtcatgcttctttttgtaaacaacgtaggcaattctttcttcttggaacgtttgcagacccaatttccatgccgtgaaatcaatggatcgggtgtggggccagctgcaatgaatagtgtttgaataattggtatagaggtatgtagtaaaaatatgccagattaccataggagatgacagcttttgttacccattcattgtaatgaccttattcgataaggttacgtgtagtctacgattgcagttgcgggccgggagttttttcccatgttatgtagcatcattctatcggatctgaaaaaaaaaagaggccccgag

SEQ ID NO: 24264 - DNA, 671 bp, Zea mays
cccccccccccccccccctcttatgataatgtaacaattataaagtacagtaacgtaaaatacattagacaaacatcgttggctgaccaacaaactgatgatcgtaacacaatcgtagtatgatcggtagtaagtagtaacgaacggcaggtgtattggatagagtaccactaccagagtacaaaaggagcgaaaacatacagcccaaaacacaacgggaggctactagtttaacaagtttatttattatcgctcatcgaccatgcacggacgccacagtagggggcggcacgtaggggcgggcgcgcgccacggcatcacatgatcacatcttcccctggcgatgcacgcaggacgagccggcgcaaccctccacgcacttctcgacgcactggtccacccgctccgccgcacgctgctgcatcagccggtccttctcctcgaagtacaccgacgccgccttctccgccgcgcgttccttcgccgcgcgctcgtcctcgccgcccagccggacgtcgacgtgctgaccttggcccagcgtcagcttctccttgatcgcgcccgtcacgttccccagcgcccccagcagaccttgtccctgttccctatcagtgtcgtgagtgctggccgtctccctagccttgtcagcggcggtctgtgctgtggctcgg

SEQ ID NO: 24265 - DNA, 2737 bp, Zea mays
ggacacgcagcgacaatttgctcgtcgattcagggaccccggggtcgaaacgccgatatctatatatcctatgtcttaatttttgtacatacatagttatcgtgctctaaaatattgtatgtatattttagttttacttaatctaatgtttaaatttttaaaataaatagatgagaggagagagaacttttatatacagagagaatggatgatcgtgttctatacttaaaagaatattttagaggacactattgaagctatagaggagtaaatcttgataccgttagagttagtcttattcgatttaattttatcatgatgaaatctacctggattcaatgagtatatatttttaatgagctctggacgtggatgctttactaaacgatttaccaaaatactctaactttaacggtagggtgctggtagagctgaaacaaaaaagcgcattttctagtaaactggagtcgtgctaaatagaaccttaatcataacgtaactacgaacgacatgtcacatcaactcactcacgagccaaattttaatgggtgtcataattctgagaacttttgaataggtatacagcatacgtacaccatacactacagaaaatggactcatttccaacggcgtctgcactttcgaataggtatactataccataccttagaagagctaacacgatcttcatctccaaagccatgacatagtgatttctgtaaaaatagcaacaagagtcaggcgaaagtgacccattatacatgactttagaacttggctacccctttcctttgtaccgacactcctaaactggtttaactctctttggtttaaatacctcgctttaaaaggttgtatccaaataatatttttcgagaccatgatatactatatggtaatgtaacagccataaagtatatggtaatgtaacaattataaagtacagtaacgtaaaatacattagacaaacatcgttggctgaccaacaaactgatgatcgtaacacaatcgtagtatgatgggtagtaattagtaacgaacggcaggtgtattggatagagtaccactaccagagtacagaaggagcgaaaacatacagcccaaaacaagggcccggaaatgaagttaaacacaacgggaggctactagtttaacaagtttatttattatcgctcatcgaccatgcacggacgccacagtagggggcggcacgtaggggcgggcgcgcgccacggcatcacatgatcacatcttcccctggcgatgcacgcaggacgagccggcgcaaccctccacgcacttctcgacgcactggtccacccgctccgccgcacgctgctgcatcagccggtccttctcctcgaagtacaccgacgccgccttctccgccgcgcgttccttcgccgcgcgctcgtcctcgccgcccagccggacgtcgacgtgctgaccttggcccagcgtcagcttctccttgatcgcgcccgtcacgttccccagcgcccccagcagaccttgtccctgctccctgtcgaagtgtcgtgagtgctggccgtctcatcgatcatccaactacactagaattcttcactgctacgtcacatacctatcagtgtcgtgagtgctggccgtctccctagccttgtcagcggcggtctgtgctgtggctcgggacctgtccctggcctcctgcgcggcctccctgctggcgtcggtgtactcgcccgccttctgcctggtcacgtctctcgcctccctcgccttgtcggcggtggcgtccctcgtctcctgggccttctgcatggtcgcgtccttggcctccctcgccttgccggcggtggtgtccgcggcctcccgcgccttgccggccgccgcgtccttgtactccccgagcttgttcttggtcgcctccgcggtctcgctcgtcttctgcgccaccgcgtccttggtctccctcgccttctccacggcgctgtccttgtactcgcccagcttgttccgggtggcctccgccgtctcgcccgtcttacgcgagacgctgtcgttggcctcccgggccttgtcggcggtgtagtccctgtactcgccgagcttgtcgcccgcggtgtgcgccgtctgcgaggtcttgtccacggtcgcgtccttggcgccaccgaaggtgcggcccacggcgctggccaaggacctggcgccctcctgcacgctctccaggatgccgccgccaccggcggcaccgcggtcggcgcgggagcgcgcgatctcgtccgcggccgagcgggcgttcacctccgccttctcgaggtgctcgtcccgcgcccgagccagctcctccacggcgcgccgcgcgtcggcctcggcgcgcgcctcacgcgtgttctgcctcgatgccatagcggtcggtcagtgactctgtagcttctctttctcggtttctctcgcaaacgcactagtgtttgtttcgcagatcgtcttcccggctgccccgcgccgtccagataaataccgctctcctgagaaatgagagcgggacacgtacatccgaatgcatggacacgtgggattcatgtagggagacaggaaccagtgacacgtacgtgaccgccgcgtcgcttcgcaccggaggccgacgcgtgctaccgtggctcagttgccgatgcattgtgcttctttgcttgctaccggggtcggtaaccgttctggacccttcgcgggtagagatggcaatgggtacccgaaaccc

SEQ ID NO: 24266 - DNA, 2668 bp, Zea mays
  misc_feature (76)..(76): n is a, c, g, or t
accctaatacatatggattgagcttaattctagagtacctaaactaggcctaaccgaataagtcgagggcttggtntgaggtggattgagggagattagaggggaatcacctcatattcaaatttcaaatttatatagagggggatttaggaggtgtttgggatggcttcagattccagctccagtatggagctgtagtttataatatcaatttaagtagttttaaaaaatatttttaatcaaaataataaacaaaaagacttatctaaatgtcttctaaaggcttacaactccagctccacgattttctagagcacctaatgacctgcttcactaactccaccaaattttctagagctggagctgtcccacagaacatacaaagagaaataaaggatcagtgcaatcgcaaagcttagtctgcgataagatttagattaaataacgagcaagtgccatagaaactggtaggaaaattcggagcattaccaactccaaaaatatacatgatccattgaattatgtcaacacaccaacatgaaaaattgagtatagaaatacaataattattatccggttacatggaataagcaaataaaaaataaagaagctacaggcaagtaaacaaactgaacactattttaggaaacaggctacacgaggcagttcctcagccttctctacaagattttgcttcgccttgaaatcaagctctgactcccaagaccacaagcaataaactcaatttccaccaaggtgcttggtggtcctcactatgtcgccgagaagttcagcgatgcaatcattcttccatgtcttgtccaagatctgctcgtgctcttgctcgagtctgataaacttttcttcctccgctgctgctgccgctgctgcagctactgttgtagctgttgttgatgctcattaaatcgctcaagaagtaccagcagattgtgctatgtggatgcccaggtaaaaggctaacaggaggagccctgcacggcgtggagctcccagattccatgtcaaagaccatgccttgatccctaccgcgcccacctatccagtatacacagttgcccctcaatcctggcacaccctctgcatacattgacactgcattgttccttccaacaaaaagtgagtgacctcccaggttcttcaccacatcccagcaaggctgccgtcgaggataatacctcagcaccaatatctcattttccgcaacgcgacgctgacctcctgtaggcagctgcagagtaacagtgcaacttgcgttcctccaaacttggtacagattgccctcacagaacaccaagttctttgcactagtgaacgacgacactgtgtcataaggtggagggaagacagtggcagggtcgaacgggaggttggcctcacacaacaggggctcaacagtggctggcgcatttaggtgtggtccttgcgattcaggtggaaatttcttatatgggatgaatgtctctgcacagaacgttaccctcagtggaatagttggatcctgatctcttgtttgggcctgttcatggcgcatcatccgaaaattgcgcagatgttgccaacgcagtggacggcaattatttgtgcgttcagcaggctgtggcggctggagaacagagaatggtggctccgatggccctgcttcatcggcgttggcaggctttcggcaccgtcgctcggggagacggagcacatgcacgtccccgcacttggtgaggcagtagaccctacctttgtcagtgtagacgacatcggtgagctggtccccgttggtgagacggacggggtctatgacggcccacctcctggctccggcggtgacgtacgcgatcctatcgatatcgcagattgccgcggcggcgaagtcgtccttggcggggttcggagtgaagacgaccttggaaacccagcggctttcgtagatcagcggcgggaggaggatctccacggcggcgatggggttgaggagcacgaaaatggtcccgccgctgaagaggacaacggagagtgcgagccagccgttgctggagccgacgcagcggcttcccgaaacgatggcggtgagctcgaaggacctccgcgtggggagggaggcggcgtaggggcaccagcgggcgtcgttggcgaccacgaggagcgcgggcgacggcggcgcgagcgcgcatcgccacgccgtgcaggcgccccgcgcgctggcataccacttgagatcgagccggtctccgatgcggcacagtagatctgccggcaggtcagcccagcgccggaacggcgccatggcgactggcgaattcgggatgctagggtttggggagcgcggatgcaggccattcccctgctggggaattttacgaaccattgttcgggcggggggttttacggagagcccctctcagttacgatttgtttgcggaacggtccagcggctgaaggtgaaggaaccgcaccactctttccgaggcgcatagcccagctgtgattgttggcccaataaggcccagtttgggaccgagataaaggtaagagctgttttaggactcatttggtagtgttttgggcttagaaacattccaacttaacattcattttctcattcttgattatattatttgaaaacgtttagcaaggatatagattcagatttttgaaa

SEQ ID NO: 24267 - DNA, 1413 bp, Zea mays
agtagacacagttgcccctcagtcctggcacacccctctccatacatcgacaccgcattgttccttcccacaaaaagcgagtgacctcccaggtccttcaccacatcccagcaaggccgccgtcgaggataatacctcagcaccaatatctcattttcagcgacgcgatgctgacctcctgcaggcagctgcaaagtaacagtgcagcttgcgttcctccaaacttggtacagattgccctcacagaacaccaagttcttcgcactagtgaacgacgagacagtgtcataaggtggagcaaagacagtggcagggttgaacgggaggttggcctcagacaacaggggctcaacagtggccggcgcatttaggtgtggtccttgcgattcaggtggaactttcttatatgggatgagtgtctctgcacagaaggtcaccctcagtggaatagttagatcctggtctcttgcccgggcctgttcatagcgcatcatccgaaaattgcgctgatgttgccaacgcagtgggcggaatgtaattgtgcgctcattaggttgtggtgactggagaacagagaactctggctccgaggatcctgcttcatcagcgttggcaggcttccggcgccggcgctcaggaagacggagcacatgcacgtccccgcacttggtgaggcaaaagaccttacctttgtcggtgtatacgacgtcggtgagctggtccccgcaggtgaggcggacggggtccatgacggcccacctcctggcaccggcggtgacgtacgcgatcctgtcgatatcgcagattgccgcggcggcgaagtcatccttggcggggctcggggtgaagacgaccttggaaacccagcgactctcgtagatcagcggcgggaggaggatctccacagcggcgatggggttgaggagcacgaagacggtcttgccgttgaagaggacgacggagagcgcgatccagccgttgctggagccaatgcagcggcttcccgagacgatggcggtgagctcgaatgacctccgcgtggggagggaggcagcgtaggggcaacagcgagcgtcgtcagcgaccacgaggagcgcgggcgacggcggcggaagcgcgcagcgccacgccgtgcagacgccccgcgcgctggcgtaccacttgaggtcgagccggtctccgatgcggcagaggagatctgccggcaggtctgcccagcgccgtaacggtgccatggcgaccggcggattcgagatgctagggtttgggaagggcggatgcaggcgattcccctgccggggaatttcccgacccattgttcgggtgagggattttacgaaggagccctctcaattacgttacgttagcggaacggtccaacggctgatagagaaggaaccggaacccctgcag

SEQ ID NO: 24268 - DNA, 3961 bp, Zea mays
  misc_feature (1007)..(1007): n is a, c, g, or t
  misc_feature (1040)..(1040): n is a, c, g, or t
caaccatcaaagggagccttaagtagatttgagttcccttatgattgttatgggtaaattgaccatcttcttttggcccttatgggttggtggctttcatttaaacataatcatttcaaatattgggggcattccgccagtattcatgatgctacccctgtacacaatgttaaaaacttacagcagcaatcgtcaagagcaccggtacgtaaacattgataagtacaaaaaccaataccttctctacaaataaatcataaattgttgcaacaaaaagaaaagaaaagaaaagaaaagaaaaataggtctttcttcagagctttcagttaccaattcgtcagcaatgtaaaatggaagtagcccccagtccatgcaatgtgccgaagactgtaataggtgaaatgctggtttgctcatttggacgacgatgctctggtcctgctaggtttcgaatctgcattatcactcttctccgtgtcggagttgttgtccttttgcgaatccatttctgtgctccctccacggtggtgcttagatcttctgtcctgcttgcgagaatttatattttcgctatgaaggttgaagtaggtacaatggaaaccaccagtatatgaactactatgaataaaaaaaaggttttccatttatttatttatttatttttgccaggagtaggacatacccctcgaggaattggatcatccgattccagcatccggacaacttgacccatcttcggtctcttctctgaatctggatccacacacctcagagctgtcaaaagtgcacgctttagagctctcgtcgaaggtcgtgtctctatggtgggatccactacttcttctgaccgcctgctggcaaccatcatttttagccagtcaactagattcacctgcaaatggcaaaaaatatgttcaggtagagaagtgaaagaaaccatttcctattttcgtgaaagaatgcatcatggaggtcaaatggatatgatcatcgttaagttcttaggncatctccagcaggccttaggccatctccagcangccatgtaaacggccgtgcaatagattgcactgtttgcagagtgtgatttgaaatatgtagtaaaatagggagtggggtagagagtctgttggagatagtcttactggagttgtggacaacactttagcgattgtgctctttacgcatatactattatgacctctaaacgacacagtaatataaaaaatagttactgatagtaacacacacgcaggccagccagcccgtccacacatgatgcacgcgcacacacgcgtgcctgcatgcgcgggcgcacgggttgctatcagtagccattctttaatgaatatatactgtttcgtttagaggtcataatagtatatgtgtaaatagcacaatggccaaaatgttgtccacaactgcagtaagaacacacacactaggatacccaaccacttcatctgaataaattaatatgccaaatacgtaaaccagaggcaaagttatcagttcaacaagcaatatggatggatacaatgcatattttatacattaacaaccaaccacaaagtgtcatcagaaaattcttaaaggaacacaccaacacccatctcaaaagtaagctattttctagagagagaaaatgtcctttatgccaagcatcatgcacatgctttagtaagaaaaaaatgggagcaggatgatcaaaaggttcacatgaaggaaacaggcaaacagcaaatactatgtagaaaataactggatgtacagagcaatttcttagccaacatgaagcattccagtgccaacagaaacagaacagaacttttgagtcactcaattttggtgagatgtctgttattgcttcaaacctaaacatatctaactacacaagcaaggtgtctatcatgtaggttagcactaaagcaaagaatattgaccaatttatcaatacctcggtttgggtgggcgtccatagtcaacaggatccccttccggtaattgcttccaggagaacgactccaaagctgtaaatgtcactcttttcgttcaagagtccagtatttgcatactctggtgccacatacctgcagagtgaatcagaccatcataaccctgtactaatataacttcatggaaaccttggtcacaaatagcggaacatacccaaaggtacccataactctagtggtgacatgactctttccagcgccaagaagcttggctaaaccgaaatctgatactttggactcgaactcatcatcaatcaaaatattgctggatttgatgtcacggtgcacaactttgggttcaatcgcctcatgcaagtaagcaagcctgtggacaaatataaaaaactcttgttttcatttcaaatcattcacacatgacaaaactgaaaggagaaaacatattatgcaagtgtagcaacaattaaggcaatgcaaatagtaattagaagtttttagcttaacatcagatacacttgcttactttgaattgaggggtgctatggtaggattattcccgtgtagaaagataattagctttagaatttttatagcattcatatcctaaggtgagctggaaaataatgcagacaatggtaataaaaaattaaagtgtattttgcactgacgctttagcagtcccaagaagaatctttatgcgggcctcccatgtaagagagccatgttgactcatagctccatgaagccattgttctaggtttccattgttcacatactcatagacaagcatcctgaaaaattcatttcaagttagatatgatgtcagaaaaatgatatgcttattgcaactgtaataggaactacctttgggtaccctccacgcaataaccaagaagccggaccaagttcttgtgtcgaacatgaccaatagcctcaacttctactctaaattccttctcagcttgacctctacagattcacaaaacatcaattggagaaactaaatgcaacattggtaaggaagacaagcaggtaaataacgacccgagattccttctcagcttgacctaggttattgagaagctttttgacagcaacaggggagccattgattagctgcccgcgataaactacaccgtatccaccctcaccaataatgttgtcctttgaaaagcgattggtagcaagctccagatccctcagcgtaaaccagtgaccccaaccaaggtatgaaaactcgggcaggccaaccagaggtgaaggagcaactatggcattagctgaagctctgccgaaacgttccagagccaccttcctcagctgactggaatcctgcatccttgtccatgtagcgaaatgaccccgaatggctctcatcaccacgcttcgatttgctaacacccaaatgggccatgaccttgtccgaatcccggtcgctggtcttgtcctggaacgtgaggaggacgccatcatgcgccacaaagtcgctggccggcacttgctccaccctcacctccttgatttccttggaaattgcagggatttgggtgattgggatatttgcggatgcccgccgccttaccctcttcttgctcctgagcgtgagccacacggtggcaaacaagacgagcaccatgaaagctcccaaggcaatgcatatgacctcccatactttgagatgcaaggggcctgtaggcgtggagagatggtccttcagagtaggggagggcatcggtgacgacatggcgggatgccagcttcttgctccggcagaacgaggaagcagccgacgcccgagcggccggatctccgctccaccggaccgcgagaggccggaggatccagcagagagagatagagatgggcctcccggcagcggcctcctgcgcgtgcgctgtgcggaggagggagacgccgaccccgccggcgagcgagatattggttgcgcttggtggccggatcggagcggtaggtgagtggtatcgatg

SEQ ID NO: 24269 - DNA, 2354 bp, Zea mays
  misc_feature (54)..(66): n is a, c, g, or t
agcagtggtaacaacgcagagtactttttttttttttttttttttttttttttnnnnnnnnnnnnnggcccaaagggaaggaggctttcatttaaacataatcatttcaaatattgtgggcattccgccagtattcatgatgctacgcctgtacacaatgttaaaaacttacagcagcaattgtcaagagcaccggtacgtacacattgataagtacaaaaaccaataccttctctacaaataaatcataaattgttgcaacaaaaagaaaagaaaagaaaagaaaagaaaaataggtctttcttcagagctttcagttaccaattcgtcagcaatgtaaaatagacgtagcccccagtccatgcaatgtgccgaagactgtaataggtgaaatgctggtttgctcatttggacgacgatgctctggtcctgctaggtttcgaatctgcattatcactcttctccgtgtcggagttgttgtccttttgcgaatccatttctgtgctccctccacggtggtgcttagatcttctgtcccctcgaggaattggatcatccgattccagcatccggacaacttgacccatcttcggtctcttctctgaatctggatccacacacctcagagctgtcaaaagtgcacgctttagagctctcgtcgaaggtcgtgtctctatggtgggatccactacttcttctgaccgcctgctggcaaccatcatttttagccagtcaactagattcacctcgtttggtgggcgtccatagtcaacaggatcccttccggtaattgcttcaaggagaacgactccaaagctgtaaatgtcactcttttcgttcaagagtccagtatttgcatactctggtgccacatacccaaaggtacccataactctagtggtgacatgactctttccagcgccaagaagcttggctaaaccgaaatctgatactttggactcgaactcatcatcaatcaaaatattgctggatttgatgtcacggtgcacaactttgggttcaatcgcctcatgcaagtaagcaagcgctttagcagtcccaagaagaatctttatgcgggcctcccatgtaagagagccatgttgactcatagctccatgaagccattgttctaggtttccattgttcacatactcatagacaagcatcctttgggtaccctccacgcaataaccaagaagccggaccaagttcttgtgtcgaacatgaccaatagcctcaacttctactctaaattccttctcagcttgacctaggttattgagaagctttttgacagcaacaggggagccattgattagctgcccgcgataaactacaccgtatccaccctcaccaataatgttgtcctttgaaaagcgattggtagcaagctccagatccctcagcgtaaaccagtgaccccaaccaaggtatgaaaactcgggcaggccaaccagaggtgaaggagcaactatggcattagctgaaggcctgccgaaacgttccagagccaccttcctcagctgactggaatcctgcatccttgtccatgtagcgaaatgaccccgaatggctctcatcaccacgcttcgatttgctaacacccaaatgggccatgaccttgtctgaatcccggtcgctggtcttgtcctggaacgtgaggaggacgccatcatgcgccacaaagtcgctcgctggcacttgctccaccctcacctccttgatttccttggaaattgcagggatttgggtgattgggatatttgcggatgcccgccgccttaccctcttcttgctcctgagcgtgagccacacggtggcaaacaagacgagcaccatgaaagctcccaaggcaatgcatatgacctcccatactttgagatgcaaggggcctgtaggcgtggagagatggtccttcagagtaggggagggcatcggtgacgacatggcgggatgccagcttcttgctccggcagaacgaggaagcagccgacgcccgagcggccggatctccgctccaccggaccgcgagaggccggaggatccagcagagagagatagagatgggcctcccggcagcggcctcctgcgcgtgcgctgtgcggaggagggagacggagaaagagaaagggagcgagatattggttgcgcttggtggccggatcggagcggtaggtgagtggtatctgtggagtatttccgcgcttgcttccctttttcctcgaaagaaatcgcaaatggccaccccccgcctcgccgccgcgcgcgagggcgagcagaagcagcaggagcaggtgttggtgccgggcgggctgggctgtgctcctgcctcccggcgagcccgagggtac

SEQ ID NO: 24270 - DNA, 698 bp, Zea mays
actcactcctaagggcggttggggtccggcccgccggccggggcgggtttgttgcagcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgttgttgtttaaggcataatatataaactgccaaattcacatgtattttgggatatttgttatcatactatgaaatgactgtgaatcgttgttctgatttgtctttcaccacatgttttccttgcatgaagtaatatacgatatttatgtatttcttgttttcgagaataatagtcaaagtatcttgtgatttgaacggttaaaaaaaaaaaaaaaaacggcgcgccaaaaaaaccccccctgcagccaagc

SEQ ID NO: 24271 - DNA, 4820 bp, Zea mays
tcaacaaattgttagtaatatccacaaattctaaagctcagtttgaacacagcatttcttcctttgctttacataaacaaaatttgatatacctctaaattctgtaagggtttacaaaggattattgagcagaaacagcaaaattagtgtgaaaaatagtattcatagggggtacgcaaaggctgtcttccaaatttcccccaaagcatttttggtggaatggcttcatacaactgcagggtgacatagatcatcaatgatgttcatgatcaccataactactggatcttgatctatgtgcaacctatatgcatcagagcatcttcagagagtatagctaactctactcccttgatctcatcccaaagacgaccaactcatggttcaatcctgtcctctctgttcacttttccaagaattcttggcagcttctgcagatgaaccactagaatctccacctttatctttaggcttcgagaagaatggatcccatttgtgaggtccaattgcctgctgtccatcgtctaacagactatacttccagctattctcttcgataaaatctttgtcttcttggcctgcgatgatatctcttctcaactttgtcactttgttaatgatcgcctctatggaaacatcaaatgcatctttcaatgtctccagtttcgatcttggatcggcatatatcacctttggtatcagattgatgacctcctctctcatttgcttgaccacatctgggtgaatactctttagcctctcctcaatgctggcatttccagaacggatgtcatcttcagggatgaatacagagtacgttgtatagttctttgggagatgccatgtatactggacgtacgctgaaccgggatggaagaaaacaggcacgcagccagccaacatcgagtcaaaggcagatcttcttgtgtaggagtcaccctggggctgcaaacagaacatagaactctggaacatcttcatgattgtgctcggggagtggcacttgctctccccaaggtcacactccaacaatttacaaaggcttgagctcctgcattgatcgatgagctgccctctgatggacattggatcaccaggacgtggagcgcctgcaaacgagaacagccatgggcgttccaagctcctcatcctatcctgccaaaggaaaacctcagcgtccttggccgggtggaagtacgtaggatatggtattccaaaatcatttgaattccacgggctcgactccaccacgagcatcgacatgttctttgcagccggcaagaaaagcagcttgctgccccaatctgcttcctcctccgtcaacctcctgaaatcccaggtgatcctcccggcaaccaggaaatggtcccgcccacccatcacgctccactcgggcttgttcatcagccactccaccaaatcaagcgacgccgcatccctcgtcgtgatattatagccccagagataccttgccacatcgaacccagcgtagaacggcacgaacaccgccgcggcaacggacgagtccttggtcaggcactcgtactgcttcatcctgttgccgaagatgacatccacggagaactggttggtgccataccagccggtgtcggagaacacgccctcctcgttgcccagcggcgggccgagcccgtcgttgctcatgaacctgcacatgttggtccagacgctgagcttctcgcagtcccggagcatgtcctcgttgaaccgcggcggcaggtcgtgcacgtagatgtaccggccgccgcaggggtcgctctggttctccgccgtcctgagcgcccgctcgaacgggtacggcgccgcgacctcgggcggcgcctcctcccggcggactccggcggcaacctcgtcctccgcctccttgggccgcgcggcaggaggaggaggaggaggaggcggcggcggaggcggctccgaggcgaaggcgaggggaacgtcgacgcgagacgcgccgtcgcgttcgggaatgcgggtgtgggcgccggcaatgcgagcctcggcgccctgcgccgccgaggcggcggggtcgttggagacgacggcgaagtggaagtagaagatgaggacccagaacatggcgcagagcgtggcgaggaagcagaggcgcgacgacgccggcttgccgccgcccttgtccacgtcgtcgtggtgggccggcaggaccggccgccgcctcattgaagaccgccccgggcctctccgcaccgacacgggtagctctcaaaaccgaagcacgggccccgtgccacgccacatcaacgccaggccgccgcaaggcgacggacggagggcggaaccgggccgccgaaacagcggcgggatcgggacgggcggccgggcgcggggaaaccggatcggcggatcgcgcgagaccggggttggaggaggagtgggggacgggacgggacggaacggaacggaacgggggaaaagggaggttttggtgtttggctttacgcgggcgctccggacgacggaggcggagcgcgagaggctttcgctagcgtccggccggcgtgggattttgtatgtagcctgcgatttggaggcttttgaactgggcacgggcgtttattattgccggtggcggggacggacgggggagagacgtggcggccgggcgtgttcggtgctgggtggggcagccggttgcgcgggacgtggggcagtagtggcgtgcgcgtagccgacgtggcggtggccgctggccagtggggacggagaaagccagcaacgccgggaacggaatggggagcgtgactgcggagagtgactacgcggacaatttccccggtcaccggcgtgagtcgttgctggtgtggtctacagctgtggcacgcggaccgtgcccgtgtcttgctgcggcctgggactgagaggttggggtgctttccagacgctgtgcaagttgaaatcttgtcttgtaccgtggcagtggcaggcttgcaccgtcggatggcgacagcgtgttgacatcggcaagcagcgtcgaaacggtggtcatcaagtgcacgcccgtcacctctttttcacccgctgtcatgtgcatttggcatgcgagttaaccctgacatcagatggatgatggaacaacatgtcgcccgaccacgaagctaccattgatagatagagtatacttcagcatcgtctggggctgtacgtcgtgggggtcgactataatgtggcagaaaactctcaacagtcggtactctccgaacaattaataataatccattcgcaaaaaaccagttgacctagaaattgataagcacagtaaaaaaaaaaggtactacgaaacaggagtagtacaccagaccagtggactttcagccgacctacattctgtcttggactttgtcatacaggcaatgtagtactacaaaagtacagaacaacaactggccgcttaatcattgccgatgcgctttgtttacacctgttgaggaggtcatgaccatgatcagcggcggggcaaaggacaaagagtagtagagcacaggtcacatggatccaactatccaaaggacaggtgcgccgtgcgcgaaagccacagcgccgcggcagcaggcgaccgactgaccgagacagcacataaaaaaaccggaaccgggaaccgtgggactgggacggccggcgctccactccacccacacagacagacgtgcgtgcgccggccggccgtcggtggcgctgtcccggcgtcacggcggccgcgtgtccagtggccacggccgctacgtcagttccgtggcctgcaggccgcaggcgtgacgtgccgggctcgcgcggcagccgggccggccggcaggtgcagagcgagcagcagaggtcacgccgacgccgtcccgtgacagcaggatccgccgcatcagatcccaaaagcaaagcgggatgggcggcggttccgttctgccgacactggctccgatgcatctgctctctcttttcttttccttggccgcggtgcaattcctggatgctgtccttgaccacggtcggagctcgtaaaacgtagagtagtaaaaaatagaccggtagaaattttggatgcacgtgggttgggttggagctccaagggccaaatgacgtcttggccaattttatactactgcgtacgtaaggttcaggtctgatttctgaaccctccctgatacgcgatctcgttcttttggactgaaccgctgatgctcattactactgtactactactagtagttcctttgtgctgtcttcaaaacactagcacctctttaagcgcagggattttacagaaatcaattcacttttcacacaaaagctaacaaaacataaccaaaaaagaaaaaccatcgttccaaagaggcatcgactcgagtagtcgagttccaccttccacgtcacggcggaaagaaaccaacagcagcagctgctactgctttactaccgtttggtgaaaccagagatccaaaaatcagcatcgcatgacgcattgacgcgtaccaactgcctccacgcgtccgtcttcctcgccccaccccccatcatgtccggtccctccactgtccccatggagccccatggcatttatcgtttcagagatctgtggcgtcatcgtcgccggggagtgggcctcacgttcacgtacgccgaaggtctgcgcctgatggcctggtgtcggtctaattaagtgagaggggtttggttggctgcttgccctaactgcgccgattgctgccatttgtcaacccgcgagcctccaaagaaaaaaaaaggttgggcgcataaaaaagtgtcgtcagctgcggacatgaccacat

SEQ ID NO: 24272 - DNA, 1399 bp, Zea mays
ttttttttttttttttgcagaaaaacagccactagttatctgaatactgcatcccaaaacaaacaaagaaaggaagaaagaaagaaaaggcaaggacgcgcctacgaatcgcagactccgcagctcctgcggcactgcccaggcgccccctcatcgccggcgccgagcatgtacgccgggttccaggcgcactcacccgccgcggcccacttcgcgcagcgctcgctcctatcggcgcacccgcgcgccgtcggtttcctcggggagcacgagtactgcctggggttcgtcctcgtacgacctgacgtggatccacttgggcgccgaccacttctcgccccggatcaccgggcagctcccgtggaggctgagcgggtccggcgtgccgtcggcgtgcaggctgaagaagagcacggcgtcgcctttcaccggtttcactgccaatcctttgtgtgcacactcggagaaagtggcgtccttgggctgggactcccaacccttggcgttggggaacacggtctcgcctccctcgcggacggtggacaggtacatgagcacggtggcgtagcggtggccgccgcgggcctggttgaccctgtcgtggaagtagtcgaagtgcggctcgtacttctgccccggctcgtagcgcagcacctgcatgttctcggcgttctcttgaggaagaaacgtccatgccgcgatcctctcctcgatccgactcaccaccgggtcctggcgcttgtcgaggaacatgccggagctggtgcgcacctcgctcttgacgctcttgccggactcgttgtccgccaccatggaccgctggatctttttcttcgccagagtcacgaggtggtcacactcggcgtcggagaggaaccccttgtacacgaagatccttggatgccacgagacggccttgacacgcgaggagttgaacggcggcgcaggtgcgacgccgccgccgccgttctcgctaaggagcagcaccggcacgatggcggtggcggcgaggaggagcgcgaggacgaggcgcagcacgccgcggagcctcatggcgatcgatcgatgacgatgctgcccaatcactactgcaggacgtacggatggagaaacgcgagctcctacttctgcgacgacggcagctagccgtggtgggcaccagtcgccggagctttatacaccggctccggtgcttgacttgactttaacggccggcgccagggggtgttccgctcgctgagtcgtctgatcctgtgggtctgtcgtcgccgccggggttttgtcgtgtgcgcgcggtcgccggagtcgtcggccgggtcggtgcgcgcggccgctggtttttctgcgtgggggtggccagtggcctgcacgcgtgcccacgggcatgtgcccggggaga

SEQ ID NO: 24273 - DNA, 875 bp, Zea mays
gcaccgggcccccccccccccgcccaggaaacccggtatagcatgaaggaacgtttttttggcgtgttgatctctctcctcctccagtcctcccccgtcctgcaggagtaaagcctgttccaggcgaggggacgagaagggaagggttcttggggggagagggaagaagatggcgcgcaatgcggtggacaaggcgacgtctatcgatgcgcagctgcggctgctggccccgcagaagctctctgacgacgacaagcttgtcgagtacgacgccctgctcctcgaccggttcctcgacatcctacaggacctgcacggcgaggacatcagggagacggtgcaagaatgttacgagttagctgctgagtatgaaaataagcttgaccccaaaatgctggatgagattgggaatgtgctgaccagcttggatcctggagactccattgtcataaccaagtcattctcacacatgctgatcctggcaaacttggctgaggaggtacaaattgcataccgcaggagaataaaactgaagaagggtgactttgttgatgagaactcagcaacaactgaatcagacattgaggagacactaaagaggcttatgcatcagcttaagaaatcccctctggaggtatttgatgctctcaagaatcaaactgttgacctcgtcctgactgcacatccaactcagtcagtccggagatcattgcttcaaaagcatggcaggataagaaactgtttaactcaactttatgcaaaggacatcactccagatgagaaacaggaacttgatgaagcacttcaaagagagatttcagctgcctttagaactgatgaatcaggcgggcgcctcctactccgcaggatgaaat

SEQ ID NO: 24274 - DNA, 698 bp, Zea mays
gcccgtgcccgcgcgttccccgtcgccgcgggagctggcgcgcgtgaccgccgagggtgtcgcggatatggtggacgagtcggggccacggcgttcgggaacgcgtgcggacgcagctacgtacgcgtccaggccggcaaggcgccggcgccgctccacgcggccaccgcgtccgcggcagcggcggcgatgctcgcgcagcggaacgtggagtcggtgctgttccgggggcgaaggctgtcggagcggactaacgccgagaaggtggacgcgctggccgtggagcttgttaaggagcaggagcgccggcggcgcagcccgcttccgaacgtggccatcaagcaggtggccacgccgcggctgtcgtcggcgaccgcgacgtcaggcaccgcgacggcaaggaccgcgtcggccatgccgtcgccggcgtcgtgggattctcgccgatagttgtgttaattaggccgtggcgcgatgacgagtttttgttttcaaatgcatgtcactaacaagggtagagcagtgacgtgtgttcttttgcataatgggtcaccgacaagtttgaaaatgaattcattttcatatacacgaacgtgtactgctctaaagttattcacaaatggagattcaaccgtggttgttaactccaaattatccacatccatagacggatctatgatccaatcacatctcgatcc

SEQ ID NO: 24275 - DNA, 1145 bp, Zea mays
aaaggagtatcacgagcgtcgaggtcgagcgaacccaacgcatctccgcagttagcagcacgcacccagagcaagcccaagtgcccaatcaacaaacccagaccgccagacggcaaccgttgtcatctctcactccacggcgccggccatcgtcactcacacgcccagcaccgcagcacgacaccatcgcgccctggccatcctcccgttcacgtgcacctaccgcacgcaccaccgcggaaagtaaccccgagatccagcgccatcggcacgaccaggcctgtccagggatggggcggagaggggagccctactacgtcgaagcggcgccgccggtggacgtgaacaagaacacagagtggttcatgtacccgggcgtctggaccacctacatcctcctgctcttcttcgcttggctcctcgtcctctccgtctctggttgctcccccggagcagcctggaccgtcgtaaacctcgcgcacttcgccatcacttaccacttcttccattggaagaaaggaaccccttttgctgctgatgaccaaggcatctacagcagattgacatggtgggagcaaattgacaatggtcagcagcttactcggaacagaaagtttttgactgtggtacctgtggtgctgtatctgatcgcatcgcacttgactgactacaagcagccgatgtttttcctcaatacaatggcagtttttgtgctagttgtggcaaaattgccaaacatgcacaaggtccgcatatttggaatcaatggagacatctgaggaccactgcaggaagtacatggatgcaatgccatgatgtgatgaagagctaaacagaacaagcagtgtgtttctcaaacttgacacaactgtctgtaatatatgtacaggtttaggaagaactgtaaatgttactctaccatagaagctttgccagcggactggcctgtgttgttgccgttgctgctttcttttgagtttcactggaaggggaaacggtaactccggtaaacaaccaccagcatgtggataagaaaaaaggaagtgtgtagcagatgctatttggtatctggttcgattgaaccaagaaatcagttaagttcatatttttgtcttaaaaaaaaaaaaaaaaaaactcgagcccgg

SEQ ID NO: 24276 - DNA, 1060 bp, Zea mays
cagtagtatcttgaacgtcgagccctcccggcccgccgccgcagtccacaaatccgcacccaaagcaagcccaacgaaacccagacggcaacgagacagttgtcatctcactccaccgcaccgtccgcgcacggctcgccggccgtcactcacacaaccagcacgacaccatccgttcctggccttcctcccgtgcaactaccactcgcgtcaccgcggaaattaaccccgaaatccagcgccttcggcacgagcacgaccaggcctgcgcaggagatggggcggagaggggagccctactacgtcgaggcggtgccgccggtggacgtgaacaagaacacagagtggttcatgtacccgggcgtctggaccacctacatcctcatgctcttcttcgcctggcttctcgtcctctccgtctctggttgctccccgggggcagcctggaccgtcgtcaacctcgcgcacttcgccatcacttaccacttcttccattggaagaaaggaaccccttttgctgctgatgaccaaggcatctacagcagattgacatggtgggagcaaattgacaatggtcagcagcttactcggaacaggaagtttttaactgtggtacctgtggtgctgtatctgattgcgtcgcacttgaccgactacaagcagccgatgttttttctcaacacgattgcagttttcgtgctggtcgtggcaaaattgccgaacatgcacaaggtccgcatatttggaatcaatgcagacatctgaggacagctgcaagaagtacatggatgcgatgccatgatgttatgaacaagcagtgtgtttctcaaactcgacacaactgcctgtaatatatgtacaggtttagaaagaactgtaaatgaatgatactctaggatacaaggtttgcctgcagactgctctgtgttgccgttgccgctgctttcttttgagtttcactgaaagtggaaaccataacttgggtaaatgtaacgttcggttttcagcttcagcaagacaataatttaccagcaaaaatgtttcaaaaaaaaaaaaaaaa

SEQ ID NO: 24277 - DNA, 979 bp, Zea mays
agctataaatcaaatatgattgatgtgttgttacaacgtattatactagtaatggtttaagctatattccatagaccacgaccacgtcatgtatatacaaagcatgaattattagtgacccggaggaatacttccaaccaaacgcattgtaaaaccaagttagttaaattttgcaatattgtcttcgaaatggcactgcctacacggagtgactgtgacaccgtactcaccgagcagctgtactcaccgagcactgtctagagtagtttacatggagtaagagaacactggcaccggcggtgcaaaaaacggcacacgggtacatgcagaggccgccggtcgatgcaagacaaacagcttctgtcgttccggggcatgcatggcgatcgcgcgagcggatgcgcgtcttcctcttcagagagctcgcgccctgacaatgtccatgctcatctcgctggggtcggtggcctgcagctccagctggatgccctccagctccctcttgaaccggtccttggagctcgcgtacagcatcttgctcctgaccctcgaggtgtccggggaccaggagatgaacaagatcttgctcttctggcagttctcgtcggtggtgaagtcgaagtcgaagacggcgtagcggcactcgctctcgggcatggagccggtgaagtcgtcgtaggtgtcgcccggctgccccagcctgtccaccaccacctgctgcgtctgctcgttgatcttgaacgtgatgaaccggaagcttcgcttcgacttgagctcctggaacttgagcttgcactcgtcgctcacggccatccccgacgccgagttcgccatggttgatgggtttgttctgtttccacagccgagctcgacggtgccgggcgagaaggaggggacacggggaggcggtgcgcgatggcgatggcgatggcgatggcaatcgcgccgagacgggggagcagaggtttttaaggccaga

SEQ ID NO: 24278 - DNA, 1848 bp, Zea mays
  misc_feature (1830)..(1830): n is a, c, g, or t
  misc_feature (1845)..(1846): n is a, c, g, or t
ggccgctttttttttttttttttagcaaagtcgaccacaaattcacgacaatttcatgtacagacagaaggaactaagttgcaggtaatacaaattttgtcaataaccaatcaaacttaagtcttttttttttttttttgctggaaagaaaacttattttatttcaagtaaacaatgatgcaaattgcaatgaatcacatgctctcaagaaaaaacaaggatattcgacgcgttcacagctctacactctaatgaaaactaaacaacccctctggctatgcacacaactttcttcccgatggcactgccccatggccatgaaatgaacacaggcttctacaaatcctttttggatgattgcctgcctatctagagatacactcttgatgcagcatggaaaactggaggaagacactacctacctagcaggcgcgaacctcagtgaaccggcttgaagctggctcacagttgctgttactaagtttgagggagccaaagaggcaggacaatctcctcatgatgggactgcgagtggctacttccaacgacaccgcatctttcctggtaccaatataagtatcatagccctcaagatctgcttctgttacgaggactgcatcggtgcacccagacccagtggggctggctggcctaggtagcataatttgataaagtggtaagccactatcttcgcagtcaaactccatcacgtggtaatcatcatttcctgttgtgttcgtacagccagcttcaatggcttctaggaaacaggccaggtttgtactccgtactggaagttgtccaccggtgagagctccaaatgaattaacagcctgcaaaattgtgtggattgtcatagtgtcttaacgccagtagtattgtactaataacttataaagcaatcacaaaagactgcatacatgccactgcgagggtgccaaaagcactcgaggcctaatggatcgtacatgatccaaagctgcttcaggggtcatgttcctgtatttaatcaagtagcacaatacaatagtggtgcttcgtcctcttccagctttacaatgaacatatgtagtaccgccttgtgatgcattccgatggatgaaatctatggcttgagaaatatcctcgagtgaaggtgcaaagaggtaatctcttgttggaattaccaggtgctcaatctcattagcctggtataaagatgttgggacaagagtttcataaggttcattcaacgttacaaccccttgaactccaagctgcttcaaccgtggaacatcacttgggaaaggaacagcgcccagcaaaataaactggtcgacgcgatcccaccaccggaagtccgcctcgaaccggttgcgcaagacgttgtagagcagcgtcgggtagaacagcaccctcgcgccggcgccgacgagcgcgtgcttcgccttaagccgcacgagctcgccgctcgcctggacctcctcctgctgctcttgctgaaacaccaggcccgcgacgtcgtcaccatctcccgattcgcagatcctcatttcccaccaccgcagcagcagctcgcgaatcctcgcgccgagacgcctccagcgtccgcctccgcttccacaacgagaagatccgtggaggcacggaagagggagggaaatcggtggatcgagacagtggggtagccttgctcgcgaccgtggcctggggacgcgagaaatgggacgagtgatttttgtctaaaaccccagcagcagaaggcggaatggcggaatgcggaaacaggtggcacggattgctgattcgggccggcctcgaggtaccctttgttttcctctttttttgatngtcacctcccggccnngg

SEQ ID NO: 24279 - DNA, 1767 bp, Zea mays
cttttaactgcaccggtgatggacaagaatatgtagttttggccactcgttgttaatctaactgatacctttaaagagttattatttttctcttttgggcaattcaagagttcttgttttcatcaaatataaaggaagcaaacttctgacaccctaaaagttctcagataatgaacaatagaattttcacttcaaatagtttcataatatacaatcgtatcatgatgcataaaggatcatacatcgtttatacatgacaaagaaattattacttcatttgtataaggatattgttggaatgcaattcggtaagggtatggcagagggaatttcattccaaagttccgtatctagcctttcatttgcatgaaaacacattattttttagatccagagaccagtacatattattgtgtcatactcacacgtgccttgcaatttacaaactgaacattcaactttctgggacatgtttttggtttcaaacctttacagcatggactctgtcatatacttgtgtaattagggaggcaatagattgtcaagattccagacttctcgagtgatctgcaagtaattttaatgtggttgctggtgattttgcaaaaataactgcataaccatcatccatgtgatcagcgctttcagggaaaagctgccaaacaatgcagccttctccaatcaccccagtcttccaagagcgcaaaaaaatgttgtacactgtatccatgaaagcttcacgaaacttatggtcaaactttccatccttaagcgataccccaaactccccgatcagaattggcatcccaagcaagttggctgcatcatcaatatgctgttgcatccaggttttcacaaaatggaggtgactgtcctcttcagagtgagttaaccaattgtcagaataaatatgaacagaagccaaatcaattcccagtgcatgatggttcctgataaaatctgttccaatagttccagaataagcatctgggttcacgtgcagaagttctggagtcgacggaccataaaacccttcaacaccgatctctaaaaggtgcacagggtctatatccttcacataagacgccatctcttctatccatgcctgcaatgtgtcgcctgatggatcggaatggcagcgtggctcattaatcagctcccaggcaagaatcgtagggtcatccatgtaggcgacatttgtgattgtgttttttcttgtcaaaacagccttaacaaaagctttatagtagctcttgattgtggcatgagagaagaaagcgtcgtcatcggaagtaagatccaggccagcctcatttccccaccttacatactgtgccttacctccgtaatcttcccagttattacacagtgccagtatcagtctcatcctgtggtttcttgcctcgctgatcacgaaatctaaagcctggaagacctcctcgtcgtaggagaagggcttgagctgcagcgcgcggtgccccccgtcgttgaaggcccaggtgcggcacacgttgagccccgagcgggcggcgtccgcgagggcggctgtgacggcggcgcgcgttgcggggtcggccgcgaagtacatgagccagtaggtgttgaagccgtggacgacgaagggtcgccccgacgcccacaggtgcgggccccggcgctccaccgccgcccactcgccctcgtcggcgaccggcggcatggcgggggggatgcaggaggccacgaggaggacgcagcggaggagcggcaggcgcggcgtcgttcgga

SEQ ID NO: 24280 - DNA, 1658 bp, Zea mays
atctcaaccaagttatcatttatttaccatgctgaaaaacatgaggtcagaaggctaaattttttttccactcagcccagccacacacacaaaaaaaaagagggggaaaagatggagaaaaactagccggtccacacactagactagatcctgagcatttaccatattaggcacctttgcatgccaaaaacacctggtgtccaaactagaaactccctatttagaatagaaatcaccggacgcctccgccgtttggcgttaattttggactggcgaagaaaatgcaggcccccctgctgctgctgcacgtccgtcaaatagattggtagggagcccagagggtgatgggaatggcgaaggagcagcacttcgtgcttgttcatggcgaagggcatggggcctggtgctggttcaagctccgctggctcctcgagggcgctggccaccgtgtcacgtgcgttgacctggccggaggcggcgtcgatcctaccgaccccaacaccatccggtccttcaagcagtacgacaagccgctcatagacctcatctccaacttgccagacggagagaaggtgattctgatcggacatggcgctggagggctgagtgtgatccatgcaatgcatgaatttgttgacaggatcggtcaagcatttttcgtggccgccacaatgctgccgtttggatttcaagccgatgaagataagaacgatgggttaccgactttgcccgagaacgagattgagttgacacttggtgcaggagcagatgatcctccaacaaccattgccttgaggccagaattccagcgtgatcgactatcacaacaaagccctgaagaggaatcagtacttgcttcaatgctgatgcgtccgtggcctgcaacagctatcagtacagcaagcttcgaaggagatgatgagagattgaaccgaatcaaacgaactttcataaagatggagcgcgaccacatgctggatcctcaacagcaagactccatgatcaaaaagtggccacccagtgaggttttggtcatagatacagatcacagccccttcttctctgcaccagaacagctgttcaatttaatagtcaaatctctatgatgacaaatgcagaaagctactgactggggttgcccaaattcttgtaacactacccacaaacaataatcaccacaagatttaggacctcagatttgtcaaacatgcttctcaatgaatcttcctggcatatccgcatatctacaaatatggtttaatggtgcaagattgcaagtaaaagatcgcttagcgcaaacacttaaattcagttttttgaacaactcactcaagtcagagcctttataatttccataccaaaagttcttacatgtcacgcataaaaaacataaaatatagatgctactttggaagcacttttaattgcaccggtgatggataacaatatatagtttggaccagtttttgttaacctgagttccctcttaatgaaaggcatgtcatcggaaatgttctaaaaaaagttaatgtgatgaggccttcagagttatcactttcctctttttagcaattcaagagttcttgttttcatcaaataactgatgagcaatagaattttcacttcaaatagtttcataatatacaatcacctcatga

SEQ ID NO: 24281 - DNA, 1000 bp, Zea mays
acgctgacgcgtgtgctgactcgtgggctgacgcccggccgggcgcctaatttggattgtccacgaaaatgcagctcccctgcctcatgcccatcaaatcgttaaacttgttagatcggtaggcagagagaggccagactgatgggaatggcagcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtgattctaatcggacatggtgctggagggctgagtgtgattcatgcaatgcacgaatttgttgacagaatcagccaagcattttttgtggcagctacaatgctaccatttggatttcaagctgatgaagataagaaagatgggttaccaactttgcctgagaacgagattgagttgacacttggtgcgggagcagatgatcctccaacaaccatttccttgaggccagaattccagcgtgatcgactatcacaacaaagccctgaagaggaatcagtacttgcttcaatgctgatgcgtccgtggcctgcaacagctatcagtacagcaagcttcgaaggagatgatgaaagattgaaccgaatcaaacgaattttcataaagatgcagcgtgaccacatgctggatcctcaacagcagattccatgatcaagaagtggccacccagcgaggttttggccatagatacagatcacagtcccttcttctctgcaccagaacagctgtttaatttaatagtcaaatctctatgatgcataaatgcagaaagctacagactggggttgcccggattcttgtaacactacccacaaacaataatcaccacaagatttacgacctcagatttgtc

SEQ ID NO: 24282 - DNA, 5541 bp, Zea mays
  misc_feature (1948)..(1948): n is a, c, g, or t
gacagagagagggggggaaagctgaaatgaaaatgaactatatatgttagtgtcaatacaatgtttacagctcccatttctgagtcgtaattcaacatgcaggagtagtgaaagatttgaaacttaccagtataccgacaatatgatcaattttgaccaagagactaccaacattgtggtattaataattgtcactatactagatatgaacaaatttacaacaataatatgcaatatccatacaccataacaaaagaatatgacaaaactaaattgctgcaaatatttccaacttctctgagaaactgatgaaactatttgatgccaagatgccaacttgccttcagatcataggaagggcttctacagttcagatcataggaatggcttctactgacattgccgagagctcagttgacacttgacacagtgcgtcgggtgtacataaagacagccaatgaccacatggtgaagccggagcaccaggacgaggcggtgattcgactgtggctgccgagcaaggtggtggtaatggacacttgaccacagccctttctcctccacgccggagcgagctgatcctcaagtcattgtgatctgtaagcgatggtgtatcgtagtcccgttggaggttccacctgttctgttctttcagtggtgctatatgtaagccaatcaagttatcattcatctatcaatataaaaaaaaggaggaaaaaccatgaggtgagaaggctaaatatataccactctcagtcacacacaaggaaagaaaggaggaaaactagctggtccacacactatatcccgatcatctaccatattaggcaactctgcatgccagaaatgcaggctcctccagtcctgagaccctctatttacaataggaatcaccggaagccttgtcggtttgacataatttggattgtccacgaaaatgcagctcccctgcctcatgcccatcaaatcgttaaacttgttagatcggtaggcagagagaggccagactgatgggaatggcagcgaaggagcactttgtgcttgttcatggtgaagggcatggagcctggtgctggttcaagctccgctggctccttgagggtgctggctaccatgttacatgcattgacctagccggaggcggcgtcgatcctactgaccccaacacaatccggtcgttccagcagtacgacaagccactcatagacctcatttcaaccttgccggagggggagaaggtacgtgtattcttccttttttgccaacacatttaatataagtggtaattaggtaatatgttggcataatctataatatcattactacgggttgcaatgtaaatgaccagaagccaaatgtttcatgccattttgaataaaaggtgtattagattgcacaaaagtaggtgcaacctattttaaataaatcttaaaacatgtgcttaagtctgctagatgtatctatcttcttgtatttccccattgtataattggtttactgtatattttccctcctgtaccggtgtatatatatatcggccttagtgtctcataatgaatgcaaatgctattcataacaaagtcatgatccttgacattttatctaggataacacctgaaaaataccttatacctgtgttctacaagaaaaagttggaaattatgtgaccccagcaaacgtacataaggaagtcaaggatctatttaagaataatgttgaaaattgatgaccatgcatgctaacccatttcagtcctattctaggtgattctaatcggacatggtgctggagggctgagtgtgattcatgcaatgcacgaatttgttgacagaatcagccaagcattttttgtggcagctacaatgctaccatttggatttcaagctgatgaagataagaaagatgtaatgttttgaagagtttgtttgtcctctttataaagcatagntctcctggcaatgataaaaaaaatataagccatagactacacatcaaacaaacatatacatacagtgcaaacattaaggtttttattatagaaaaggaaatgtaataactcatatgagcatgggtccacctagttgcagtagctactaaaatgtgtttgatcaaaagtagggtaatacggtggataatgtcaactaggaacctagttacctaaaagactgactcactgttagcatagtcaaatgcatagtagacaagaaagagaaagttgacggaattttagaagaactctgaaacgactatatgaacttaccttaggtcgtggtgaattcactgcaactaatcttctgttacaatacaatgtatgattattacatacttcttatattaacatgtaacaggggttaccaactttgcctgagaacgagattgagttgacacttggtgcgggagcagatgatcctccaacaaccatttccttgaggccagaattccagcgtgatcgactatcacaacaaagccctgaagaggtactacatatttatattgaatgaaatgtgccatgagagaaacattgaagcaagaatggaaaacataatctcactaagcatagtaaacttatgtgggaatgatctcacgaaagccaccctttttattaaactactaattatgtcacaaaaatctattaaacatttgattttcataattcatcataaaaatatatgtatatattattcccctttagtatttcctaagtattcattaaacatctgctccaatgaaaggtgaataatgatgcagaggttacttacatccttattttcgtcttgcatccttatttttatctggtataggaatcagtacttgcttcaatgctgatgcgtccgtggcctgcaacagctatcagtacagcaagcttcgaaggagatgatgaaagattgaaccgaatcaaacgaattttcataaagatgcagcgtgaccacatgctggatcctcaacagcaagattccatgatcaagaagtggccacccagcgaggttttggccatagatacagatcacagccccttcttctctgcaccagaacagctgttcaatttaatagtcaaatctctatgatgcataaatgcagaaagctacagactggggttgcccggattcttgtaacactacccacaaacaataatcaccacaagatttacgacctcagatttgtcaaacatgcttctcagtgattcttcaagtcatatctgcaaatgtggtttaatgatgcaagactgcaagtaaaacatcgcttagcgcaaacacttaccttcagttttttgaacaattcactaaagtcagagccttataatttccattccaaaagttcttacatgtctggataaaaatatgtaaaatatagatgctactttggaagcacttttaactgcaccggtgatggataagaatatgtagttttggccactcgttgttaatctaactgatacgtttaaagagttattatttttctcttttgagtaattcaagagttcttgttttcatcaaatataaaggaagcaaacttctgacaccctaaaagttctcagataatgaacaatagaattttcacttcaaatagtttcataatatacaatcgcctcatgacgtgtaaaggatcatacaccgtttatacgtgacaaagaaattattacttcatttgtataaggatattgttggaatgcaattcggtaagggcatggcagagggaatttcattccaaagttccatatctagcctttcatttgcatgaaaaaaacattattttttagatccagagaccagtacatattattgtgtcatactcacacgtgccttgcaatttacaaactgaactttctgagacatgtttttggtttgcaaacccttatagcatggattctgtcatatacttgtgtaattagggaggcaacagattgtcaagattccagacttctcgagtgatctgcaagtaattttaatgtggtttctggtgattttgcaaaaataactgcataaccatcatccatgtgctcagcgctttcagggaaaagctgccaaacaaggcagcctcctccaatcaccccagtcttccaagagcgcaaaaaaatgttgtagactgtatccatgaaagcttcacgaaacttatggccaaactttccatccttaagcgataccccaaactccccgatcagaattggcatcccaagcaagttggctgcatcatcaatatgctgttgcatccaggttttcacaaaatggaggtgactgacctcttcagagtgagtcaacctggcaaaaggatctcactcagtcaggataatgaattcaatctcatgaagtgcatagatgaagcatttatagctgctcagctacaaaactcgtagtggaaacatgtctacatgaggacttaccaattgtcagaataaatatgaacagaagccaaatcaattcccagtgcatgatggttcctgataaaatctgtcccaatagttccagaataagcatctgggttcacgtgcagaagttctggagtcgacggaccataaaacccttcaacaccgatctctaaaaggtgcacagggtctatatccttcacataagacgccatctcttctatccatgcctacaagaaacaccaagtgttaaaacgcctgtagtatagggaaaaaaacagaaggaaacagatctgtaacagatagaaagcaaagtaaggacctgcaatgtgtcgcctgatggatcggaatggcagtgtggctcattaatcagctcccaggcaagaatcgtagggtcatccatgtaggcgacatttgtgattgtgttttttcttgtcaaaacagcctaatacatgaaagaacaacgtacgtttgtgatggcaagacatgacagaacagcgatcaaacaaaacgagtgccgtaagaaacagctgttgtcgagaattaaggtcacgaagctatggatacaccgagactcagctgtccattttgggccatgcaagcaggacgtttaccttaacaaaagctttatagtagctcttgattgtggcgtgagagaagaaagcgtcgtcatcggaagtaagatccaggccagcctcctttccccaccttacatactgtgccttacctccgtaatcttcccagttattacacagtgacagtatcagtctcatcttatggtttcttgcctcgctgatcacgaaatctaatgcctgtaacaataatgggatttctaagctctgcttaggtgtcacttgcttagtatgtactaataactagtagtactcgtactactgcacagatacggggaatgtagtacaaatgctggacgatggcaataaatgatgtgaagacgcgacgaccatgtaccaatcatttcatcgaacaagcaccgcgcatactagcacctggaagacctcctcgtcgtaggagaagggcttgagctgcagcgcgcggtgccccccgtcgttgaaggcccaggtgcggcacacgttgagccccgagtgggcggcgtccgcgagggcggcggtgacggcggcgcgcgttgcggggtcggaagcgaagtacatgagccagtaggt

SEQ ID NO: 24283 - DNA, 1152 bp, Zea mays
ggccgcttttttttttttttttttttgctccaaccgaacatcggattaatttgcctgaaaactagcaaaagttgctttacacaaggtacgtagtaactgatttgatattactcgctacaattcatcaaagtaataagcatcatctactgtacatatatgttatattactcgctacaacaacaaagacatgttgggtaaactttgatatcatgaacacatcacccttctagtgacgccttgcctggtaaacctcttattgtatgcttgcactggaaccaaataacatctgaaagagaagattctgaagtcgaacatggggaatcaacaagaggcatatggtgctggttatgccctgaacaccctgatttactgcactttatatgcatttgaagaggtacaacctttttgctgtaacgaaaatcaagctttggcaggaaatccagtggtagctttaatgtactggagcatcttaccaacaaaaacaacttgctaggtcctgtgtaggacagactcccagctccacgtgatacaagagcacggatagccttccgagaaacagattgggctaacttggttagagcatgttctttggcacttcctggaccaaagataccatgagaaattgtaatgtcataaacaaataggggccgtacaaggcttcctccaagtatcaggacaactccttcaatgctagaaacttcatcaagtgcgtgctgaagagaacagagtaaggtagagatgccattcatcaacttctcgtgcttctttattctacgtctaacctccgtttttcgtgtgttgtactttctccgatcagatggtttgagttcagctggttgtaatgccatttctgtcatttcctcctttaaacttgcaaattcattttcaagactcggcaaaaccgaggggatctggtggtgcatgtagaggacgaagcctacgagctccttcaagacgtggaacacctctgaccgccgcagtgctgccgtcgccgcttgcacctccacaggtcctataccccgctgttgggcgccgccgcctccgcatgaagagatgtcagtctccatctcgtcgtgatctcgccgccccgtcccgctccacacccaccgccgaccgttaatacgagttcgaaatttttttaaggttgttctc

SEQ ID NO: 24284 - DNA, 1825 bp, Zea mays
aaaaaaaaacaacgggaagaaacggctccgttcccaacccactcgcacattcacgagactcacttacctctctcctcactaataagtactccctccaggtacaaattctgtaaaagattttgagtcagagtagtaaaactttgaccgactagaccatgcatgccgctcatatacacagagatgaattattcactcatgcatgcacttgaccatcagccggccaataacattcaaacaagcaagagtgcaagacaaatactacaagttttcatccagggacatctccatcggccgacttgctttgaactgcacttacaaacacaagcacgatcacttaacttacactgcttatactccacaaacacgcagtatctctgggctattcctgacagatgagataaatagctatctatcgtacatgctaaggctgttaatgtgaggtctgccagaattgtattgcttcctacaaaattcttgaatgtcaaatagaccctacacggtgaagaaacctaacaaaactttcactgccatgtcaccgctaacagcaaatcagacagcttcatcatgccaacaacactcaacatgaacagcaatttaagattaatttaaatccctatgagcttttgacctagcccctgacataaaaccagacatccaagacactacaagtataaagatgctgcaaacactatgtccctcttgatcttgttgaccgcctcctcgagttttgcttctaactcggtttccccaatggacttggatgccagaatcagctgctgcagaacctcctccagcctcctgatggccctgatcaggcttccttcgaacacttgggtcatctccatgatttggtagaacttcgaccctctggcccatgaatacaccgcttccattatgtcgggtcggaaagaattcacaaaactttccacatcgatctggatcttgcattcaagctgaaggttagcaacccttcttgctgtctcccaattcacacatgaggcagcaatttcattatgatggtttggtagcactaactaccttgcattcaagctgaaggttagcaacccttcttgctgtctcctgcagctggtagaagagcaaatcgagctcctctcttggcttcggagcatcctggagcttctcctgccaaacaaagcaagagagcagtgccaccacctgctctactgtagcatccttcagagcaccactaaacataagctctgtcaatgtaagctcatcagctgaacttatctcacacgccactttgcccttaacttccacaacatcatcactcgtaacatacctgaaataaagatatctcttcttgacaaattggtaggattatctgatatacaagatagttgcagcatggtatcttacagaagcaacatcaagcatatgcacctaaatctttccacagaaaatttggttgaggacacagacaagaacacatgataaaattatatctttcaaattgacagtgagattcttacaacttaatacagaacagacaaaaaaatcccattttatttcaaatgaaaccaaatttgacatgacagtagaagatgcttctaacttggtcaaaatagcatattccctgtctcaaaatagttgtcgttctcgcttttcgaggagtcaaccatttttaaccttggccaaatatatacaagaaaatactaatatttatagtacataattagttgggctagatcaacaacaacgacaaagtcttttaagtcccaaacaatttgggtagggatgaaaacgaatacttattcagataccagtttttcggacatttttctttgattgtgaataaatagga

SEQ ID NO: 24285 - DNA, 1166 bp, Zea mays
ttttgaccatcagccggccaataacattcaaacaagcaagagtgcaagacaaatactacaagttttcatccagggacatctccatcggccgacttgctttgaactgcacttacaaacacaagcacgatcacttaacttacactgcttatactccacaaacacgcagtatctctgggctattcctgacagatgagataaatagctatctatcgtacatgctaaggctgtttttgtgaggtctgccagaattgtattgcttcctacaaaattcttgaatgtcaaatagaccctacacggtgaagaaacctaacaaaactttcactgccatgtcaccgctaacagcaaatcagacagcttcatcatgccaacaacactcaacatgaacagcaatttaagattaatttaaatccctatgagcttttgacctagcccctgacataaaaccagacatccaagacactacaagtataaagatgctgcaaacactatgtccctcttgatcttgttgaccgcctcctcgagttttgcttctaactcggtttccccaatggacttggatgccagaatcagctgctgcagaacctcctccagcctcctgatggccctgatcaggcttccttcgaacacttgggtcatctccatgatttggtagaacttcgaccctctggcccatgaatacaccgcttccattatgtcgggtcggaaagaattcacaaaactttccacatcgatctggatcttgcattcaagctgaaggttagcaacccttcttgctgtctcctgcagctggtagaagagcaaatcgagctcctctcttggcttcggagcatcctggagcttctcctgccaaacaaagcaagagagcagtgccaccacctgctctactgtagcatccttcagagcaccactaaacataagccccgcccacgcccgcgcggccgcccacccggccgcgcacgccactttgcccttcacttccacaacatcatcactcgtaacataccccagcctgcgaagaacacgttcccgggccttgagttcatccttgaaagctaaaacggtggaagaccgcattgttttctttatggactttattttggctgatagttcttgcttagcatgaaagactttcagcttttgctggaattgagagtacggatcggttc

SEQ ID NO: 24286 - DNA, 1709 bp, Zea mays
ggccgctttttttttttttttttttttgaatcgaatcatggttaatacttcatttcttattatcataagtaatgccctaaaactaccgtatttcaatattacatttcgtgcaacaaatgacaagactctggataacataggtagaccagcaacgcaatctcaaaattgcagtgacaaggataaaataaagttataggttatgatgtttgttgaatgatccttgtccacaaaaggtattatccccaataacaaaacagcaagccacccaaatctcaaccttgctgaatggttaagctccactgccaaacaagccgccatctgcaggccgcggctattggagaaagaaagctacattcgatgttctactgtattgacttagctgacttgaaccttgttatagtgatcggcggccacagatagtgatggtatggtaacaggaagtccgggtcccattgtgctactcagtgtgaacttcttcacatatccgacatattttgaagttttctttaagcccactggcttagcaagtaaaagtgcatgcacaaaagcaccaatattttcacgtaaactctcctcagtaaagtttaccttcccaaggccaacatgcactatagcagttttatctattttgaaatcaacacgtcctgattttgccgctttgaccgcaccagaaacatcattcgtcacagatcctagcttaggattaggcatcaaaccacgtggacccaatatcctagcaacctttgacaatcggggcatgaacattggggttgctatgcacttgtcaaagcttagtttgcctcctcctgtgcggatctcctcaatcaactcatcaccaccaacaacatctgctccggcagctctagcttcgtctgctccaggaccttcagcaaatactgctaccctaacagtcttgccagtgccatgaggcaatgttaaggcgccacgaaccatctggtcaccacgacgaggatcaacacctaatatcacatgagcttcaacagtttcaacaaaattccgcttcttctcgtttgcactagtcttaactaggcggatggcgtcgattaaatcaatggcgaccttctgcggccgcttgacgacgggtatgaccgtcgggtacggcagcctatcctcctcgtgcatcccaaagacgctcctggtgggacgcaccgcgttcatctggatccgctccgactccccctgcagccccccgtcctgcacctcctccacctcgccgccgaccggacggtcctccggcagcggcgcgaccctggacgggtacgagacgggcgagatcgcgggcgccgcgtccttcacgtaccgcatatcctgccgcgtccactcccgcggcggcatcggctgctgaggccgtcgtggcagtggggattggtccctaggggcaacgtccggggttgtcggggcggcagactcctcgggcggggcctgctgctgcggcttcggagcgtaggagacgggcttgatgggaggaggcggcggcgaggcggagctggacttggcgtcggaggagaagtggaagagtgagagcaggcggtggcgctgcgggttccgccgcgagtatgagaagaggagctggaggtgagccatcgggggcgtagcgcgtggttgcggcggtcggcggcgactcgcgaggcctggggttttagtctggaagaagtaggaaattcccggccggcctcgagggtcccaat

SEQ ID NO: 24287 - DNA, 1073 bp, Zea mays
  misc_feature (21)..(21): n is a, c, g, or t
atcgcggccgcgtcgactttntttttttttttttttttttactctcccgatatatcaagttttataggttctaatttgcgtcctttacagttccgttttttttttttttttcaagataagtgctcatgtttgattcagaaactatacatcatctcgtattacagatagtggtacattgatccagattcatgatatataccgctggtggtagctcacacatcccaaatgccgggataggcgtcgaaactccaattttccaaacaatcatgtggtgctattgtgcatgatatctctgattcagcaggctatctgcaccctcgatgagactgatgtccaccaccggagtggaaatggaatcactcctgctgctgctgctgctcttcctcaggttcaggttctggttctggctcgaccgaggtgtacttccggatgacggcgatgatcctctccttgtccctcgtcgggaacgactccaccagcaccccgtccacgtagaaatggaagagcggcacgatcttgatgcgcagccggtccgccacctccgactgctcgtcgtactcgtcgatcacgttgtgcttgaggaagacgacgggggcgccgtcgtcgccggagcccttgcagaggcgcgtgaaggccttctcgatgtacttgcagctgccgcaggagggccggtagaagtccaccaccaccagagcgcccgtggccctggacctgttcaggtggcgctggaactcctcgtccgtcttgaactccgtcacgcagtccacggggcacagctcctcctcctcctccacagggggcaggcccgggagggacccgttcgtgctcccgcccgccgcttctccttctccttcttcgctgctgctgctgctgctctcagtcgcggcggcggccaagcggcggcgccggctgagggtgatccttggaaagggaaggagggtggcggtggcgggacgggagcgggaggcggcgctggaggggaggacgaagacggaggagcggagcgggaggaaggaggagacgatcatggctgcattctagtggtacgtgtgcgtcgatcccggcccggccgg

SEQ ID NO: 24288 - DNA, 4210 bp, Zea mays
  misc_feature (1793)..(1793): n is a, c, g, or t
  misc_feature (3367)..(3368): n is a, c, g, or t
  misc_feature (3934)..(3934): n is a, c, g, or t
ctgcagccgcactgatgacagcacggtggtggctggaagcagagatcagcagaggagtaaaaggatgttcaatggctctgtcagatgaggagaagagcctgttgtgcttcttccatctcaatgcagcagctcagtagcatctcaagaagaaaaaaagaacaaatgttcagcagcagcgtttcctttgtggtattgcacaagtaaaatctcaggtgacaagaagtaaaatctcatctcaacaattacgagatagatttaagaatctagcagttttgcacatctgaactgtgtctccttggatcagagatcttagcaattgcaagtaccaacctgctgcactgcacgtaccagccatcgctagtaagtagtaaccaggacagaggtagctggagccctgtaatagcatcttcagcgaaaaggagagggcaattgtgacgcccgccggcagccggtgcgccacacacaaaatgctagatgccgttatgaaggtatgatgatggcgcgggagaacaaaggtcactgcaccaacagttgatccaactgtctgcctgttggctttactctaaaagcagatccaccgacagatagcgagatagaccgcaacgcagttcacagggccccgccttgatttttttttttttcacactgaatttgacagtttatcttcttcgaaaccaatttcgtcgtatcacgatttacaaatgaaacacggtacacatttcagtgttcatgaaaactcaaaagaacttcagcggaaacggaactctatttatgaacactgctggaacatttactgagagcgtacagatgaacaagagctatcaactcttcagtttattatgtactgttgggctttctggaggcagttgcgctcccctttgtcgttgagcagggttgcaattctgaagcaaaactctaaaccatgaatgggaaatttagaattttgatatcactgtatgtatgaacatatgtgtgattcccatgctgtctgaacaagaacaatagcatgcgaggaatcaacttatctgttcaccaattagatcgaggccaacggcaaggaatgacatcccctggaacagaaggaagtagaaatgaatcccctgagcagacaagaggctccgagtcgcagcggtgagcaggagcagagaaagagcaagctctttcttgtagatcttgttaccccttttggcgtcatttggcaccttctctcgctgttcctttcgcacattgatctcgaccagctcactgttttcaggcaattgattctggagctgaggaagtgtggtgcacttcctattcttttcttccgatgtcaagagatccaattcagatgatcggccagacttcttggtgacaacccattcgtaggagctcccgagtttgaacagcccggacaccattgcgttgaatttggtaacagacatggtgttctcgaagaggaggtatggtacaatgaagggaaatgatcttggggatggcagaatattcaagaaggacatgcaaatcggcacataacagatgacccacacaggcaactcggcctcgggaacaaacatggttaatggaagaatgacacaaaataatgtgaaagaatagaaaggaagtatcaacttcctcaaaagaaagaacaatagtattaaatttgctttcttccatgaggagatctgcaggcaggctagcaaattttcatcaaaagaaaaatattgatccataccccgagaaaaggaactttgatcggcacaagttccaacttcgagctatccggattgcataccttggcagtaattatgtcnggaaagcacagccggaaaaggtgcattgggccagaatgccaccggtgttgctgtttccgatatgcttcataagattctggaacttcacacaagacctggacgatgatggtgccaagaaaaatcagtttccacatggacatcaggacatgacactgatttctatgtgaaatgctatggttatgcaaatgtaccttcacatcattcaggaagatgaacttccatccattcaggtgagcccgaacagcaatatccatatcctccacggttgttcgctcaagccagcctcctgattcttctaaagcttggatcctccagactccagcagttccattgaacccaaagaagttcaggaagacaccattgacctgctgctccacttcaaagtggaagcaaaggttgatattttgaaggcgggtcaagaggttctcatccttattcacaaagctccaacgggcttgaactaatccaagctcagggttcccctgaatcacccaaagatttgcaatagatttagtatggagtagacacacagtagctcatatagaaaaacagactacacaattcttacatcaaaatgtgggattgttttcttgagaaaatcagtgcttggttggaagtccgcgtcaaaaatggcaacaaattcaaaattcttgacatagtcacagctcattgcagagttcaggttcccagctttatacccagtcctcaacacccgatgccgatagacaatgttcacaccctgctggttccacttagaaacttctgctttgatcaacatctgaatgctctcgtcgctcgaatcatcaagcacctggattagaaacttatccctaggccaatctagctggcagacggctgaaatcgactgctcatagacctgttccaataatgatcctgtcatccaaaacccaatgaacaagcacatcacaacttgcataaggaattcagctccttacctccttttcattgcacataggaatctgaacaagtaccatcgggtgcagataccctgaaccctcccggaatgggtccccttcaagccttggcttgattttcttgagcttaatccagaagcatgcgatgcacaagacgagccgatccaacgattggacaacaaatagcagaatgcaaactttggacaagaactcgatcggccgtcggatgtagtcagctcggaatgacatccaggcgaggtacgccgtgtgcagccacccctgaatgtcctccacctccggcacatgaaattcaggcatagtcaaattgggcctctgaaagtgccaccctttccagtaggccgccagctcaacggtgagggcgagcaaggagagcgccaagagcaccttgatgaacctgtagagcagccagccccggccgcggccgacgccctcggcggcggcggcccgccggaaacgcttcgcgacggcagacggcagcgcccaggtgacggcggcgagcgaggcgaggcacccggcggcacggtgtgcgcggaggagcagcacccaagtgaactgcttggcgctccggccccggcctcggcctttgtccatgggaggcacgccggcccggagcgcctnnccgcctcgggcccgtcaatctccaccaccgagtagttggggttctccatggtcaccaccaccggcgtgccccgccggacatccctcccccacgggtaggccagcctcaggcccggcgccattgccgccgacaactgaaggaaagaacagcactcgcgaagcggcgaaggtaagggaacaccagcaccactgacacttctgttctcaccggggccctctgcctccacctacccgccgtcggtgctgccgagaacgacgcggagcgagcatctctagcatcaagagccgcctcccgccgcctgggatcgcggaatgcagctgcgtctgcgcgggtgggtgggaatcagatggattcacagtaactccccgagcttgccgcgggctcaattcctaatcttccaccgccgcaggagagatgagcggagcagtggtactagtagagctcagcggcgtctgtgcctcctttttaatgaggggcacatgacacatcctctgctttatcttctcctttctccttttcactccgcccgccgagacaattagaacaaatgtccacatgtccacgcnaatatggaagtctctaattttttataattttatactaacggaatacctataatacgcatacctcttcgtaattatgtggtatatattttttatcctttaactaaaccaaaatatatatcttatacaaaagctatcgtatccctctttattatatatacacacgcaggttctcctattgttgtgtgtatattagattttgttcgaaaaaaaaaatgataagagcatctccaagaaactagtcaaatgattcagcaagttaaaatttaaatatttaac

SEQ ID NO: 24289 - DNA, 1133 bp, Zea mays
aagaccttttttttttttttttttttttaggcaaagccctgcacgaccgaacggtccgtgcagatattcaaccgaatcatagttttgttggaatcatttctctataaactactggatgctatacacaataaaatcagtgaaaaccaaacatcctatacatcatacgtggaaactacatctgaaaacataggaagtaagactgtagcactgttttagagttcattggtaaggcccagttcatcttcaaggtcatctccctcttcaaagagtttgaggaatcgcgcctggtcttgctcccgcttcttcttctgccagtacttgtagcccccgaacaaggcaatggtgagaaggactgatgcaagaacactaactattatgatgaccacaacagatgtcttcttagtttccaaatcttcactaggttcacggtttccatgtccagttgaggcagtgcagtttggacataggaatgttgcattgaactggccttccttaaaccgggtgtatttcccacccttgaaatcactcgaacacatctcccattcatcaaagacatcatcaggtgtaattgtgtcctcctcatacaaaccacatcgcttgcatttcttttctggaagctctgttaagggctgccatgattcttcacccttaaaggtatatagcgtgtgcacctccctcacatctggcaaatctgttttattctctccattgcacccgaaaacgactgttggtttgccaaaccattcatgagtagaaaatatctcaacagtatcgagtgtgacttgcctcgatgaaaatgtcccaggaatcgtgtagaggacgacgagaaggatgaaaaggaggagggggcggcggcgagtcgagatcgccagcggccacctcatgctaaggccgcagcgcaagtaacagcttggccgcggggtgcggatttgaagctcaggacaggagcacctatcctggtgccacgtcttcgcgggctggtcgcctgttgctgtgggcgttggcctcctcttcctcgtcgtccacccaaacgagagagcggaactgctccttctcccagcggccaacgcattcgtgagttcgtggagaaagcgattcgctaatcgaaatgttcaagccccccccccggccgg

SEQ ID NO: 24290 - DNA, 1081 bp, Zea mays
caggcgtttttttttttttttttttttttttttttttttatacgtgaatccattcatttttgcacttttatatatgtacgttacggggcttgtgcaaactgttgcaagattcactccctccgcaaaagctactaggaggtcgccaaaaacacacattctatacatcatacgtggaaactacatctgaaaacatcggaagtaagactgtacgcactattttagaattcattactaaggcccagctcatcttcaaggtcatctccctcttcaaagagcttgaggaaccgcgcctggtctcgctccctcttcttcttctgccagtacttgaagcccccgaacaaggcagtgacgacaaggactgaagcaagaacactaactactatgatgacagcaattgatgtcttcttagtttccaaatcttcgcttggtccagggtttccatgtccagtagaggcagtgcagtttgggcataggaatgttgcattgaactggccttccttaaagcgggtgtattttccgcccttgaaatcactcgaacacatctcccattcatcgaagacagcatcaggcttaaatgtgccctcctcatacaaaccacatcgcttgcatttcttttctggaagctctgccatgattcttcacccttaaaggtatatagcgtgtgcgcctccgttacatctggcagatatgttttgtttgctcctttgcaccggaaagccactgttggcttggcaaaccattcatgagtagtaaatatctcaacagtatcgagtgtgacaagcctcgacgaaaatgtcctaggaatcgtgtagagggcgatgagaaggacgaaaaggagggggcggcggcgagtcgagatcgccagcggccacctcatgctaaggccggggcgcacgcaacagtttggccgtggggtgtgggttcgtagctcaggagcacctatcctggtgccgcgtcgtagcggctggtcgacggtcgggcaccggcgcgcgcctcctcctcctcctcccaaacgagagaaatggaactctgatccggctcttttcgccttcgtccccggccggcctcgaggtacccaatg

SEQ ID NO: 24291 - DNA, 1304 bp, Zea mays
  misc_feature (1204)..(1204): n is a, c, g, or t
ctagatcgcgagcaaaaggaaacatgttttttttttcatttagtgctaaaccagagcggaacacgttctctctctgagccgtgctaacgaactgtcagcacccaaaagggccgctggaacggaacggaacgaactgttagcatacaaagcaagcagcctcccaagggcttgtacctagccagggtcactagcaccttcgctactaataaagtacgctaccaactaccaagtagtacacacagccacagacacggcaattgacacaaaaccaggaggcggcaggcagcccaggatgttctggcacccctcacgtttccattccacccgacggccaacgcgtcgccgctaccggctccactaaccaaaatgggtcccaccacctcctggcctggcctgccctgccctgccctaggacactccacgagacgactccttcactggtcgtccggcggcaccacctccatgttctgctcctcgtacttcaccccgaccaggaagcagatgctcacctgcttggggtcgtacacggcgtactcgttgtactcgagcgggccgtccttgttcgccgacggcaccagcttgccgcaggggaccttgacgccgtccctccagctgaagtgctccgactcgtcggtcgtcttcctcccgacgcctttcacgcccaccttcttctcttccaggactcgtgcctcctctgcccctggtgttccggtgacttcctcgatctcttctcccagagaggccaccgccaggaccaggtacccttccggacggtccactgcagtgaagccgtagcgagccgcctccgccgctgcgtcggaacacactatggctttgccgaacatgtaccctggcacaggcagatggcagacggcaggcaggaaccctttgtggaggtgcctaagcaagttcgagcttctagtcccacaccagagaaggattttgtttggcaggttcctgatttcctcgtacaaagggaatgcgctggattcaacagcatatatcctctcgacagacacaccatagaccacatcctccacctcgacaggctcgtacgtcttctccaggtacttgagaaccatcttgtagtcttccgagccctcggcgacagcactgatacaacaaccgagcttcttgtagcattcagagagtgggtcatccgagtagtgtcgtagcggatacgcatccctcgatgagacgagancgcgtcgtttatatcgccctcgggcccgattcctgatgctacgttgtcggcgatctgctcgaagcccctcatcgttgcgcccgagtgggggaacagagga

SEQ ID NO: 24292 - DNA, 2173 bp, Zea mays
  misc_feature (90)..(112): n is a, c, g, or t
gtgaaccaatagagtaactgatgcttctttccaccaaacataaacacataggttccctcagtaaaccacaagacacgtgtttccctcagnnnnnnnnnnnnnnnnnnnnnnnctctagggtaggtaagacttggtcgagcaaggtgattcaaaaactttaaccccgacagtatgaaaattcggtagtacaagcaaagggccagaggccagcattttgaaatacgaaactattgcaaaaacgctacaggtaaaaagaagtagtcatgtgcattatgaagattttattccacatcttcctccttgtggacaacaagctcgccttcagtgaactcgcatggcttgatggccacatctaactgcttgcgcatttttcttacaacaaatccctcgctttcttcgcatattgtgaccacgatccctttccgcccaagacgtccagttcttccagctctgtgagcataatgtgtggagtcagttggaaggtccagattaaccacaaggtcacattctggcacgtccagtcctctggcagacagctcattcgtaacgagaactctgaattcaccatccttgaactttttcaaaactgtcgaccttgcaagctttccaaggtctccatgtagctcagtggctttgataccacgggcctccaacttaaacacaacatccttcagtggcttggtgttgttcataaatgcaatcactgtctgtgcttccagagcatggatgcacctccgtaatgtgtcaaccttgtgctgcgccttggccgtacaatagtagtgttccaaagatggcggcaagctgccaacagcagcttggttcactgactgcgatgacgaactggggttagcgtcactttgggataacgcaggtcttggcacagtgattgaatcaagtggaactacacttttagctctaatgagaactggatcatgaccccaactccttgctgctcgtataactgaaaatggtattgttgcagaaaccaggatagtctgacgctcagatcgtctcgcaagtgggccaagaatatccctagatgtgcctccaggtctccttccaacatgctccaaaattctatgcatatcttcacggtaattaaaagacagaagctggtcgacttcatccagtacaagaaaacggcagccatgagtgtgtagcttacctgctgcagaaatttcagaaatacggccaggtgttccgacaacggggggggggcctacgtagctgaatgcttcttcctgcctggaacgattagctccgccaacaagttgctggaccagtcttttgtcattaggacccaaaatcttctccacttctcgcacaatctgcattcctaattctctcgaaggagcaacgatgactgcttctatacctgatcttttctcagaatggtcttgttccatagtcctcttcagagggcctatatcagaaagaattggaagaagataagcaagagttttccctgagccagtatatgactggatcacaacatcatgcttttgtgctattataggaattgctgcggattggacctcagttggggcagtcagaccttccttgttcaactggtcaacaagcaaaggtggcaaaccaagttcttcaaatgacttggccgaaaacagagcctcatctaccttcagtgtcttctttatcccagctggcttcatcaaggcactctttgctggtttgacatttgaagaaacctttggtttcacatagagggaagaagctcttgaacttggctttggacctccagttcgttccattttccccttttttccatattcaaccctgctttgcacttctaggctagcaagagtcaatggtcctcccctgttatcttccaaaatttgactaccacgccaagcagtctgatgaaatccagctacccgtggttgggacagcatcctgaacgaaacacgatctcccagaacaaaacatgaccgagaagatgccagcgcaagaacatttcgatggacttgcccaatacttagcctcatttcactcctcacagtgaaatcaatcacagcaccaaaattatcttttccttcgaagttcaaacctgttacaagttcacagcaaggtgctcttgtgtctgcggctggtaatcgctgagacgagctgcctaccctgcacaatttggatctggggaagacagggccggcctcga

SEQ ID NO: 24293 - DNA, 1541 bp, Zea mays
agctgatcccaccatgtcgaatccagcaaaacagttttgtttttttttacccagagagattattctctgttgattctgtaaaaacatctcaagattagcttcttctgattaaatggaatgattctccatcgtgcttttaaaaatgtatatatataccgaagaattacagaaaaaaaaaacattcatgtgcactctgaagactttgttccacatcttcctcctggtgaacaacaacaagctatccttccatgaactcgcatagctttcatgcccacggctctgcttgcgcatttttttttccttacaagaaaattcctcgttttcttcgcatactgtgaccgaaatcccttttccgcccaaggcgacaagttcttccggctcttctgtggccatggtgtgtggggtcagttgtggaaggtccagattaaccacaaggtcacattctggcacgtccagtcctctggcagacagctcattcgtaacgagaactctgaattcaccatccttgaactttttcaaaactgtcgaccttgcaagctttccaaggtctccatgtagctcagtggctttgataccacgggcctccaacttaaacacaacatccttcagtggcttggtgttgttcataaatgcaatcactgtctgtgcttccagagcatggatgcacctccgtaatgtgtcaaccttgtgctgcgccttggccgtacaatagtagtgttccaaagatggcggcaagctgccaacagcagcttggttcactgactgcgatgacgaactggggttagcgtcactttgggataacgcaggtcttggcacagtgattgaatcaagtggaactacacttttagctctaatgagaactggatcatgaccccaactccttgctgctcgtataactgaaaatggtattgttgcagaaaccaggatagtctgacgctcagatcgtctcgcaagtgggccaagaatatccctagatgtgcctccaggtctccttccaacatgctccaaaattctatgcatatcttcacggtaattaaaagacagaagctggtcgacttcatccagtacaagaaaacggcagccatgagtgtgtagcttacctgctgcagaaatttcagaaatacggccaggtgttccgacaacaatgattggtttgttcttcttcaatgcttcttcctgcctggaacgattagctccgccaacaagttgctggaccagtcttttgtcattaggacccaaaatcttctccacttctcgcacaatctgcattcctaattctctcgaaggagcaacgatgactgcttctatacctgatcttttctcaggatggtcttggtccatagtcctcctcagagggcctatatcagaaaggattgggagaagataagcaaaagttttcccagaggcagcataagcctggctttctaccttctgcctttgtcaatatataagaaataccggcgaatgggactccggttgggtcagtcaaaccgggaggcgtgggtggaatccgggaatccggcctgcgtgcggccagcgtt

SEQ ID NO: 24294 - DNA, 977 bp, Zea mays
  misc_feature (696)..(700): n is a, c, g, or t
  misc_feature (785)..(842): n is a, c, g, or t
  misc_feature (856)..(861): n is a, c, g, or t
gattgggttcctcgccggccggggccagctccgcgtgtccctcgcttcgtcaaggtgcatgccgcacgttcgccgggtaaccgccctccttgcatcccctaacgcacactgccgcgccgccctcggtctcccctctcctctccctcccttcctcttccacggacacgggaggagaagggttgatcacgaccggggaggacgcgtggccagagatgggtctccacggaggcgtcgtcgtgctccgcgcggccgtgctcgccgccgtcctcggcttcgtcgccgctgccgggttcatctcaaacgacgcgctgctggagcgcgggcacgacaccaccggccggagcctgctgcaggccaagaaagattgcccggtgagcttcgagggcgccaactacacggtgatcacgagccggtgtaagggcccgctgtaccagccgacgctgtgctgcggcgcgctcaaggacttcgcgtgcccttactccacctacatcaacgacgtgagcaccaactgcgccgccaccatgttcagctacatcaacctctacggcaagtacccgccgggcctcttcgccaatacctgccacgagggcgacaagggcctcacgtgccccgaggacaccccgcagatcgaacccgggcagaaggcctccggcgccgccgccgtcgccgcgccggccgcggccctggcggcggccnnnnnggccgtctcgttgctgctcatgtcttgctgagagacccgggttgcagatggccgtgacagcgcaaccaactgcgttgctgtaccnnnnnnnnnnnnnnnnnnnnnnnnnnnnnnnnnnnnnnnnnnnnnnnnnnnnnnnnnnatgtttacatctgnnnnnntgaattcagaaaagggtggtagacatgcaatgcaaaccagctaaagtctgctttcacttgttcaacgtggtaaaatttcttgaaatgcagtagtcgaaaattaaacatgcagtgct

SEQ ID NO: 24295 - DNA, 1028 bp, Zea mays
ttttttttttttttttgaggcaggcaaaacaatacaatgcacacgtaacagagaagcaaacgcagcgaaccagctgccagcgacacatgccatcggacgtcccaaaccgggttttttaagaagctgcgacttttgggagtgaaaaaaatcacagcacgcacacgacattgtaatccctgcggattccgtttctcctcgtgattccgaggcccagcccaagatgtcggcccgcagcgctctactcatgtggcacgcgcggcgctgtgggcgaggaggacgctggtgggggagaggccgagcccgtgcggcgggggcgcgccgcccgtgtggtggacggggccgccgccgaggctggtggcggccgccgcgctgggcgccggggcggcggcttccacaggctttcttgaacggccgcggccgcggtggacgtgccgctcgcagtacttgtggcccggcaccacgtcgcgggagcaccgccacttacttgccgtccgtgcgccggcaccgcccgggctccggctccatgctgctgcggtagtcgaagcacaggctccccaggcccatcagcgaggggaagcgctgcgggccgaaggaggacgcggcgacgctcttccagatagggagcacaaggtgcgccggcaccggcgcgcccgctgcgaagtagcggtagatgagcacctggtgctccagttcctgctgctgcatgaacgtcagcgctgacggcctcttgggcgtcgccgttgccggggacgcatccgcgtctcgctcgccgcccccgccgagcaccaggcccagcccgagaaccagaggcgacgaggccgccactccggcgctcgtgtcggcgcaggagagacggggcagcttcgccggcggctgcggcgagtcggtctccttgtcctcggcggccattttggagactccgctgttgcgcttcctgtggcggtttggactctacggagggagcgcgcgggcagcttctcgatagaagggaagaagagacagcattcgttctcgaccgacccgcgagt

SEQ ID NO: 24296 - DNA, 1091 bp, Zea mays
gccttttttttttttttttggatgtacatcaaataaatatgtagctgcatggcttattattaattaatcacgacaggtacacactgcagcttcactagtagttagtacttaggagatacgtactagcttggttacagcaggatccacagattgcatgcaggaacgaaacctactagaaagctagagaggatacatgcatgcatgcacggatggataggcacaagaatacaacaacaacagcaacaactataatcgatctagccccttttccttttgacgcctgcagcggtggtggcccccttgtgttcgtctccgtctccgtctccgtctcctctgggggtagtagtagcatcgtcgtcgtcggctgccaggcgcgccatcatggtgagcctagtcagcaggtcggcggcggtgtcagcgaggacgaagatgttccgtgccttggtgtcgatgaagccctcctcgacagccttgtcgaacagcgagagcaggctgttgtagtagccgtccacgttgagcaaccccaccggtttgctgtggatgcccagctgcgcccacgctatgatctccagcagttcttcgattgtcccgtaaccacctggcagggcgatgaaagcgtcggcatgtttcgccatttccgccttgcgctgatgcatgtccctgaccactttcacctctcccaatgtctcccctgacacctcttcaggtaggagggcggtagggatgaccccgaggacgtggcggccgccttcgtagacggccttggacaccaggcccatcagcccgccgctgccgccgccgtacaccaggttcatctgcctctcgaccagctgcttccccaggtcgagcgccgcagcgctgaaggacggccggttccccggcctgctgccgcagaagacgcagatcgttctcaccgagccaccaccgtcgccgccgctgctctccggagcaaacttctcttgattctcctccatacccacggaccacggccggggagggggaggaggaggaggagagctacccaccctgctacccacgggagagggagagacagagaggtctgtggatattccctttacgaggtcctctgc

SEQ ID NO: 24297 - DNA, 1247 bp, Zea mays
cggccgcgctcggcggggcgttcagggacaacgtgcggtggctcctgaagcagtggagatgcgttccgggttccgtgtcggcgtggcgcgcgctgctgtcagacgagcggacgggcgccttagtccccgtcatcgccgtggaggagctcgcggcatcgtcgcccttgccgctctgcgatctctgtcgctgcgccggttggagccaccactgggtgtcaaagcggaagtaccatttcatcattccggcagtggtcgactgggaccggccattcagggctgatgggttgcttgggcacagcgagcacctcctacatggtctgatccatagtaatggctttggtcaccttctcaccctccgtggtcgtgttggtggctccactttcctctctggctgccagatcatggatatatgggatcaactttgcacagctctccgtgtaagagccgtctctgttgtgcagacttgactcttcagtaagtactctgttagctagctgtggtttaagtacactagcaaattctgaactttggtaacttcatgaacgctgtaaactcgagaaagataattcaccttgtttctatcttctgagctttggaaggtttctgtgcagagccgtctctgttgtggacttgacccagaagtactctgtggacctccgcctcctgcttggaatggcacaaagcaaaacttggttcactcgctgggggtactgccttgccaagggttgtttcagcgtgtctaggtccacttatactgctgcacttgaagcccttgctgccctgcctgttgattgtctccgtagtcgtcatgtccgtcgtgtggtcaccatctaccgccgcctctccagcaaacctctggttacagtccgcgagtttctcctctgcctgcttgattggaagcaccgtgagcccccgctttctcctcctcccgtgaaggcatcctcgcggctgatgttcttgctgccaaagtcatgtatgatgaagaggcccaggcagccatgtcaacgctttgaggacgtagttgacctgcttgagtgtcggtggtcaaagaagcgtctgcttagtgctgcaaatgttgttgttgcaaagctgcgagagcatgcggatggcacaaagataacacggcaagcagtgcgagatgctgcaaggggtggcatcggtgacactggtctcctggacttcgtcatcaagtccctcaataacactgttgttggtaaccacattgtgcgccgcgtgcccggaccctg

SEQ ID NO: 24298 - DNA, 1068 bp, Zea mays
actgtctgatcctcatcccacttgggtgcgccgtccccgcgcacacacacatggagggatatgaagggataggaggcagaggcggcgattgcgaagatggtcgagagcatgcaggcggcggacccagcgggtcggataagcgcaccgctcgcgctgcgccaactcctcgccatgctccagtcgctggccctgctcctacccgtccagtggcacgcgtagcgggggcgttcgatgccgcggcctccgtgctgggactagcgggaaaaggggaaggcaacggcgtcagtggttctacgggtgctggccgggtcgctcatggtcgccgcgcgaagggaggtagccacacgccgggcgcaggaggctgggcgggagtacgagctgatccccaggacatgtgccacaatgtggtttaaatgaatggtgagatgaaggaatgctatccttcaaggtccagttcgtgcatatactgtcctgttggcttaatgcagctatgagtattccaccaacgccactaccaagctgcagttgtcgctgcacagcggccccagccgaggtcgcctctgcacccacgaaagatgtttaacacctctgcaactactagaagctattgcggttctgcggcctgactcgacaccatgtggtttacttttctatgttgttgctgatttctccccttgtatgatggtgtgatttatatgcctaggaaacccttccatataatgcatatagcctatctaatatgttgttgtgtattaggcccctcctgtatggctagcactgcctcactcttgtgtacaaacaacctgactatgccctaacctaaatatgctaagcttacaatgtttatttgcaaatcacactggaataaatacacatggccacgcgcgggcgaaggcacgcggtcaaacactagtattgtacaccgtagttttacgttgaagcccagagaagtgccaagcaagaattagcgttgctctcgacagcatgcttttatagcccaaggggctaagaccgtaataaagattggttacgatgtatattatttagtactcatgctgcaggcatgca

SEQ ID NO: 24299 - DNA, 1485 bp, Zea mays
ttttttttttttttttgttaaaacaaaatttgggtatttttagataatgcactcactgacaccaaaacacagacttcgaaggcacatacaaatggagtatatgaaaaccacttacatctatcacaaaaactgtcaaaacagcacttgcttgtcaatactgcatctctcatcacttttttacatagtcggcagtggagctctgctggcaagtcatcaacagccccggctggggcagacgggacaagtgaatccaaaatgccatcaacaggtgtaactactgggacaagagaccgactcattttattgttgtcgaacttgggatcgccaatgcttggacaatggtggataaaatgccctggaattcggcatctgtagcaaatgtatccaggtggaggcatcttgttttcctgtgagcagtgttgaatgaaatggcctggaacaccacaagagcggcagacatagccgggtggaggtgtttccccttccaacggcccatagttacgtcttgatgtaaaccttccactgtcttgtcctcttttagaggggagctgttccaaattgagttcagcagcatcaattactgctgcaattgcagcatcttcatcttgcactactgtggaggaacatgactttgagcttgagtcagtaaccaccgacttgcaaggtacagaacattcttctgtgactttcggcctaggggacaaaacaatcttctctgacagttgcccgggaatggaaattctgcggaccaacacagttgtgttctgtggtatggatgctctttcatctgcatattcttcgccagtttgggcgttggagatgacaatatcctctgtggcacgaccgcgggttcgaccacggccgtgcctaccgctcgtcatgataagctgcttgagttcagacacagaaataaaagcatggggcacgggcatagaacagatttccttttcactcttatattggtaatagacaacacccatgatggatggcgagtcctgtttctttttctccgcctatgaaggcctctctatctcgagatggcccgaatacttttttcagatctcagatgaaatacaacgaatagcaaaacactgaacagattcgatctacgaagaggcgatcggcgatcgacgacggcacggatccttcgagtcgtcgacgctggcttggtggagacgtagcctgtggagcaaacgattcctcgtgacgacggctgggggagatcgagggcgtagaagtcgggtagaggacgccgggtagccgagatgccggaacgcggcaaccggtggtaggagcgagcgattccgcctgatagggcaccggatctgaaggcgtcgccggggctagggttctgacttctgaggcgcggggggagactggcggtgggattggggggatgtttggcgacgagggcggtggattttcgcactatgtaagcggcccacgaacgcgcccgtggaaacccgccgcctgagcgccgcacag

SEQ ID NO: 24300 - DNA, 1747 bp, Zea mays
tagcgtggtcgcggccgaggtaccaactcatacgctggatgagcaccaatcaatgcgactgccatcatactaacttcgggagaaaacgggcatccgcttcctagtagaatgaacctcaaggaagtcaactgaggccctgtcagtatgccccataagaatgcccatggtcccttctatctgagtttgaccttgttccatgagaggagaccagccgtcgcttgtgctctgttgactggggctgaagacgagtgtccttgggccggtcactcctctcacggtgctttgaaggtgctctggcagccgcagtgctcccacgacgcatgggctcagtttcaggcctttggtagcttgctggatagccttgcatcgaatttacacaatatggatccattggattcacacaatatggatccattggatttgcacaatatggatccatcggataaccagcgtacggcatccccattgagctatacatgtaaggttcagttgcccaaggatgtccactaatgaagggattgtaatatgcagggtcaaatgaaacattgtaaccatagccaacattgttaggctgaacgttcttggttaagtctgccttcttccgcttcttctttgcttgatctgtcctcgtgccatcatattctcgggaccctgaaacagtggtggccttcgaactcctttcacttccatccttcactttgagggcttcagcatttgctaccgccttctctgctgacacttctgcagcattgcctccatatttgctaaggatttcagcagtggctgctaatttctctagaggctggttcaccagatcaccttctgtggcaacctggagcacataatcaggtgcagataccgctggtagctgatggtctatagactgcttcacctcccttgctgacgcagcagaagcagcgtggctctgtatttttgggcgagggttgctgcctgacgaacttctgtgtcttgttgtaccactaccaccactgcttgtctgtgttcccaacatattgctgattgtgctccgaagtgtttgatttggaatgaggtcatctgctagtgtctccactccacaaatgcacttcgactctttaataatataatcccgaatgcatctatcacaaaaactgtcaaaacagcacttgcttgtcaatactgcatctctcatcacttttttacatagtcggcagtggagctctgctggcaagtcatcaacagccccggctggggcagacgggacaagtgaatccaaaatgccatcgacaggtgtaactactgggacaagagaccgactcattttattgttgtcgaacttgggatcgccaatgcttggacaatggtggataaaatgccctggaattcggcatctgtagcaaatgtatccaggtggaggcatcttgttttcctgtgagcagtgttgaatgaaatggcctggaacaccacaagagcggcagacatagccggctggaggtgtttccccttccaacggcccatagttacgtcttgatgcaaaccttccactgtcttgtcctcttttagaggggagctgttcccatttgagttcagcagcatcaattactgctgcaattacagcatcttcatcttgcactactgtggaagaacatgactttgagcttgagtcagtaaccaccgacttgcaaggtacagaacattcttctgtgacttccggcctaggggacaacacaatcttctctgacagttgcccagcccggccggcctcgag

SEQ ID NO: 24301 - DNA, 1544 bp, Zea mays
ttcgcacgggggagctctaatctctctcgcccttgcgttaatcttaatcactgcatttaactgcgaaattaactcttttttcaagtttaattacctaataacaatgtgtactatggtactacaaatattgtagtatttttttagaactccaaaaactaatgtaaaagtcaaatagctcagttaaagagtaaaaggagaactaaatagtgggaacggttgaagaggaagtgaaataatggggagagtatttgagggggaggtatttaaatatgaataggaagcacgaataaggggatatggaagggggaattgttggaggaggtcttagagaatcaacttgcatcaaactcagaaatagccaaactgggtgaggaatacatactggaatgacgcatgcaaaaatcattggcaccaaaactaggacaatggataaaaccatatgcaaagcccaactgagtgaagaatgtatattgaaatgacgcatgcaaaatcattggcatccaaactagaacagtcgataaaacctatgcaactcgctttttgttaagtggctaagagctacaatcaagcaattcgcacggacaacttaaacactgaaacaaagttcaggtgtccatttaaagaccagattgatgttattaaactctcccatgtgttaacaggttgcatgaatccagacatctcaaaagcaagcttaaatgatttccccaaaattgtgatgatcaaacggctcctgcacctcatctgctctcaattttattaggctgtgaaatctgttgtggtgcagagtaaaggcaactacgatgaaattttacacaatcatacactcggcagtatatacagaaataaagtaatcgagaacagttaagatatttgacgttaaaccaaccttcgccagtttgggcgttggagatgacaatatcctctgtggcacgaccgcgggttcgaccacggccgtgcctaccgctcgtcatgataagctgcttgagttcagacacggaactttttttttttttttttggccatagaacagatttccttttcactcttatattggtaatagacaacacccatgatggatggcgagtcctgtttctttttctccgcctatgaaggcctctctatctcgagatggcccgaatacttttttcagatctcagatgaaatacaacgaatatcagaacactgaacagattcgatctacgaagaggcgatcgacgatcgacgacggcacggatccttcgagttgtcgatgcaggcttggtggagacgtagcctgtggagcaaacgattcctcgtgacgacggctgggggagatcgagggcgtagaagtcgggtagaggacgccgggtagccgagatgccggaacgcggcaaccggtggtaggagcgagcgattccgccggataagggcgccggatctgaaggcgtcgccggggctagggttctgacttctgaggcgcgggcggagactggcggtgggattggggcccggctggcggcgcgggcggcggcctttatgagagagaggcggcccacgaacgc

SEQ ID NO: 24302 - DNA, 892 bp, Zea mays
ttttttttttttttttcgatgcagtaaagacaactatgatgaagttttacaaaatcacatggtcggctgtttatacagaactaaagtattcgtacagttaagctatttggcgttaaacgaaccttcgccgctgtgggcattgaagatgataatatcctccctcgcacggccgtgggttcgcccatggccgtgcttaccacttgtcagtataagctgcttgagtccagactcttcgttttttttttggggcacaggcatagaacagatttccttttcactcttatattggtaatacacaacacccatgacggatggcgagtatgtctcctttttcacgtatatataaaggcctctctatcacgagatggcccgaactttttttcagatctcagatgaaatacagcgaactgcaaccagaataatcacagaacgaattcgatctacgaagaggcgaccggcgaccggctatcggcgatcgacgacgacacgaatccttcgagtcgtcgatgctggcttggtggtgatgtagcctgtcgaccaagcgattcgtcggtacgccgcctggggaagatggcaggtgtagaagccgggtagaggacgccggggagccgagatgccggaacgtggcgaccgagggtaggagccggcgatcccgccggatctgaaggagtcgacggggctaggttccgaggcgagtgcggaggctggcggtgggattggggaattttgcggaggctggcggtgggattcgggaattttgcggaggcggcgggggcggtggatttttataggagagaaagagccgaaccgcgaatgcgtgaacgcgtgaacgagtccgacgggaaaaaaattctatttttcgattaggatgttctaggtaatggtctcgtgc

SEQ ID NO: 24303 - DNA, 783 bp, Zea mays
ggccgcttttttttttttttttttagcgaaattatttggagggttcgcattatagagagagctggcaactctcagcattaatacaaaaaaaattgttcaatatcaatacatttcgctagggaaccgaaagctccctctgctttgtgacaatctttcttctactttcaggggcatacatacaattacgagtataagaagatcaataggtgagcactggtaaccagcaatatattgctgcacttggtctgccaagtttaggacagtgccttgtgtccacgcctcctgatgatctatgaccccatctcgtcttgaaattacgttcctcgtagcttgcgtgctcctcacgagtcatcatactcctggaaccgtttcgatcaccaccgatttgtctaccatcatactaacttcgggagaaaacgggcatccgcttcctagtagaatgaacctcaaggaagtcaactgaggccctgtcagtatgccccataagaatgcccatggtcccttctatctgagtttgaccttgttccatgagaggagaccagccgtcgcttgtgctctgttgactggggctgaagacgagtgtccttgggccggtcactcctctcacgatgctttgaaggtgctctggcagccgcagtgctcccacgacgcatgggctcagtttcaggcctttggtagcttgctggatagccttgcatcgaatttgcaccttatgggatccatttggattcacacatccattggattccacaatatggatccattggatttgacaatatggat

SEQ ID NO: 24304 - DNA, 3229 bp, Zea mays
ggtaccggcgccttctctcgagtttttttttttttttttttttttttttttttttttttttttttttttttttttcctttttttgtgtggtagagccaaacgatgttctccagatgcaataaacttcaaaaacacctccaaaatgtttaaatctacctccaaaacaccacctgatccagctaataacatttttctaattaagggcgatcaagcttcaaattaatccggtggcaatcttcacccaccagtgattgacatatcaaaaacaaagtcaaacctccagccttcagctgacctctccataaccagccaggtacttttgcatctaggacgaactccgagtctcctaaaagtgcgcagatttactaacaaatggaagcctatgaggaaagctaattttcaaagaagattgacaaaggatggttagtgaacaaacaaggaactctgaacagttcagaacttctgattgcaggagatgctggagaaaacaaccagccccaatttaaaacatttaagaattgcagcggacagaaatgtgtataaaccaatagaagagcgatttaggtagatatatcctgacaatcttcacccggtactatgggcatcagtccagtcaacgcctcaaatctacttcttgcccttacagatccggtaagcagcatttccaatgaagggtaatcaagattataatgccaattttcaaagaaaaatgacaggagagggggtggttagtgaacaaacacaaggaactctgaacatttccgaacttctgattgcacaagcgtaagccagatcgatcaaactcgcctccaacccatccattcatccatataatattgctggaaaaaaccaccagccccaatataagaaattaagaattgcagcggacaaaaactgaagatgaaccaatacaaaagtgatttaggtatgtatatcgcgacgatcttctcccaatataccggtccaatcaatgcctcaatctacttccaaaactcggttgcccctgaagatccagccagcagcatttccaatgaagggtaaagaagcttatagtaagtccggtggcgatcttcacaccaatatgacaacatcaaaaccaaaaacaaggaatgaaccataagcaaacctctccctgtaaccagcaaggaccctttcttctctgccgttaaagtaagaatggatcgaaggttctggtggtaccacacccggagacatttgagcctgaaaccaccaatccatgtccaatcgacaaaatcaatgaaccgccggatctgacagaagactgacctgcctccatctcctcgcaacatgtcatcatgatgaattctccactgatcggacccaatcctgcaacccacacattgggaagtcgaggactacaaaatagactcaaaaactagaattgcataataaagaataaactgaataacccggccaaaccaaactcggctcactcctggtgtcgtgcggaggtgaaacagcccaaagggatctgcgagagcacggaggcgcaaagcaacagaacaaatcaacaggtgaagaagataatgtcccggctcaaaatcgaaacagagtataaaaaaggaagtaacggaaaatgcgagcacgccaaggcccaaggcaagggcaagacaggagaggcaaggcacttgaacaccatccatccatccacatgatcgtgtccgaacaatcttctctcgatatatgaatgccagtccagtcaacacaccaatctacttccaaaactctgttgtccctgcagatccaacatgcagcatctccaatgaagtgtaatctagctacaatgccaattttcggaaaacagcatgagggaggatgggtaagtgaacaaacacaaggaacttgaacaattccgaactcctgattgcacaagcataagcaggaccaaactcgcctacaacccattcatccatccatccatataactgaactgctggaaaaagccaccagccccaatataagaaattaatagttgcagcagacaaaatatgagtatgaaccaatagaagagcgatttgggtagatatatttgaacgatcttatcccaataagatggacaaccagccccaatataagaaattaataactgcagcggacaaaaaatgagtatgaaccaatagaacagcgatttgggtagatatatcctgacaatcttcacccggtactatgggcatcagtccagccaacgcctcaatctacttccaaagctctgttgcccctgcagatccagccaacagcatttccaatgaagggtaaacaagcttatagcaagtccagtggcgatcttcacaccaatatgatgtcatcaaaatgaaaaacgaggaatgaaccatggccatgaaccataagcaaacctccaacattcaactaatctctccataaccagcaaggacccttccttctgcttctaaagtaagaacacccaaaaggccacaagcaagatcagccattaaaataagaatggacccaagatctcgaatccacctgatgtgcaggctccgacgacactatctgattctgatggtaccacacccggagacatttgagcctgaaaccaccgaatccatatccaagtgacaaaaccaatgaaccgccggatctgacagaagactgacctgcctcccagctcctcgccacctgacgccatgacgaattcccaataccggatcgtacccaaacctgcaatccacacgctgagaagtcgaggacgaaacatgatccacacgaaaactagaatcgcaggaagactaaaccgcaaaccgaacagcccagccaaaccaaactcgtcacgctcccgcctcccgtcgtcgcgcagaggcgaaacagcccaaggtatctgcgagcatggaggcgcaaagcagcggaactaatcaacaagggaagataccgacccgactcaaaatcgaaatggagagtatagaaagtaatctccggaaaacgcgagcgcgccaaggcccgaggcgacaaagggcaagacaggagaggcgaggcgcttgaacaccatccatccatccatataattttgttgctggagaaaaccaccagccccaatataattaactaaaaattgcagcggacaaaaattaaaaatgaaccaatagtagaagagagatttaggtagatatatccgaacaatcttctcccgatactatgaacatcagtccagttaacgcctccatctacttccaaaactcattcgccactgcag

SEQ ID NO: 24305 - DNA, 1678 bp, Zea mays
gtcgaatatatcatcatgcatataacaaatcaatcatatgatcttgcaagatttctggaaaaagcattcattgggccgagtcatgtatgcttgattcattcacttgcttggtgtgcagcacaaggtacagtctctggtaacaaatgcacattcaagagctgatgagcatcatgcacactattctctggaaacatagcatcaacattcagcctcctggaatgcttatttgcgagcactaactcaagtaagatgctcataggctcctagcttgtgtaattagctaggagggactccatggctacattcttggcacgcacatctttgtacttgattcgatagccatgtccaggtaaaagccactcgaactctagctccagtagcttcctgatgctttccagctgaaggctcactgactgcttgctgtacatcagaaagaggttcagatcgtctgattcttctgactttgcaacatggtctccagtgaacagcacctttagcggtttgaagtacaagcacactgagcctggggtatggcctggcgtatggataagttcaaaatctgttcctaagttccatggaccatttccttcaagtttccactcaacatctgcggtagcctcctccacatctcctgaatgtattattctttcacattttagctgctcagcccacttcctgtgatctgctacgtcatcaatgtgggtcaaaaacatgtagcgcgctccaccaagcttttcaatattgttggccagctttggagtataccttgggctgtcaatcagtatgtttccttgtggatgaattaccaggtacgatgttgccccatatgagtcttcagaattatacccacagagataaacacctgggagtagcttgtcgtcgattggtagaggaaacatgttttgcactttaagaatgtcttttggaggtttctcagtgtgaattgaggatgttggacaggatagcagcgcctgcagggccttggtcctctcctcctcggagctgggctgcgccgctacggcggccttgccatccaccctcttgaacacctccggcgccatccatcggcaggtctggcagtcgatgcagcggtggtcgacgaagaagtcgccagccacattatgcggccgtcgccggcggtccagtgccgcaggggaggcggcggcgcgaaacggcagggtgcatcttcggggacgaggcggcgcggtggccgtggtgtacccggcggcgccaaggctcatcagcgccatgtgtgtgtgagtgaagaagtcggagttctctacttctattgccgtcggctgtggtcaaaactgcgtcggatagcttgtttcgtcccggccggccgcgtccgacttctcctcggtgttttgttttataaattagaggactttaatccgatgcgaatggcctataatctcagtcatgtgtgttagagggaattaagtaaaaaattaactaatttttactttaatctactttaacttgcatggattgttaaatacattcaaacaagctctttggagtttatagtagtcagtatatgacaagcaagatttgatgcaaaagcacaaaatatatggctagtccataaaagcactacacagcatcataatcctgtcgtaaataatcatgcatgaacacgaacagtaatgagcccatggtgatcaagatattcaga

SEQ ID NO: 24306 - DNA, 5959 bp, Zea mays
  misc_feature (2238)..(2238): n is a, c, g, or t
  misc_feature (2303)..(2303): n is a, c, g, or t
tctcgctcatagagagttcaccccacactgaaatcaagcataaatgtggattaggatcaatgggctaaaagataaagggaggctatgtggtctcgatactctcataatatcctccatccttagattcatcaataaataagtagcaagaggatatagagtgttatacacattgcagtctgaacctttctaactgtccatatactggctcctaattatatccaattttaacacaccgtcgacttacgctccgctctctcctacacattttcctatggtgttatttcacaacgacgagtgttaatatttatatctccaaccaaggttatttgaaaatatataatcattttgtatttattttatattataattgttagtggttttttatatagttttggtcaaactctaagtcggttgactccttaaaaatgagaaatgtgttctttcctgcactaagtacatatcatagttctgatagaagcctgagtagcacattaaatgctggatccatttagaaacgatcctaaacaagcttgagttaaaaaacaactctattcaccagtgtttttttaattttagtatatacatgtaccacctaaatcactcctaggcctactttagaaacttaaatctcatccaggattagagaggatttggaggaaaatgaaatatctcttccaatcttggaagagatttgagtttttcaaactagccgttagtgaaatgcacatggttacaggcgtgtcaagtgaaataaccagggcaactggcggccttcaagctgtatccctttctgtgcgcgaaaaaatgtaatgacgtaggatgatcttttccctgcgtattgagttttttttaagaaaaaaacgaagccgatttgatagctgattcctagggagaaaccgtcttctgccgcgccgcagcaaaatggaaacgacgaagatccaacgtcgttgcagacagctgcagccagcagacgagaaacccatccagattccctgcaatgctgttggacagaaatattccccgtgtaattattcctaattctaagctatatacatgattgcgaaaacaaagtaggttatgatctctgtcatttgtcgtaaccataacatatgcctactcacgtgggcgatggtggcacggatcagttcagcagcttgctcagtctgcctcacttttcttctcgcaaatccagatgcgccatagacgagtcatacagagtgctctacaaaatgtactgcaacaaactactggatactgatcgaaccaacaagctgtacaaaaggtgagatccactgaccaacaggtgatcttctcgacggggttcaaaggcatgattcaaaccttcgcccatggctcctcaccttcactggtcaccagagtggttttcgggggttcatacatagaccatacttatcaacaaaacgtgtttcatgccatccacggcaaggaaacatgaatacaggctgagtcagccagcacccgctacggcacaaccaaacttgagtagaggatcagtcagcacacctagggcgcatggttgctgtaatctccccttacgccgccgccgccgtcagtcacaccattagggatgcttgccctattagggttcgccgtggtggagtatggagagtagggagtggcaacgctgccattgctgcttctcatgcgcccagccgtactgctccttgtaattttcgttcgggctctccgtccctgaaatagcaaatgatcagaggtgtcagtgaaccagagccttacaacaaatggatctgatggacaaaaaaaatgtagtttctttatgcaaaaaatactagttccaagttccaatatccaaaatctttgtcgggcgtttaggatgagatggttgtggctacataagagtgatcctgcccgaccatgggaggtgtttcaacttcagattcataagaaagttcaggctttcttctcaatggcagtaccgcagtagtagctgaagttggtaattgtgctcgcaccctcttctggtctgataagtggatccatggtcggagtgtggctgatattgcacctcgagtgatagttatagtacccaaaagacgtaccaacataaggacagctcttgaggcccttacgtatcattcttgggtatcagacgtggaagattctttcatctggcgattctctagcgatggcatctattcgccaaaatcgccttatgcagcattctttcaggggaaaattgccttctatctttgaganaggatttgaaaatcttgggcacctggaaagtgacatttcttcatgtggttggttgctacaaacanatgttggacatggactgttgatcgacttgcaagacgtggcctttagcatcctactacttgcccccattgtgaccaggatgaagaaacattaaccacctgttgctgccatgcgtgtttgctcgagaattctggttctccctcctgcaaagggctggcctgcagcacctctgtcaacaaatggaagaatggtgggatagaatctccagtggggtggttgatcttaatcaaaatggctttgattcccttgttattttaggggcttggactgtctggaaacatcgcaataggtgtgtttctagaggggtttcccctactgcggcccgagctgtgttgctagctttagaggaattacattttgggggtttagccggagcacaaggtgttaactttcttttggcccttgtgcaggaggaaggttgaccgtcctgtgtattttttgtgatcttgatcagtcttgctgaaaagggcatgtttgttgtttttttatatctaggattttggttgttggtgtggattttgtgtggttcttttgtaagggagctttccctgtgttttgttctcttctaatataatgatacagagttctgcgtctcgagagaaaaagttcctactaaagtgggtatagttgacacaaatgatgggacaataaggcaatcgttaacatgacagacatgctgcatctacaataagctatttccaatactccgttctccaacaagtaaactatagattaaatgaactttgccaaagaaggccaagacaagggaaaccaggatgtagtcaacccaagtctacagaaaaggaaaagaaattagcccaaccactgtaaatgtaaatccaaaatgaagagctgcccaaaattaatccaaacaagaggcaaattgactggttgggcagcaaaggataaaagttcacctcgatagttgggaactggatatatgttaaccatgagccccattcaaagctggacaagatcatgaatcctcaacctattatcgtgctcaaattctgcatggatggtcttaaggatttcttaagatcttgcccttatagttgatcatgctagaggaatgtggttgtttccatctggggccaacataaaaatacgttaagaacttaccgtgaaaattcatatcacccttcatcatgaatgccaactcaaaccaactgcttgataaatttgtcatctcattccaacaccatgagttcaattagcctattggattgctttatccattgtcatgtcataatgtagatttgcacctaaaatcaagtacgtagtacataatccaaaaggtaacagaggcgtgcaaagctttcgtcgggctagacggcaaaggcagaagagagcttgactacaagactcacccatcgagcagagacgaatagtgaaccctgaattaccatgaacaaaattgaatcaggtgcccaaacttctgaccacggatatatgtgacattgatcataattttagctaagcacagaaacctactaaatcagaagggcatgcctggtactgtggtgagagttgtctcactgagtcaccaagccagattcaaagcagtctctccgtatttacgggaaagggcttgtctcggtttatcccttacctagaccccactcatgtaggagtctccgacactgggtctgccctttagagaaacctactaattccattgaattgcttaatcagtatatgtaataggcgtggggtgatcaccttgctttcaaaaacacgtctccagtgcaagaaagaggatagcagactagcttgtgagaaggtgcaagcccccatgcacttaacttggtcttccaatgaacatcagaaaaccatctaaaagctgagttgcatacttcgatcgtgaagtggcggataaccctccaaagcggaaagcatctctcatgaaccgtgttgggtgctgcttactgttgtccccacctatctcttgattgcaatcgatctccccaaattggtaattagaaccatcgacaagagatggagggttttctatggactgcaaatggtggcaattgtttttcttttgggaataagtgaatcagccaacccaaatatacagatcttggactcttggtattcataaccttgaggtctacggctggtctcttcacataaggtggctttggttggagaaaatggatgcttcatgaccatgggcaggtttgcccattcaaatgatgtgcaatgtccaagctttattcaatttggccatggaattaattgttggtaatgatcaatccaccctagatggcagagcaatatctgaattagccccaagtctcataaaaagatccacaaaagaaccatcaaatggtgcacagtgcctcaggctttagataatggatgttctgctggtaatatcaaaggggtgctcactgttcctctcctgagagaacacctatttatctgggatttggtggatggcttgaacctgcagtaaggcataaaggatcaacgtcaatggaggctttcaaggtcgggacttaattttagaaaatcagactacaacaccttcttcctcaggataatccttttcgctccatggaagagatcaagagaatttggaaaagttagactcctttacagtgtgagttctgcatttggctttccattaacaaccactactggactgcagcttgggtcgctaagtgaaggtttccattgccacaccacacagatgcctgcctcattgtgaccaagctcaagaatcaatccaacacattccagtcccctgcgtcattgcctagcaagtgtcgtccttgatctttcagagtccgggtttgatttccatctcatcacagcccaacgccagccatttgcccatttctcaagctgctggatgtcgtgcaatcaagtaggtgcaaaaggaaatcagacaagagctcaactcccttatcgttatagtgacctaagaaatttggaaagacatgagtgtttgtcttttcaatggcgtaagtccgagtgtcatattagtattgcagaccacggcaactggcaaactagtccaaatggctgttaacaaatggcatgaaacgacaggtcttcacaaacttttgtggaaaaaacaatccttctattttgtgtcaacaacctagccaatgccaaatgtaggcataaggctatcaaaagccaaagtagcattttcagcactattacttaacagctgatcaccatctgtaagggatcttggctagcaaagcaaagattgaattgaaggtagataagtgattggcattcaaagtagtggtataaagggtttatctctttcttccagatcaacccagaactttacagaaatttaggaaaaagaatggagttttgaaatattttaattggatccacaccacattaacataacattctagaattgagtctacagcctgatcatggtctgcaagaatgattatgatgtagctataacatttcttagatattgggggtagtgatttttcctacatggcataaaaaccggtttgtaatgataattccacaaagactaaattctgctctttgttctaaatagaagttacattagaaggtgcagtcaaacctaaaaattttaaccaagaatacggcaatacgcacatattttagaatttagtacatgaaaatgatactagtaaatccataaataaaa

SEQ ID NO: 24307 - DNA, 945 bp, Zea mays
gcaacaaactactggatactgatcgaaccaacaagctgtacaaaaggtgagatccactgaccaacaggtgatcttctcgacggggttcaaaggcatgattcaaaccttcgcccatggctcctcaccttcactggtcaccagagtggttttcgggggttcatacatagaccatacttatcaacaaaacgtgtttcatgccatccacggcaaggaaacatgaatacaggctgagtcagccagcacccgctacggcacaaccaaacttgagtagaggatcagtcagcacacctagggcgcatggttgctgtaatctccccttacgccgccgccgccgtcagtcacaccattagggatgcttgccctattagggttcgccgtggtggagtatggagagtagggagtggcaacgctgccattgctgcttctcatgcgcccagccgtactgctccttgtaattttcgttcgggctctccgtcccttgcccatgcacttctcgaggtgcggggcgaagcggccggcgacgacagggcgaccgcagttcatacactcgacgacatcggcggcgatggcggggtgcgtctggccgaacacgtcgaccccgcccttgctcccaccctcctcggcggccccgcttcctccagggtggtggtggtcacctccagcggcggcggccgccgcacgtgccgcccagacgcggagctcctcctcctcgccgtcgacgctgcggtccaggccgaggcgcgcgatgcggtggcactccgacgcgacgtccgccacggcgcagtcgaggagctcctcgaagcaactgagcgccagctgggatcgagggctgagaggagcgtccttggacgacgacatgcctgcctcccgtttcctgcttcctgccggtttctgacgtactccgtgctcggccgcactgggatcggttgtcttacccaaacccat

SEQ ID NO: 24308 - DNA, 2994 bp, Zea mays
gctcggtacccctgttgcattaggtaaagtgattttaattttgtgacatgatccttaagtctattgcttaacttcatatcgagtgtttgtttgggattataatctgccgagattatataatccaacaaatttgttagttcaaaaatttgttggaatatataaactggacagattataatttcaaataaacacccgctaaggcacaacctcaatctacaaattcagcgaagaacttctgggacatggaaacatgaacttcgcgtatggtactgaaccttctttacatgcctagcttttttttgcatttgatgcccaatttaccatgtcactacaacgagaaccacgacaagaacaagcatccacaccgaaattgttgggacttctgtcctatcactatcagtgcacggcaataggaagatttcccatcagtggaagctggaatacaaaggttggctttgaatttactgacgccacacaaattttcactcctgcacttgctttcccgactcgatgaaattgaaaggctgtgactggacccagtgtattgcaacgcatttgtcattacctcaacacttgcatgtttcatttcttcatgcctctagtgcgaggcgagaacatggagcagcaagtggaccgaaagacgccataatctgcggagagaatggaaatgtccgagaaggtgcaggtagagaggtaggtagcccaggtgcagtggatggaacagcagataagaggctgcatgatatggcagcgagggattattggctggtaaacacccatgtgcacgctcaagtacgattacgaatggagaatccctgcacgtggcgccacaagttcaaaccggcaagatttgccgtcggaacatctgatccgagcaagataacacagtgcatgtacaatgcacatacagtacagggcgacgcagataacagaaaagcacagacagatcatctccaccgaccaccattgatacacatggatggagtggagacatggactatggagcagtctgcacgaggaagaggaatagggtgaacttgctctcagcgatccagcacgaggtgaaccacttcaagaaaacagcagcagttcagcccattggtggctgccgccaaccgtactggtctctccaaccaacacggagcatgcggttgtgctgctccggtcgcgaaactcagcagctagtcactgccgctcttggctagtctatcctgttaacaggtgaagggcacaattcttgaacccaattcacacatcgatgaaacagagcttgccatctatcctgttctgcactgccttgatcgcagcgacacgggcagctgtagccgctctgtttgcagccatgacggccttgttcacctgctcttgtactcttgggaggtgaaaggcgctgtctgcagcccttcgagcagcctagttgcacaatgagagaatttgagcaactgaagcatggaggcggcgtatcaattataaatgttgggaattgttgaatacctgcagggcacgctgaacagctgggtctgacagaggcaaggagctcttcagaattccagaatcccactccccggctcgttcatccccactcccaaatacgtacatcccgaacccctgtttctttccttcgtgccaagatccctcgtagctgtgtccattggcgaatctgtacgcaccgaaaccctggatcttgtctgcgaagtactcccccgcgtacagatcgccgttcctgcagaggattttgttctgcaaccgatgttacggtgttcacctgaaatggtagcgcaggcgaggccgtgcttcacggtgttcacctgaaatggtagcagccgaggccgtgcttgacgccgcacttgaactcgccggcgtacgtgctgccgtcggagcaggtctgggcgccgataccgtgactctggccgccggcccactcgccggcgtagtcgtcgccgctgtagaatcggtagacgccgtggccgtggcgaaggccctgccggtactggccgcggtaccggctgccgcgcgcccagctctcgacgccgtggccgtcgtacttgccgtccacccagtcgccctcgtacttgcccttcccgaagaagctgtacacgccgctgccgctgcagcggcccccgtggaactccccctcgtagcggtccccgttgctgtagaactcgacgccctcccgcacctccgcgcggcgccccagtcccagccccagcccgagccccgccctccgcttccagtcccgctgctcctcgtcgtcatcttcgccgatgaaccaccgcacggaggcctcgagcgccggggagcgcgggcgagcgccgcggagccgcgcgacggcggccgcggcggcgagggcgaaccccgccgcggccgccaggagggcgaggtggtggccgccgtcgcccccgcgcatgagcagcgcggcgagcgcgaggaccgggaggaggaggaggagcgcggactgggccgggccggggcggaaccggtggtgggcccggcggagcagcgcccgaggcttgcccagtggcgcctgcgccttcttgtcgtcgggttccgggtcgtcgagcgcgtggaacgatgcggtgccgggacccgcgcgcatggtaggcgaccggagtagcgacgacggcgtcctcgtcagcttaccggctccgccgccgtgcccgtccatgcctccccgccgactctcgcccccgccgccgcgtcagctcctctcctgctctgcttcccccgcgacgaaccgtgctctcactctctttcgttgaacgtcgagctgcctcccaggcggtacggatcgatcgacgcggagggagtggttgggtagtgcaagagaaggaagagaggaaggggggccggagaggtgagttttataaccaccggacggcgatgggcagcttccttcccttcgcgggctgaatgaactcgctggcagcgcgaaccgccgcggcgagatgtgatccccgcgccgcctcccgatctcgacccgataggcggcgaatc

SEQ ID NO: 24309 - DNA, 1705 bp, Zea mays
cgcgatcggcccaaagtgggtctggactcgcacgagtacccctcgtgcgccgcatgttcaatgttgctcgcttcacctgctctgtcgccgccgaacaccgccgccaggctccccctcctcactgcactgaacgaaaaacggcagcaagccgcccgcccaccaacccgacaaaatgccggggatgttggcggcgcagtttacggctctctctctatcccagtcaccttcgccacagtccagcttacgccttgccatccgcccttcgctggcggcgagggcccgctctgtcgctccgcggacagcagcctctgcggccgccgtatccgctaaaccggcggcggcttcgtctcccctagttgaggaccgcactgtcgtccgtatcgggctccccagcaagggccgcatggccgagcaaaccctaagcctcctcaagagttgccagttgtcggtgaggcagctcaacccgcggcagtatactgcagatatcccgctgattccaaatttggaggtttggtttcaaaggcctaaggacattgttcgtaaacttcagtcaggcgatcttgaccttggtgttgtgggttttgacatagttagtgaatacggaaacggcaatgaggatttagtggttgttcatgatgctcttgagtttggacattgtcgtttgtcccttgcggtacctaaggaaggcatttttgagaacatacatactatggaagatttgctaaagatgtctgaatggacagaagaaaggccactacgtgttgttactggatttggatatctaggcgataagttcttaagagagaaaggttttaagcatgttcgttttttatctgccgatggagctcttgagtcatatcctcctatgggtatggctgatgctattgtggatctcgtgagtagcggaacgaccttgcgtgagaataacctaaaggaaattgatggtggagtagttctggaaagccaggccactcttgtagcaagtaggaaatctctgcacaagcgtaaaggtgtgctggaggttactcatgagttgcttgaaagattagaagctcacctaagagcaactgcagaattaatggtcaccgcaaacatgaggggcaacagcgcagaagaagtggcagagagagttcttagccaaacatctatatggggattgcagggcccgactgtaagtcctgtctatcgcagacgtgatggaaaagttgatgtggaatactatgccattaatgtggttgttccacagaagttgctttacaaatctatccaacaactgagatcaattggtggcagtggagtcttggtaacaaagctgacctacatattcgacgaggagacgccaaggtggcgcaatctcctctcggagctggggttgtaacttgggcgcatggccaacttcgggtctcttctactagttcccatatgtactgcaccacattcgtttgtcagtgccgaagcatgtaaaccgatatgcagaagtgagaccgtgtggtatcttttgtgtacctcttcgcttcaggaaattttggcctgtatcttgaccatctgagatgtattgatagagttggggaatgctgttgggttgggcgtgtgtgtacttcttgtgcggttgtgcctgacttctcttgccggggcactgaataatcggccatgtttgaataaagaaagccggtgtggttctcattaatgatcaaaaaaaaaaaaa

SEQ ID NO: 24310 - DNA, 6625 bp, Zea mays
ggtgggggtgtttctttgccggcactgggtcatagaggactagtttggaaacttaaatcacctccgtaattttcgacatattgtccggccattgtgcactatcgagagaaaaatagaaatttgaaagtttatgtgtggagcttatagttgcccattagactgtttctaccctagtggtggacgtgatgaataaatgctcatatttgggatgtcataagtctcatcctcctgatatggtctcgtcccgtcaattttgagagacaaccggagacgataccaaataggaatattttcctaaggatgatcttgtctcaaccctgactaaaccaaacaaccatataaagaatcgtcttgtctcatcataatacatcattgtaaccaaacacactctagttgcagacctggtctctctctcccgcaggctgcaaacccattccactaggtgtgcccttgcttgtactatccaacatcagtgtaatacgtgacattgtgctgtagtgctgtactaccggtggatcagcgcggcgctaataacttctggtcttgaaggctgctcagtttagtcaggtactagtaatgctgcacacgcgctagctctgctctggaaccgaagctgcagccgcaggccgcagctgcggtaacagccgctagctgcgccttctactacttaactcgtgcggccgctgcactactgactctggtgcgccgcagttgttcgtgtccttttagtttttaccggtgccagttcgccagtttcgcggaggccctccggccctcccgcaacaacgcgctctgcggcggactgtagcgcagcgcagggccctctgcgaactgccagtgcaagtaaattccagtcagaagcggggccgttatttactgctctgatctaggcaaacgccgcctggtcccccggtttcgtttctattccctctccctcaccatgcatttgggatctattccctctccaaacgacttttaatttcccttccctttgtgaaaggcaaaatcatcgcgatcgttcctctccattccccgtcccccaccccgcatttctagttcaaatcaaactagagtgccgcgtctttttcgattttcgaacccttcatccccacgcaggttttgcgcatgcacttcgtagtttcgatgagccccagtggcccgtcagcatttatttatttggtgtacaactgtacatacatagtactacaagccagcagcgacggagcgaccacaggtgacaccacaccagaacgtgcgcggcaggcatcctccccggtgccggccgcttttttttttttttttcacaaaaggattttttttttcgtccgcaccggacaacgacacgacgtacaagacaaccaagtgcaggcaaatgcagagccgaaccccgcggcctccgtccgagccgcacgcgcgcacggcagaggcgcgacaagaggccgccgccgcgggtcgtgtcgctcactcgccccagctcgcaggagtacattacagcgcgtcacccgcgcagcgtgatgacgaacgacgacccccatccccattccatccggacatctgctgcaggctgcagtacaaaggcaggcggccagccggcctttcgcgccacctctctctctctctctctcgtttctctacctggcactggcggtggcaatccggcgcgactcgtcgcggcggtgggagacgagcttggcggcgtcgcgccaccacaccacctcgcgctccttctcgtggagccgccgctgcgcgctgtccagcgccgactccagctccacgatccggtcctgctgccgcttctgcagcagctcgtggagccgccgctccagcgcgcgcgccgacacgccgccgtgcgggggactcatcctgtcctcgccgtactccacgtcatcctcctcctcctcctcatcgccgtcgtcgtcctcttcgccctcgccgtccacttcatcattatcgtcgtgcttgtcgcagccaccgccgtcgtagtccacgcagctgcgcgacgcgctgtcgggggcgtcgcccttcgtcttcaccttcagcagcggcaactgccggcaacgtcagccacatcagcagcaagcaagacgaacacgcgtcgcgtcacacggacgtacacgtacggcgtggtacgtggtggcgtactgcggtactggtggtgatttttcgttccgcacgtacctcgagtcctcgcgtcggggcgatccggctgtcgccgccgtggccgtgcaccaccgtaccgccgcgcccacgctgctgctgcatgcggctcagctcggcctggagctccgcctccatgaggtccatcaccaccgccgtgcgggagcagttggacgcggcgtcggcgtcggcgtcggccgcggggaacgcgatcgggtccttcacggcggtggtggtggcgctactgccgccgtcggattcctgcgacgtggcgggaccagcgacggcagcagcagcagcagaagtagggtggctcgccgcctgcttctcctcctcctccctgtaccgcgacgcttgcctgatctccgacaccagggcctccatctgcgcgcgcagctccaccatcttgttcagctccacggcgctcttggacagcaggagcaccaggctcgcgcccaggcccaggttcatggacaccagctcctcctcgggcttcttcctccctgcggaatccgacaaaactccagcattagcatcactgctctcgacgtctccataattcaagcaagcgttctgaattcagcgggaggtttttagtgcatatgatgatcctcctgcctcggaatgccgaacctagcgaactccgcggcgtctcgaggggcagctctggcagcggcggcggcggcggctcgacgaccttaacccggggagtctctccctgctcggcgccatccttccgttcctccctcagcccgccgccgtaccgccgcggcagccgcacccggcacccgaaccctcctcccccgccactcccgccgtcgccgccgccacgcagcaggatgcgcgacagcagcgaccgcggcgacggctgcgcgtccaccccgctcgcggtgcgcgccaggtgcgcccggatggacgccgccgccgccgaggaattcgcggccgctaggcgcggcggcggaggcaggggcagcgacgacgaacccgcgtcctctctaaccctccctcccgctcgacccctcacgcagttctccattggaaaaggcgatggaacaaacaagcaagcaagctaagctataggcgctatgcgcgtgcctgccgcccgccgaggaattcgaattattggccacgccacgccccgttgcttttttgctcctgcatgcatgcgtaacgccacgtatttataggagaggaaggagaagatcgagggcgaggaagaagaaagaagctctcccggcctcttccggaaaggcgcgcggcaactttggagggaagttcggcaagtttaaaaaaagcggcggggggagtgttaaatgccggtactaatctaggcgatgaatgatcttggaagcttgcttgggttgcgctaatggcgcgctggccccaccgtcgtcccaggccaggcatgcaattggaggcgcaggggagggaggaattaactgcggggggcgagcaacccatgttgatgctgctgcagccggcgggggaagggaagctgccgctgccggtaccagtaactgcgctgcgggctctgccgtgctgccatttttaaccctctgcacgcaaacaatctctcggaatggaactgtgaattcctgggtgttactgacggccgaaccgagcagagcagaggtcgggcagtgccagggccagggaattttccttctggagactggagggtgtgtcctcatgtcagcgtcgtccagtgcagtgcagcgctgtgcctgcctgtgcctgtgctactgctgctgggaggagacggagctgcagccttgcagggtgcgcctaggtctaggctaggtagggcgtaggcatttttcgttaggccggaactaggtggcggggagacgtcggatgaagcatccgacggctggtattgagcccggcaaaacgagtcgtagtagggtagaagctccgtgcaactgtgcaagtgcgtcaccagcagcaatacgggttatacatgtccaaacgggccggcccggcagtgggcccgtgatccggcacggtcgtggcccggcacgagcacggcccggcccgactagaggcgtacccgggccggcccggtccaatagccgtgccgggcttgggctgaccgtcgggcccgcggtgcaggcacgggcccggcacggttaattggtaggcacggtaacggcccgtttgagggactgattttgtaacgaacagtctatttttagctataatacttataatatgttattatatgagagcattctgagttgtgatatgtgtttatatgtgtatctgaaattctttgtctaaatatgtatctaaaattataaatataattaactaaatctaaaataaatttgaataatacctttaaattctgaattttggagtttttttgtttacgggtctgatccggcacgacaggcccgtgtaagaataacccgtgacgggcctggtctctaacgcccataggctgggccggcccgacacgatactgaactgtgccgagcttactggtgcccctcgtgttaggccaagctatgcccctcgtgtcgggccaagctatgcccaggccggcccggcccagcccggcccactggacatgtatacccaagcccagtcctgactgtccaattggatgaataggaaagctgcaaacgcaattcatttagcacagctactactagatttgaccgtgttcagtaattgaccatcacagctgaggaagtgaggacccaatcatttagcactgatctagtgctaatgtttagcatcagagatacatgcacgcgtgcctggatttcgttttcttccagccctaccctatgcctacactgaaactccatcgccctagctacaacttctaccgccagagctatatcacaagcaacacaagcatcactcctcctatcaccaccaaccagccttttccttacttacctaggcccaacatcatccggagctcttcgacacgcatctccttctcgttcttgcctcccttcttcccgaatgcgccgctgatcagccgcttcttcctctcctgcagggccagtatcctctcctcgatgctgcccttcacgatgagccttatcaccttcacttctttcttctgtccgatccggtgcaccctgtccatggcctgctcctctaccccagggttccaccaggggtcgaacaggtacaccgtcgaggcagctgtgaggttcacgccggctcccgcggctttcagactggccagtagcacagttggggagtcagagccaccgtgactgaattcttggatgacttgcagcctcttcttcgcactcattgagccatcgaggcgtagtgtcttaaagcctgcccttctgaggggcgcttccagcaagatcagcatcttcctgaactgggaaaaaacaacagacttcgatgaggggtcttcgttctgtgaagccgtcagcagcttcagcagtgcttgcaccttggatgagaggggtctgtcagactcaaggttgcctgaaccatcttcatcaggatgctttacctctggagcaaggaagaggtcctctttagataaggtgcgcctgcatattggacagcgggaactggagctcttgaggatttttaggatgcaggtttggcagtatatgtgagtgcagctggttatgacagttttagttggtggagagaggcaaataggacagtcaaagtcatctccatcatcaaccaataaggccagtttcttcaacagctctgggtgtttagacacatcttcgatagagcttgcaggaaaccatgctttcatgtctaaaggacacaaagcaacatcatcacagagctggcggagcctcagaatgaaataaagcacggttgagtaattactcagaatcgaatctctgtcaccgaattcctgcattttgttcctcccttcctgttccatctgatcatagtattcacgctcctctgcagaaagatcaatataacatgccaaaacagttttggagggaagttcaaccatgctcttgtttccatcgtccatctctttgattctccgcaatgaaatagcacctaagaggttttgcaaccgtgacaatccagccttacttcctttctctaaggggcgctggatcaagctctgccagtagctcttgattgagaaaggctggaatctcaaaaatgccatgaggggatataaatcaaatgagctgttctgaatgggtgtcccagtgaccacccaccgcctctctgcattcagagcgataaccgccttcgtctgccgtgctgcagagttcttgatcacatgggcttcatccaggatcacacgaaaccactcgatatccttcaccggtgagtcctcctgctcaaattctgtccccaagatgctgtaggtggtaagaacgaggtcatacttcaacagctccttcttatctctcgtccgctcgccatggtacatgtagactttcaggctgcctgctttcaagtgttcctccagttgtgtcacccaagacggacgcgtggg

SEQ ID NO: 24311 - DNA, 3268 bp, Zea mays
cccccccccccttgttttacgtgccagaaactagatgtatctcacatgaattctcaggtaaatccagtattatgtgatgcgctcttacatgtcgacaaaaatacaaaagcccttcaagtccataaatctgagagtagtagttgcgaaaccaaacaatccaagaaaatattgaccgaagatgctacgatgacccatgaacaatcgcttttcagtcttccgcatgaagcacgttttgacagctccatcatagcaacctttgagtcacatggtctcaaaagtctcagcattgaccatccaatccaaccgatgttctcactagaatgcctaaattttataaaaaggcccaaacctaaactgccaaaactaagatatccctgaacagcagccaacaatttgactccggacaagaataaaaaggttccatgcgctctttcgaaaacatgacgtctaggattcacaaatcagaaagtccactatccttccaggatccatcaccgtcgccataagcgcccaagtttgctctgttcctgcacgcgccgctggtgttcctttgaacgctcaataaacttagcagcaacatcatgaccttgataggatgccagcactgtcctaatgtcagaaggtctagccatggcaacatactcgagaaatggaatgagatccagcagttgggtatcatttttatcttcaagtttaaaaggtttgatttcaacacaattttcatgctgcaggcaagattcaagagcatgggcgctgagatagatcacttgagcagggtttctgttcaactttgacaaatcccggtaatgttttccatccacgtacttagttgcaggtcttgataacctgtgtgaaatggtaccccttgagttcagcctctcaaacacaggttcaacatacataggtggctgatcagaatacacaaggttagaacattaaataatagtccaaatgcaaaggaaaaggtcaactaaccataggtggctaatcagaatacacaacaacttcatataattttgacatatgttccagaaacgcatcaactcctggcctcttaaaagttctccatcccctctcacgctttgcaaaaaaagggatataaagacaggaatgaacatcgttagcgccatggtttttaaagcggtaaggcgagacaaggcattggaccaccgcctggacacctaagcgacgccttaagaacagtggttagcgcattatttgcatacacaaagaaaaatgggaacaattgaaaagagtatcacaatgtgtgaaaaaatatcaaaagcatgttgtggacttgcataagcctggaccacatgtataactcataactactacagtttcagctgatgtatacacaattaagcaccatatttatgcgccttggcactgaaacatcagaaaccacatgttacttgtacaagaatatagtggaggacaactgttacatgtagcacaagatattgattaaggacattgtaacctagtaagcaacaccttttcaggttacgctaaactgcacaggcactacaaattgtacatattaatattattaagatcatctatcatagcctacagtatattacattagtatggaacacaaactacaccctactattcaaccattcaaactgccactagtcataatctctttcctgtgtggcagggataatgggcctacaatattacaatactaaactatttactaaaacaaaatatatgtaaatatagtgccagatgtttgtcttttatgtattaagagtttatgacatcatgtttttggattccaaggtggcacaaataatgaaataaacaacagaacagggtacgatgccacaatatacctgccaatcagagtagacaagagtttcattcagatcaagaactagggtgaagacatgctgatcttgaggaagtagatctggtagcagtttgtctgatgtgggttcagtaaatcccctgacatggtcttcaattgtgctcctaatatccaaatacagctctatagctgaaacaggaactgcggcccaagattgtacacctcttagtaaggacaagaaggtacaaaagataaaaacatatccaacaaagctaagctggaaacaaatagcaattcagcacagaaaaatgttacaattcagagcatatgtctctatcttaactaatgttaaatccatgaatgctttacagaggttcatatatattcatttccaacatgcatgcattgacccacttcataatccaataacaacagaatctgtgtttacactgtctcagagtaattctttaactattcctaaagtaatttgcatgaattattgattatgcaaatcgaagacaactgacaagaaacagtaagtagttctatcattctatgagcctactccatccaatctaggcttgtaataaatcggactcttcatagccttggtggtgagctcttatcatcgctcatctagtcttagccgggggggggggggggggccttctctctgaaccctgtgtgttcagtgcaactggcagcttgtttagttcaagacttcgagctaagtatgtactatggtgtacaaaactcttgtaatttcgttgcttttgagtaacgaaattcagttcgtccatgctgcaaaaaaaagagcctacttcatcgagcatcaccacattgccattaggacatgtgttcagaagtgcacattaaatgatctccagagaagaaagactttgcaacaataacacttgaattccaagaaaacagaaggaagaacactaaaaagaggagcccatttagtttgcacctttcatagccgtcgagtacaccatagctctatacttctcgaacgtggaggcatcctcagggatgagcagccttgggttcttcctgaactctctcgtcttctcctccacttcattcagcgaataggcgtaggtgccgtatccggacgccgccgatggccccggcgactgctgccaaggcgccgaacttgagcaagccccaccgcccgcgtgccgcggggggaggtgtcgatgagggctggtcgcccgctgcgggtgtggactcggccgccgcaccctctgattgggcgcctgcggccgtggccgcggcggaggcgtggtaggcgagacgggagaaccgggaagtgtatgaggagcgggaggagcaggaggcggccgtgaaggggtggctggcgtcgctccgcgcccctgggaggaggaagctgcggtggcggaggaggagacgcgacatggccgcacgcgtgggcgaacgcatggg

SEQ ID NO: 24312 - DNA, 2466 bp, Zea mays
ggctaaccaattctacatttgctacacggattttgcatatcacaataatgtttgtcgttccgtatctatgttttatttaaattttgtacttacatcgcaacgcactgacatataactagtaacctatataaatttgttaggtcgacagctggtccgttgctcaactagtctcgaccccgccacccgcggcatggttttttttttttttttgtgtatcaaacgcggtaaacatgcaacgatcgatagatacaggtaataatacatttttttgaaagaaaaaaaaggaggaaaaaggacaagcaacacaaagtcacaaagaaagacgatagatacgtgcatcttcacgcgtggttacgcgcgagatgcgtcgcgcaacggtgccctgcaaccgcgcacagtacccggcacgacgacaacacgcgcgcgctcgcgtctccgtctcacttgccggcggcatcggcggcggcggcggctggcttgtcgccgttctcctcctccttgttctcattcttcttcttcttctcctcctcctccgcttgctcgtcctcgtcagcgaaggcggaggcggggaacgagcggccgatcccgacgttggacttgaagtagatcttgtcgcgcttctccccgtcgaggctcatctcgacgatgggcacccagagcatgacctgcttgctgcgcaccccggtcatgcgcttcatccggccgtcctccacgtacgcggtgacctcggcgtcgtagcgcacccgcgtgcccgtgccgcggaagtagtgctcgtagggggccttctgccgcatccacacgaacccggtctcgcgcacccagccgcactcctccagcccccgcagcggcatcacgccgcccgggaagcccagcgcctggagcatctgcttggagtgcgcgaagcaggcctccgcgcccgtgatgacctccgcgccctcgcgctgcttgttgccgccggccgccgcggtcttcgtggacacggtgagggaagccatcgcgctgctagctagctagcggatcgaagcgggtgatcgattggagggaagggaaggctcgggcttcgctgccttcgagtgtgtttgttttttgcgtggtgcgacccccgcgggtcccaggggtgttttataggggaggacgggaggtacaagatcggagtgagtatagtagtaggtggttgggcgttgagctacaggcactggtcagtcagatcgtgttgggggttgctctgttattagctgaccaacaaagcgcgagacatgacgtttggcgccgaatgggtgcacctaaacgcccaccacatggaagttgccacccgccctgtgtcctgcacgaggacatgcatgctctccggaccctagtgatctgcttgtgacaagagcaactcttgcaaagtcaataactagtccctcaaaagaaaaaaaaatccaataaatatctctactaaagccatcaaatttaagtgaaccctcacatctctcctcggtctgggagtctccttaagagcaagtagaataatatgttgtaaacatactctgaatactgaggtagagaagagaagaggagaaaaaactcaaaaagcgatcgagttataaatttatagctggctttgacataagaaccaataaactttgtgaaagagacaaataagtcatatattaacagtgaaaagttaactactatacagatgtgctaaaagataggctgtaaaaatctttacaattagcaattagctatattattagccttgctttgagtccctcaaattttctattgcggtcgttttcactctgaacgcgcaagaaaccatgtccacccggaccccaggtcctctgctccatcatacacgagcctcttccaccggcatggttccttttggtgacggagcttgtaatttttgacatctagggtcactatctaagttaacccgtatcaaatcatatacatacccatatttttagaaccgaatgataataatacgtcttacataaataatgttcttaataattaaacgacttgataaaacaggacacagtaagaaatagcctaactacaaatgatttcgtctaccgacgttgctcactaggactaaatatgttagacattccaagcaaattatggatatgaactaaatatgttattaattagagagagaaaaataatttagaacaaaaatacgcaccataccacttgcattgatacgaggcaatggaagtacttttttttcaaaaagtaacatccatcaatggtccttaaacatggcatgttgtatcacatcggtccttgaactcttgaaacccgaagaaaaacaggtgctgaaacttggcgggctattcaaaatcgttcaatatagggttttgcttaaatcagacgtcgatattgtgtgccattacttgggtccccgaacttattaaaatgttgtgtcatttgagctccccgaacttgacatgttgtgtcaattggatccca

SEQ ID NO: 24313 - DNA, 1182 bp, Zea mays
agcataaatgagtacgaattttgaagacaaccaagataaattttagcgtaaattgtcaaaaatttagcataaattgtcaatccgttacgtgtttcgtaacgacgaatttggcctgaattacagcgtgttctccacctgtttagtatgcataggatagcaacaaaaaataacaaaaaatgcaagcacagtgtaactaactgtaaattcaaaatactatgttgatatgaccattctggaccctggatggctatgtaactaactcttgttttggtaagttgtaagcatggcatggagtaaaagccaatctcccaaaatgtagaagctggtccctaggctacgtcttcatcctccactatgcaggtgacaatatcgaggctgccacaaccacacaaccataataatgttcagttggacatagacacacaacgagtgcgtcatgtttcatgcccattaatggtgttccgttaggaatgaaaacaattagtcatcatcttaaaataacttgaaagatcctagacaatattttcaacctccgtcctgtttgaaatcaagttgtagtaatcagcaggctggagctcataaaagttgtcatctttcacatgatctgcactaggcaactttctggattgtagagcaaagttcttacttgaaaaaaacttgaatctcatgtccaagttgcaaaattaggctgcggccacctgaggcccataccaaccaattcctcaaatgactgggccattgctcctcctcgccagcttggtccatttcgtgtgcaatgaacctggacactggactcgacacgtcgttggaatctcggggagcagacttggtggcagggtgttcgtcttctccaacgttgcactgccaccgatttgtcgtcgcctcgttcgagttcgtccggctcggtatacgaggatgtactccgtcgatggcggttgacatagccggcgtccttcccgacaaatctagcgggtgaggagtcgatgggtcacgaatccaggactctgtgtcgtcctctgctgcccgaagaagagctccaaactagagaggtgggagagagcagaagagatggcaacgcgggctgaggcgacaggagatgggggtgaatccgccatggcaggggcgcacctattgcaagggcgaggcgcagggcacagctgctacacgcgcaacaacggaggc

SEQ ID NO: 24314 - DNA, 1977 bp, Zea mays
tttggtgttcttctctagtaagaggtgacgaacaataaaagaagtcgtgcacagcacattagggatgtaaaatgactaaattgtatcctagaaattgtgaaatgacattatgtaataggaagggtgaaattataattttatataaagttatatactgatccaaccctataaatagaccctatactacaaggggatcagtcattttgtgatctcacagtcacagacgaagctgtattgtttatccattccttgtatgattctctatttgtgataatcacaatatctctaatcaaaacgaatggaaaatgcttgttaacaacaaatgaatgtttcgtcctgtgtttataaagggatgtaattcaataatcatgttatcttattgggtttctttacaaaatctcgacagataccaaacggccgcaaaaccaaagcggcaggaaaagggccgccgcgcatgcccgcttacaagcaagcaaaccgtagcctccaccgaaatcacttgcatttcagcgttcagtctccagtcaaatcacttgcgtttcactacacagagcatacgagtactaggtctcttgcagttcaactagtgcatggttatgtcaccactctggggcccggcccccccccgagtttttttttttttttttttatgtgattccgtttctttagtttcagacgaagaaaccacgagagccatgtcatcagtggtagtatttacagtcactcccacacacaagcgacgagatggatgatgatgcctgcttccgactagcagacgagtacgacaccaccaccgtactgacatcgtcaccacggaaccggcgtctgtaactctgactacctagccttgccagatgcaccacccagttcatagcacacatgtatagccaacagcaattggggaaacacaaaagaaaacaaagcgcgcaaagcctgaatcacaagatgatccttcaatgggcgtatcacgaggatcaaatcgtttgtccctcctgttacacgtgattcaggatgccgatgatgatgctgaggttaaccgtccagaggcacgcatttcgtccagagtagtcgctagccagtccaacccttcatacaggccatcgccttttagagcacaggtgccctggatgtgccagatgcggttcgtcaggtcatacagcccaaggccctcacacacttccatcggagtcattgctcccctcatgtcttgcttgttagcaaacaccaataacacactgttaagcataaaagggtcattgattatagcctgaaactcccccctagagctttcccgattagtgtagtacaaacatctagtgtaatcacccaacatgccaccaatacagaactcataacgccagcagcatgacatttatggaaaacccaacatattgacatattctgtcgacaaagaaacagaactgcttacacaactaaaggatggagcagccagctatttccagtacacgcattggaatggccagacttcagcaagaaaccataatttgcatgtttacatttatgaacaaaacataatcgttaacattacatttgaacaaaaaaagatagaaccacttcaccaagccagcccttctaaatcacccactaaaatgaatcacaacacaaaataaatgctccagagaaaatgtggctgaacataccatgtcttgcttgttagcaaacaccaataacacactgttaagcataaaagggtcattgattatagcctgaaactccgccctggctctcccgattctctctctatccagtgaatcaaccacgtaaatctgcaagttcagcaaataatggggaacatcttacatttcaaggaaacagagtttactacaaatcaatgtaaataaatcaagacctaggatatataaatcagcagctacgaagaattgagctatttcctacaatgatattaggatgttttcgggtatctatattccctaagctataaagtgtaataaaaga

SEQ ID NO: 24315 - DNA, 1295 bp, Zea mays
ggccgcttttttttttttttttttctgtgattccgtttctttagtttcagacgaagaaaccacgagagccatgtcatcagtggtagtatttacagtcactcccacacacaagcgacgagatggatgatgatgcctgcttccgactagcagacgagtacgacaccaccaccgtactgacatcgtcaccacggaaccggcgtctgtaactctgactacctagccttgccagatgcaccacccagttcatagcacacatgtatagccaacagcaattggggaaacacaaaagaaaacaaagcgcgcaaagcctgaatcacaagatgatccttcaatgggcgtatcacgaggatcaaatcgtttgtccctcctgttacacgtgattcaggatgccgatgatgatgctgaggttaaccgtccagaggcacgcatttcgtccagagtagtcgctagccagtccaacccttcatacaggccatcgccttttagagcacaggtgccctggatgtgccagatgcggttcgtcaggtcatacagcccaaggccctcacacacttccatcggagtcattgctcccctcatgtcttgcttgttagcaaacaccaataacacactgttaagcataaaagggtcattgattatagcctgaaactccgccctggctctcccgattctctctctatccagtgaatcaaccacgtaaatcagagcatcagtgttgttgaagtagtgcctccacaggggcctgagcttctcctggccaccaacatcccacacggtgaacactacattcttgtactgaaccttctcaacattgaaacctatggtagggacagtggagagaacttcaccaatgtgaagcttatagagtatggtggttttcccagctgcatccaacccaagcatcaccacccgcatctccttgttgccgaagaaggcatcaaacagctttcggaaggcctgccccatctcttgaccttgcccctcgatccaaccggatctgggaggccgccgcggggagagaagcgatgagcaagcggcgcaggcggggcggggagggcggcacctcggaggcaaggttctagaaggtcggaggtcgggcgggcgagctaggtttcggaaaaaggatcggcggcaagacgacgagaggtagggtgcggtgcggccgtggaaaccaggacggcggattcgcgctggcctcaccggccggccccaggccggcctcgaggtccactggatgcgatgcgatgccgcatcgagcgatctggaccgtcctgtctgtgttcgcaaagcgtgcg

SEQ ID NO: 24316 - DNA, 1893 bp, Zea mays
  misc_feature (1536)..(1536): n is a, c, g, or t
gcctcttgctgcctgcatatttgttaaaacactatcggggtgatcttttataaacataatttttaaaactgacttttgtcatattttttcgctattatgattttttataaatgatattactttcatacatattatagcacacatgggaggatgatctcactaacttttttcctaaattatataatcaaccatataattcaagaaatccaaataaagaaaataattattccaaccatactatatgagatgatgaacttgctaacctttttccacatttaaatgagcaaaatctccaatgaattatattaaaaactgggcagcactttcatttttaaagcttatggcatcataaacagagcttctctctgttcttgacgctagctcgaggagagggagagtttgtcaaacaagtatattagtactatatattatctccaaccggtaccggtgtcttcggatggaagacatgttctctagtagcatgtgattgtatagtaaccgataatgaatagtcttgctaaatcatcaacaattccatagtcatcctatgcattatgcctaatttgatattattcacatgttttgacaaataacgtatgcatccatgcatgtttggcataatgccacttgccacacatgccatcttttgtggaccaccaaaacgaaggaacgaaacttacacatgcacacaagctgttgtgaagaagatggatgcccgcaaagctctcgtagcctcgtattcttaggcgccactcttgcatcgccttggcgcgatgggttctcgcggcccccgccgggagaacagaaatcaggtccaagccagaaaacagtaaaatggcccaatgtaagaccatcgtcgcagcagtcctcgtggttgctctcgtggtttcgacgatcccagccagcgccgatacgaacctggaacctgcaggaggctctacggagggcagtgcccgcacctccggcatgcagaaggaagagacccgaggcaacaagaagccagcgacgctcgctggatctcttggttcaggcaagaatgccatctacgggtaaatgattagaaggaatcctgcttcggaaggtatgaaaacaatggggatgtgctcaacaatcaatctcaaccccaggtgacggcaatgagtcacccacaggaatgtaaccggatatagatggacattgctcgttccatatttctttttcatattttctcttcaaattcaattgaaatacggataatattgtgtgaggtcggataaaatttaaatgaatatcagtatcttatccaacaaaaaaaaaaaaaaaaaagcggccgcgcccgggcgggttagatactggataccggactcggacacggatgatatctcagcccacttagggtttgttgggttattgaggaactttggccaggaatgatttccagccagaatcattagtacacataagttctatagtgacggttgtaaacctatttgcgctgtcgttttttagaacagtctatgctagaggccagtattaacaatcttttttacaaacggntaattaaaaaccgccgataaaaattgatttccactagcggtcgacataataaaaccgctagtggaaatttccactggcggtcgagataataaaaccgatagtgaaaagcttattcaagaagagtaaaaatgggtttaaaaataacaaaaaaaattcttagcaccagcataatcattcctaaggtctggtggtttctcctttggattatctttcaatgactttctaaagttttctcagttttacttaaataaatggtggttctacgtttcttcaccggactagtacctagcatatttttctcaagcactacaacatctaggcatcctaggaaaaaaacagtttctctctattttttag

SEQ ID NO: 24317 - DNA, 703 bp, Zea mays
ttttttggccgtttttttttttttttttgatcgcacaagaacatatgactttgtttgtataacgtcagaacggcaggctacccttatcgtcttaataagtagtagagatttcctcgaaaaaacacaatacacattacagtatcagcctctgctgatcatcgcgtgcactattgattggatcatgcaaagaggcactttatgggatggttctctggtagagtggaagcgctcccaatgcttcacgctctgcgctctcctttttcacaagagcaagcatgtcaaaaaggtagctcctgaatggcgtctgtatagcctggacgtcgtcgggtaggtactggtgcttcatggagaggtccatggcccgcttgaggcgctggttacgggcgtccaccacctcccgcggcagccgcgccagcgcctccttgatgtctaggtcgtggtacgggtcgtagaggtcgtcatacctgagcccgtatttgcggaggcgggaggcgacggcgttccggtggagacgcgcgagcggattcctccgcgggttcacgaaccacgccgacagcttggagagcatctcctcgagcttctaggaggttcgcagccttgtgatgttcggcgggcttcctgtctgtttgagtgtttggtgcttgtgcttggttttggtagtttttcccggccggcctcgaggatcccaatcgccctatggagt

SEQ ID NO: 24318 - DNA, 616 bp, Zea mays
cgattgtataacggcagaatgacaggctacccttatcgtcttaataagtagtagagatttcctcgaaaaaacacaaaacacattacagtatcagcctctgctgatcatcgcgtgcactattgattggatcatgcaaagaggcactttatgggatggttctctggtagagtggaagcgctcccaatgcttcacgctctgcgctctcctttttcacaagagcaagcatgtcaaaaaggtagctcctgaatggcgtctgtatagcctggacgtcgtcgggtaggtactggtgcttcatggagaggtccatggcccgcttgaggcgctggttacgggcgtccaccacctcccgcggcagccgcgccagcgcctccttgatgtctaggtcgtggtacgggtcgtagaggtcgtcatacctgagcccgtatttgcggaggcgggaggcgacggcgttccggtggaggcgcgcgagcggattccgccgcgggttcacgaaccacgccgacagcttggagagcatctcctcgagcttctaggaggttcgcagcctgtgatgttcggcgggcttcctgtctgtttgagtgtgcttgggttaggtagtttcgagtacccggccggc

SEQ ID NO: 24319 - DNA, 1481 bp, Zea mays
ttttttttttttttttatcaggtacacataatactattatgatgccatatccgaacattgcgaaaaatggtgatggagagtgttctttgcaaaatacatacagcggcaaaagatagtagatctaacatggatggatatttttttaatatgtacaccatatacaccaaagttttatatacataaaacaagatgcagcaaaacacaccgccattcagtacctcctttttaggcagagctaattcttatgcttattgggtatgttagcatcaggaagacaggaacggcttaggaactctgtgatgagagactgttcctggaaacctggtcctaacaactgatcatcttcacggctcttgtacaccaaaggccttgcggatttcagttatgacccgactagacacatccggaccaaacatcctgggaaggtttgcagtcaggtcaacctctatcgatttcgaccttacaatccggtccctcttgagcaggcagtccctctccgcctcatccatctctatggtggaatcaacacagttgtcaagccaagtctgaagagcctcctgaatgacctttgctaactgtccatgtattatctcttccaaggctttctcacccccttgtccacagtcaatgctcaccattattgctgtaggcgagcatgcgctgcgcacgaagagtgacggagatctgtatggacgagcctgcggtagctcctcgatctttctgcgctgctcatccattccagtttcctcgtagtacttctgcaggtagtccgggtgaaacgcgaggtctttccgtggaagcaggtccagaatcaccaccattgaagttgagctgccttgtatgagctccagtaggaaatgtggtgcgtccgtcgaggcgttcaggaaaatgagaattgaggtgatgtcaatggcaccgttcgggacttcacagtgaagcgaggactgcagcatgaaatcaatcgacgagccaggagagccccgttgcacgtcgagcgagccgacggcgttcccggcggcgttgcgaaactcgacgacgtcggcaggcacggcggacggcagcagccgcgcgcccaaacgcgccaccgcctgatccgcgaccacccgcgccacctccctctgggccatctcgggcgcgcgctttaccgtagaatccggctccgccgaggcgcgcacggggctcgacgttttgcccctgagcgggggaggccgcgagcgggctagccggagggcactgaggcgagggagaggactggagaggaaagagtaacccgagatcaacgcgggcgctgtagcgtggctggtcgccggcagcaaccggagatattgctccagccggagcatggaggggaagctgattcctgtcccggcgtcggatagggggagtaagaagacgacgttacagactacagtgacgtgagaactagcaggtagcagctacaaagaggaggcagcgctcccggccggcctcgagggacccaa

SEQ ID NO: 24320 - DNA, 1844 bp, Zea mays
ggatctaacatggatggttttttttttaatatgtacaccatatacaccaaagttttatatacataaaacaagatgcagcaaaacacaccgccgttcagtacctcctttttaggcagagctaattcttatgcttattgggtatgttagcatcaggaagacaggaacggcttaggaactctgtgatgagagactgttcctggaaacctggtcctaacaactgatcatcttcacctgcatagctcactttcatcatctcagttagcacttggttgttttttatacacaactttagcacatatactttcgattgttcaaataagggggtttcatggactcacaacaatttttctctacaataaagtaactacatgcttgtatttatgaacgacttacggctcttgtacaccaaaggccttgcggatttcagttatgacccgactagacacatccggaccaaacatcctgggaaggtttgcagtcaggtcaacctctatcgatttcgaccttacaatccggtccctcttgagcaggcagtccctctccgcctcatccatctctatggtggaatcaacacagttgtcaagccaagtctgaagagcctcctgaatgacctttgctaactgtccatgtattatctcttccaaggctttctcacccccttgtccacagtcaatgctcaccattattgctgtaggcgagcatgcgctgcgcacgaagagtgacggagatctgtatggacgagcctgcggtagctcctcgatctttctgcgctgctcatccattccagtttcctcgtagtacttctgcaggtagtccgggtgaaacgcgaggtctttccgtggaagcaggtccagaatcaccaccattgaagttgagctgccttgtatgagctccagtaggaaatgtggtgcgtccgtcgaggcgttcaggaaaatgagaattgaggtgatgtcaatggcaccgttcgggacttcacagtgaagcgaggactgcagcatgaaatcaatctgtagacaaggaggaaacgcacatcaggtcctgtcatcgtttctttttactacatcttacagcagtagcaaacaggaagcatgttaatgcaagctttcttccatcctcgacgacattgctgttttcaatgactgaaatcacatattaagattgaactatcagctcaaggacaacaacatatatgacagtgatattcagattggactgcgattacagtttaagttttggaaatcacgggacggatcattgccagtttctttatctggaactcggcagtctcacaagtcacaacaataatctaagggactcaaatggagaactgttagtaacctacaattgacaagatgctttgatagagttgcattagcaatatttccatctaaaaccttgacaattcaccttgaatggatcagtggacaacaattatccaattggcgagaagtaggcggtcagcaagtgcaccaaaccatactgaactgaaacacaagccattttttggtattcaatacagatgccatatatggggtgatgtgtgtatttgagtacgatataccaaggaaaaatggtggaatgcatgatgtgccgattccgagtcatactggagatcccataaccgtattacgcacagagcagtatagtagtatgcccttatcttttggtatgcaaccacacgaaagctgtattatactaacatggtacggtactaccacaagaaaaaaaaaaataggatcactattgaactgtaccgacgagccaggagagccccgttgcacgtcgagcgagcagacggcgttcccggcggcgttgcgaaactcgacgacgtcggcaggcacggc

SEQ ID NO: 24321 - DNA, 4314 bp, Zea mays
gataaaagtggtttatttgtcgcaatttagctaaaaacaaactaaataaactagttggcaacaaatattcgagaactgagatactacataggaaaataatgaaaaactggcaatgttgacatccacaattccgcttctgtccttacatcctcaccgttgaattccatggacttggattaactgtactgtggcaacaacaacaatgaagaccatggcgtttgtcaattattttttggaacaatcagccaagtaacaacttttaattcaaactctacacaagaccaaactatcgcagattccacccatcgttgctacgttgaatttaacgctgctctaacagccaaaatacgctcagggtcaccaatcaaacataaataacaccaccagataaaggaaccaacattgaagttggtgacatgagcgaggcaaatcagcacaataggatcaccacctccatgcaatgcaatcgctcttggcatgagatcaatttcttcccagcggaagcgagcggcacgagtatgtctccttgaaatccgacttcctggacgatgtgaatatggacgcatacacttccttattggcatgggctggcgcatggtccgcagccttgaagcgctttgctgaagcagcctcgcccttcttcccattctcagctccggccgccgccaccaccggcgccacgacagtagcagcatgcttattcccactgagaaccttcttgtccttcctctccttcgccttccccctctcctcctccatcctcttcctgagctcggccacctcctcctcagtcccgttgatgggcatcttgtcggcctcgccgaactcctcgtggcagaccaagcacgcggacgtcttgacctccttgagcgccttgacgctgagcacgtggccgcacccacggagcgcgaggaactggtacttgccgttgaactcgaggccggtgacggggcactggaaccggacctcgtccccggcggcgtcggcgcccggcctggggtgcaggtggatggggaccatgtcgcgcaggccccggatgtgggacagcgccctgggcaggcgcttgtggagcagcgcctcaacgagcggctccttgttgtagaggttcccgaggcggtcggcgacggcgggcgcggcgaggggctccccggagagcgcgcagcaggtgaagcgcgagaggcgcgcctcgttggggtccgccttgtcgggcttcttggcgaggtacatggagaggtagcagtcgcgggactcggcgcccgtggcgccgccgtcgccgccgccgccccggagcgcgcggaggcggagctggacggaggccgacggcgggagcgccgccaccggggaggaggccggcagcgggcgcccgtcggcggtgaggtagtagcaggagggcgaggggagcgggatggagcggaggaggtcggagacggggaggtgggaggggacggtgaggtgccgcgggggcagcgccaggtcgtccaggcgtagcacgacggccctggatgcgggctgggcggatcccgccatggcgcgctagggttagggttccggcgaggctgtccggatcggggtgcggaggaaagctggtgctggacggacgaagacaatggggaattggggatgaggagagcccgagccaaatcgagatgggcggacgatggtgcgagcggccgtggaaaagttggacgcggaggaatcgtgaatcgcgagcggtgaaccgatcttgttgtggtgcctagtgggccgagccgggccgggtcatccgcggaaagcgaggttggcgcacgtgacttgaatctggtgagctctgagaacttgagaaggcgaggcctgccagctcctgggagtgagtctggcgggcgagattttgagcattttctagttctttcttcgtgtacttcagtaactccacacggtttcggccgctagagagcacacaacacgatcgcggagatgcgattgctgttctgttgcaggtgaccgtccagcgactgaagccgacaaccgagctgtgtaaccaaacaaaacagctggtgagctggatatccatctatatctatacttgacaaacgtgcgtgcacctcgcttgcatgagctgcgggtcgtgtataaccaataaacatgatcgccgcacgcccttatatattcctcgatcacgccttgtttgggtttctccggtcatcaccacgcacgacctgaccagcctactggcgtgcactgcacatcgttccatcattaacgctgtgtgtacgttcgtcttaagatgaactaagataccatgtccgcagccacatggtcaatgatctggtgatgccagtcgtcactgcgctgcgcatcatggtacggtgcaccaagtgaaggtcaaagcctcaaaaaggactcaataattttttttagatacacccttttgcttttgatacagctgtcgctcatgctctccccccagtccccctcatccggagctgttagccgacgcgggcgatgatatggtcgtcgccgcggcggcagcgccgccgttggcaccgtgcatctggccgccgccgccgccggcggcggcggcggggggcgggcgggagaggagcgacgcggatgaggtggccgaggagatggcggacgccagggagatgggcatcaggcacaggcccttgccctgcaggtactgcatggccgtgcccatgtcctcctccatcatcttcgccacctggtgctccgccacccgcagcccgccgccgttgccgctcttggtggtagcgctagtgttgccgccgccgccgcttccattgctctttccctgcacgtgcgcgtgatcaatgcatggatgacgacgatgctcttgccacgacatttgttatgttggtggtggcgagtggccgagcgagtgccaaatgctctggttggttaccgccgtacatacgtacctctgatgaagccatgctcgcaaccagaggcgccatcccgccggcggctccgcccagccggctcatgctgagaacctgtgcgcaagcgcaatgcactgcacaactaacgtcagcacgtactgcactggcactcgatcgcactgaatcaaagacatgaactgccagctgaatggcatcaccttgacttggagctgcaagaacctgacgtagtcgatgatctcgtccagcatcgacgccttgtccgtctgcaaaaccacaaacaacgacgatcgaccgccccacacaacgtcgccatttcagtgttgattgttgacgacgcgagcgagagagaagaggaaggagctagctagctagctagagggggatgccgaccttgttggcgttcgggaccagttcctgtagcgacttcatccgctccgcgatcctctccctccgaagctgcatgcgcgcgaaatggatttttttttaacaaaaaaagttgagaaaatctctgtgtcgtacaagtggtagggacccaacaaatttctatttggctaatgaaccatcaaccatgacatgcataactgtatgtaaatttataacatactaaaactcttctgacaaaaaaacaaattttgcatgccttgcaatgtgttttgtcacattgttgtgtcttaattgtgtgcttaatgaaaaaaatcagagaagttgtgacagttcagctttcagagaatgttgttgttttttgttaaaagagggaacagttcagcttgtagagaagaaaaatgaaaaggtggcatacatacacgttccgctatgctgtgagggtcagtggcctgccctctcttcgcccgctgccgctgcagcagctgccgcgggggtgccgccccgccgccggccgatgaagctgccccaccagctgggggtgcgccgccgccgctcgccgcggttcctcccaggctctcaggcgacatcgatccactctgtggcgccggggacgcgcggcatagacacatggaatttaagaagggttcttgtccttgtcaagtggcatatagctatagaaagatggcgcgcgagtggtgatcttacctggccaaatggtggctgcacggtggccgcgccatgcaccccaaacccgttgaacaaggagtggtcacctccctgggcacgcgcgcgaaaatccatgccagcgaaatagtcaagaggttaagggagagatcgtcgacgtgaagaggagaaaggaaggaagccagaaccgagccaagacgacgacgacaacgacgattcttacggcggagttgggcgacttgaagccgccctccatctcctccggcgccggagcggaccggtccgtgaagagcccgctctcctcgccccccaggccgccgtggcggtgcaggtcgctgagctgcag

SEQ ID NO: 24322 - DNA, 3152 bp, Zea mays
  misc_feature (2368)..(2368): n is a, c, g, or t
  misc_feature (2476)..(2476): n is a, c, g, or t
gaaccacgcttcatcacttcataatagccatggttaagtctgaaacagcgcagtaagcgccggaaacagaggaacaagtgtcatttacaacctgatcaactgactgaactgatcacaggtcacacgcacagcagatgctgtggagagcattatccagaccaggacctagatctagatcatatttagcaccatgcaacagcatgactgagtgatgagcatctatataatccacattaaatcaaaggacagatttcggtatgccttctgacttctggatcccccgtgtgtcactcatgttccacagaagctgaatgtacccttggaaagaacaggtacatgttgaattctcactagggcactaggcatactgcagagtccaagtaaccatggctattaactgggccaagaacacgcttgtcactagatatatctagatgacatacctaaacctaggggttgtttggtgcgtggactaagccgccacggcgcgccatagttttcccgccgcaggtgtggcggccgattcgggcgccgcagcttaggcgcgccgtggcgccgcacgcgccgtaccaaactggcccctaaagttgtagacaagtgagtcacaaaaaaacagctaaaagtaagagggggcatcatttgccacccatgtcgagatggcatagaggatgcggcctttccatccctgcaagagccagtggtgatcaatatcgatcacaaagtccttgtggtataaatccctgaccttgttccgcactacctgcacgacatcagggttcagcggctgctgcttcaagcctgctcgttgattccgcacctgccattgcttgtacgtctcagggcgctccacccgatctgtgccctcgcacgcgatgacattcagggcagcccgcccgaaaaggttctcctcaatcagcatcctctggttgctgtctcttggagtggtcgtgtccagagcgtcaaacagggccgagtaaaagaacagagcctctcggaacctcgtcacgaagaagggcgcactgaaggagccattcacaattgcatgtatgaatgtatgaggccgcatctttctgatgttattgagcacaatgtcccttgggctttcaatcacaacgctctcatccatcaagttcttaaactggtataggcagttcacgatgagcacctcctctggatcgagattcagatcctccgcgcggatggactccatcttggatgctgcaatcgcctggtacttgaatggcacaccaaactgctgggcatacttgctgagccggcgccctgtctcctcaatgcgctgagtagggcggaacccaggctggggcaggtcaatgccagtaatcctcacctccggtggcccgccctccctatccgctatccatcgaaggaagcacggccactggaagccgtaatggatcccgtaatcgacgatatgtatcttcatcttgcccagagcggcattgtagatggtgttattcgagaacacgaagacgactctcttgaagcagatggcggccatgtacagctggtacgcctggagtatgtcggctgcggacgtgcgcttggccatgagcgactggtaaaccatgctgccggtgccggcgaggcgggcctggaggccctcggcgaagcagtgagcgaggcgctgggtggcgtccccctgcgggcttgcgtgctgcttgatctgcctgagcagctcggtggcgctgcggcggtcgtccgaggcgacggcctgcgcgcagtggacgagcagcgtgcgcaggtccaccacctcccgcccaccgcggcggcccttggccttgccgttcccggcggcgaccgccgcctccttggcggcctcctcctgcatggcgatccgcagctgctgcatctgctccgtgcacgtctcggggcaggtcatgatgtacttctcgaagacgtcccgctcgtcgccgtccccctgcagcgcgctctgcttgctgctccggcgctgcagctccaggtcctcctcgtcatcgtccaagcggttcctccgaccgcggcccaggacgacgccgccgctgccaagcgcggcatcaggcgcagcgaggatcacctcctcctccttcaccgccatagccacggcggcaggggcggtggtggcggcggcggcgttgaatccgggcgcgaggttttctgcggcgcgggtggggaggacaaaccgcttggggtcgtctggcggatcgaggtcgatgacgagcttgtcctctgagggcaggaacttgttggcctcctccatgcccttgaggaaggcggagctcatgaggtcggagttggccccgttgctgaagaaggccgcggggtcgaggtcgaagccgtcgaactggacggcgggggccggggagtaggngtcgaccgcggctggggtgagcggcgcgctggcggacgcgtcggaggaggagtggttgacgctggcgctgctgttggtggtgccagtggtggtggtcggggacgaggngtcgtcggagaggatgtcaaggaaggactgctgcgcctggaggagcgcggggttgtccgggtagtcgtagaagaaggtgtcgtcgatgtcgtcctccatgagcatgctggagatgtaggggagcaacatgtcctgcgtggggcctttgctcccctgctgctgctgctgggactgcgggtacggctgaggctgcggggtgggcgggaggtcgaggtacgcggagggcgaggcggggccgaggtcggagaggtagaggaagaggtcgtcggcggccggggacgggtaggggtcgtaggaggagcccatggcggcggcgaagttggggaagagcggttgcgcgggaggaagtggatgagaatgaggaggtttttagctgctggctggctttgtagggggcgcggcggggaggtgcagcgggcgacgaaggttcgaggaaggcggcatcggcggaaataggatggattcgcgggggcggggtggaggttgggggatgatgacggaggcggagggagtggaaggagatagagagaggggatcgagagccccgtggcccgtgggcgtggcataatgtgggcccgggctcggttcgggcggcgaccgggctcgatcggttttcccttttctcttccgccgtggcatagaagctgacaagggccacgagcgcaaggcccaaacc

SEQ ID NO: 24323 - DNA, 3683 bp, Zea mays
tgttgggccctaaactagtcaaactactagtcttctcctacctgacattctggatcagtgacaactgacaggtgctctgaatgtctcgtgctgctcatcttatggtctgaagtactgcagaatttcaccagttcggtgccatgtgcgaggagatactcccatgatcttatcctccattttctaggatttgtgctcagttattcttgctcgtatacttcctaattctgtattagtataacagacctgacaccctgacatactgtattgggatgatgggagagctgaagccacagaagaagccaccatcaaacacttactcaggcgtgtttggtttctagggactaatttttagttcctatattttattccattacaaaattgctaaatatagaaactaaaactctattttagtttctatatttagcaatttatagactaaaatagaataaaacgaatggactaaacattagtccatagaaaccaaacatcaatcatctcccatcaactcagtaaagtcgtgccgtttcagtcatccagagtgtgaggaagacaagacgtacattgcctctcaggattgcaaacgaaagacatgagaactttactgcagtctgcatcaacatgttggcccaattaaacattggatgttgaacatgaacaatttattgaccaaatcatgcatgccaatctgctggaaagagctcccatttatacaaggcaggcagcatgggccagaccaaaaccccccatatgtagcctgaacctgaagatgcaaaagacagtgcagcaagagatgatggcaatcctggtaataacagactgattactgaacaactccacaatgaaaaacatcaggcacagcacagttcagaaaacatcctaatgctttcgtcgctgccgcaaaccaatatatagtttcaaacgaagactcggttcatcgaccaaaccatgtacatggatggataaaacacatgccttgtacattgtattctggaaaaatgctctcatgtgcgataagagtagacagacaaaatccatcagttcatgataacgattctgaagtctgaaacagcgcagtaatcacaccggaaacagagaggaccaagtgtcaattacaacctgatcaactgactggattgatcaaacacggcagatgctgcagaggacattgcccagacccaggacctagatctaatcatgtttagcactatgcaacaacatggttgagtgataagcatctagttcgcattaccatcaatcacaagtgagtccatgtaacccactgaacacacttgtcactagatatatccagatgacatacctaaacctaaaatttgtagacaagtgagtcaacagaacagctagatgtaagagggggcatcatttgccacccatgttgagacggcatagaggatgcggcctttccatccctgcaagagccagcggtgatcgacgtcgatcacaaagtccttgtggtagcaatccttgaccttgttccgcactacctgcacgacatcagggttcaatggctgctgcttcaagcctgctcgttggttccgcacctgccattgcttgtacgtctcggggcgctccactcggtctgtgccctcacacgcaatgacattcagggcagccctcccgaagaggttctcctcgatcagcatcctctggttgctgtctcttggggtggtcgcgtccagcgcatcaaacaaggccgagtagaagaacagagcctcccggaaccttgtcacgaagaaaggcgcactgaaggagccattcacaattgcgtgtatgaatgtatgaggccgcatatttctgatgttgttgagcacaatgtcccttgggctttcgatcacaacgctctcatccatcaagttcttgaactggtataggcagttcacgatgagcacctcctctggatccaggttcaaatcctccacacggatggactccatcttggacgctgcaattgcctggtacttgaatggcacaccaaactgctgggcatacttgctgagccggcgccctgtctcctcgatgcgctgagtagggcgaaacccaggctggggcaggtcaatgccagtaatcctcacctccggcggcccaccctccctatccgctatccatcgcaggaagcacggccactggaagccgtactgtatcccgtaatcaacgatatgtatcttcttcttgcccagtccagcattgtagatggtgtgatttgagaataggcagacgactttcttgaagcagatggcggccatgtacagctggtacgcctggagtatgtcggtggcagacgtgcgcttggccatgagcgactggtacaccatgctgcctgtgccggcgaggcgggcctggaggccctcggcaaagcagtgggcgaggcgctgcgtggcgtccccctgtgggctggcatgctgcttgatctgcttgagcagctcggtggcactgcggcgatcgtcggaggcgacggcctgcgcgcagtgggtgagcagcgtgcgaaggtccaccacctccctcccgccgcggcggcccttggccttgccgttctcgcctgccgccgcctccctcttggcggccgcctcctgcatggcgatccgcagcttctgcatctgctccgtgcacatctcgggggaggcgaggatgtacttctcgaagacgtcccgctcgtcgccatccccctccagcgcgctctgcttgctgctccggcgctgcagttccaggtcctcctcgtcgtcgaagcggttcctccgaccgcggcccaagacggcgccgccgctgccaggcgcggcatcaggcgcagcgaggatcgcctcctcctccttgacgagccacggccacatggacggtgggagcggccgcgttcaatccgggcgcgagcttgtccgcggcgggggtggggaggacgaacctcttggggtcgtctggcgggtcgaggtcgatgacgagtttgtcctgggtgggcaggaacttgttggcttcctccatgcccttgaggaaggcggaggtcatgaggtcggagttggccccgttgctaaagaaggccgcggggtcgaagtcgaagctgtcgaactgggcggcgggggccggtgcgtaggagtcgacagcggcgggggtgagcggcccgctggctgatgcgtcggaggaggaggaggagtggtggtggttgacgctggcgctgctgtgggtggtggtggtggtcgggacagtggcgtcgtcggagaggacgtcgaggaaagactgctgcgcctggaggagcgcggggttgtccgggtagtcgtagaagaaggtgtcgtcgatatcgtcctccatgagcatgctggagatgtaggggagaagcaagtcctgcgtcgggcctttgatcccctgctggggctgcggggtgggcgggaggtcgaggtacgcggagggtgacgtggggccgaggtcggagagggagaggaagaggtcgtcggcgcccggcgacggggaggggtcgcaggaggagcccatggcggcggcggacttggggaagatcgggtgcgcgggcggaagtggatgaagacgaggaggttttagcggctggctggctttgtaggggcgcggcgcggcagcaagcgacgaaggttcaacggaggcggcggcggaaatgggatggatgtgtggggaactggggattgagaggagcgagatggcgcggaaag

SEQ ID NO: 24324 - DNA, 1335 bp, Zea mays
  misc_feature (17)..(17): n is a, c, g, or t
gaaaaaccacagaacanaagaaggggaggaaaagacaagaagaaggccatgaggagagctgagaaggaacgcctgaaggaaggtgaggctgctccccgcgtccggaagaaactgaagaaggatgcaaagaagaagggtgcatcttccaaggagtctactgccaagggttcaaagaagaaggctactgctggtggctctgatgaggaccactcaacctctccaactcgcagccgtgatggtgaccatgcagctgcggacgaggaagaggatgatgatgatgtccagtggcagactgacacttctattgaggctgcgaagcagcgtatgcaggagcagctgagtgcagcaaccgctgaaatggtgatgctgtccactgaggagactgagaagaagaaacatgcaacccacaaagatggcactgctaatggttcagcaaaagaaatacctgatgaaaagcctgccgtcactaagcctagtccctataaagaactgattggagacatcaaggctagcctgggaagtgctcccacacctacccagctcaaggctatgctggcctcctcgacccttccttcccaggacgtgatgaatgctctcctcgaggctctctttgacggtgtgggcaagggatttgcaaaggaggtcgtgaagaacaagaagtaccttgcagttgctgtgccagatgagggtgcccagaccctgctggttcaagccatcgaggcttttggcagcaagtgcaaccccgaggcgctgaaggaggtcccagttgtcctgaaagccctgtacgacggagatatcctggaggaggaaaccgttgtggactggtacaacgctgctgtcgcagctggaaaggactcccaggtcgtcaagaatgccaaaccgtttgtcgagtggctccagagcgccgagtctgacgacgaggatggcgatgaatgaagaggcgatgctgctctactgttcatggcttcacttgataatattaattcaataagtttattttgcttgtctggtgtcatcgatgtcagtcttcgtttggtgtcagtcggtctggtgtcgatgtctaaaaactgttattgtcgtgccgcgcagcataccctatgtggttggctgcgtttggtgtcagtccgttttgtgtttggatgtcacggtttattatgttcctgtgggctgccactatatattatagttgcttgggatgtgttttttataaccttttggggtgttgcactttcttattgcattgttttatagtattttaagggttgatgagattttatatcaaacttatatggaatccttagccggcgcggccgcgggtgagtcttctgttctcat

SEQ ID NO: 24325 - DNA, 703 bp, Zea mays
cccacgcgtccgcccacgcgttcgtttttttttaggtcgccaatgatttcattcaaaaatgtcaacatcttgtgcaaacatcatttaactcatgtgaaaccaacattaaaattattcgtcaatagctgttttaaacaccaaaaccatgccatgtaacgttaaaattattaagtcttctcgaaatcctaacgaggaaactagctattgttgggtaatttcttcgaactttgctgtggaagaaatgccataatagcttttattcccccaaaagacacatcatttatcctttcgaaaggatgggatctacacaacagattcaagtaccctgggaaagctcgcagcacgcgcgcgcgctggcgccgggatgcgccgtgagacgcgccatcacggcggccaccgtcaccggggaccccatcaacgccgccagaggccgcgcggacgggagcggggaggaggtggtggcgaaggcgggcgggacgcggcggcgcggggcgtggaggcgcgcggccgctgccgggcggcggacggcggcgaggacggcccgggtggcggggccgcgccacgccatggatggagagatggatactgaatagggtttcgtcggagtgggaagagagtgggaggagatggcggcggcggcggcggcggatggatgtatggcaggatgtaggggttttttatgttctaggtaatggtctcgtgc

SEQ ID NO: 24326 - DNA, 5027 bp, Zea mays
  misc_feature (4676)..(4676): n is a, c, g, or t
agcaaaggttgaacgagtaaaataccctggactcctccaacctttaccagttccagatggcgcttggaaaatgatcacgatggattttattgaaggtttgccaacatcggatcactcaaactgtattatggtcgttgtagacaaattttctaaatacagccactttattcccatgtgtcacccgtttacagctatgggagtggctcaacacttcatggacagtgtttttaagctgcatggatttccttcatctatagtgactgaccgtgatcggattttcactagtactttatggaaagaattgttcaagttagccagagtggaattacgattcaccacagcgtaccatccccaatttgacggtcaaacagagcgagtcaatcaatgccttgaaacttaccttcgctgtttcgttcaagcctgtcctactaaatggaagaaatggttgtccttagccgagtattggtacaatactagctatcacacttccttgaaactcacgccatttgaagtgttgtatggttaccctccacgccatcttggggtggatttcagaacagcatgcgaagtgccctccttgcaatcttggcttgatgaaagaaagatggtaattcaactggtccaacagcaactcgttcgagctcaactccgtcagaaggcacaggctgacaaaaatcgcactgaacgcacctttcagattggtgactgggtctacctcaaactgcagccttatgttcaggcatccttggtccgtcgcgcgaaccacaaactggcattcaaatttttcggcccttacccagtgatcgaaaaggttggctctgttgcttacaaactacgcttgccagaatcttgccacattcatccagtattccatgtctcgcttctcaagaaggcattgggacctcacgtccaggtgagtcctacactaccatctgtttcagattcctcccaaaaaccagagaatgttttgcagcgcaggaccattcggcgcccgtctggagatgtcccgcagctgttaatcaaatggtcctcctggccgcaagagttggcaacgtgggaagatcaggctacaatctagctccgatttccagaatttacgggcttggggacaagccttgtctcaaggaggggagaatgtctcaataccagaggatcctaacttggaaggaaggccgcagagaattcgaaagcccaatgatagagtgagtgggccaaaatggacccagtagtggtttcgtttcttaattttcctgagagatacgctgttggtatttgagggggtgcaacactgcgtggagagggtgatgtcggaagacaccatttggccggctgcgaccggaaggaaggcgacgctctgtcgttgtaataccctactctgaattctctacctaaattcgatcttcgtgagaggaggagagcaccgggagcggtgttcgcgatctcaacatccatacggtcacacaggagccggcgagcgatggagaagaagaagaagagcagggccagggcggcgacggagacaggctcgccgccggttccagctactgctgctactactactcgaggtcttccggcaccctcctgactggtggtgaacgggatcagatgcggagtctggtgtcggttcagccaggcaatccggcgttcgtgactgtcctcatgaagacccatgttgggcacaagaacagcatgctggtcagtcagtcagtttcacatgtttcagttgttagagtctcgactaaaggacatgcgtaggttgttctttttctgtgctggtctgaagctgcatacagatttccacgcatttgtttttttttttctttttttaatgaatttgcacgcatttatttctttttctttctttctttcttttttgcaatgcagaccgtccaccatggatttgcggcggagcaccttgaggggagatcgcatgaggtcctgctgctgaggccaaacagggaagagaggtggtgcgtcaggtactaccacgcgagccacaccagaggcttcaactgccgccgctgggtcaagttcgtccgtgaaaacaggctgcgcaaggaccacgtctgcgtcttcgagctcatcaaaggcgccacgaggacgacgatgcttgtccatgtcctcaggaaggctgatggacggcttgcgctggtggcctaagctcatgcatgtgccatgttgcaagtgccgtgcaatatgtacccacgtacgtatgtgtgcctctacccttgctatgaacctatctatggggtaaatgatgtcatcatccacaactcatgcacaaataaacttttggcatgaaaagagatatgagacggtaggtgcatctctaaggaggagcattacaacacagattaagtcgccaatgatttcattcaaaaatgtcaacatcttgtgcaaacatcatttaactcatgtgaaaccaacattaaaattattcgtcaatagctgttttacacaccaaaaccatgccatgtaacgttaaaattattaaggcttctcgaaatcctaacgaggaaactagctattgttgggtaatttcttcgaactttgctgtggaagaaatgccataatagcttttattccccaaaagatacatcatttatcctttcgaaaggatggggtctacacaacagattcaagtacctgcaacatagcagcagcatatggtaagcgaaggcttaggaaatttaaagctcactgcaatgagacatcaagaacaacgatcggacaaatctgaagaaaaaaaaaacttcctgacccaagtattaaaaaaaagaaacaccaaggggcaaaaagagacgcattgatcagggcaaaagataagaaatggagataacatgattgatggcccaacaaaaaaagtaccgcactgtcaaaatcagtactaaccccaagtagacagcaagttagaaaatgaattcaagaacagttgaaagtttgaaactatgagaactggaattgttagtaagtgttatgcgacactcatagaaaacatttggactggtggtgccccctgccaactgatcaaaagtgtaaacaagaaaccacagaaagcactagatacccattattgttactgattgggagctatagaagtacaagaacaattgcatttttttttatggagctgtcactagtgtagtttggtggggtgagatcagtggagtaggaacaggaccctgttgcaaactgcaggctctggaagctgctgcctggaatcctggatacaaagggcctgattggaggagctccttgctcccgtgccgaggagccccaaattcgcaactcttccagctctcttcttagttcatttgtggttgtggcagagccgaagctgttttttacaccgccacagtttgatacagtaacaaacagtatgcagagtgacttgggcgccagagccaaggaggcggagaacctcaaagccgcaccaagcagggccaaaaacttaggccctgacttggtagtagctatgtaatgtatggtgcagtgcatttgtttttttccttaccatgcaatgtttgaactgattcctatgggctagtggtttgtattcctctttgtagaagacgagagactgggcaaggaaccacacatacattcattatcatcagtatatataggcacagatcctatctgtgtgcaacagagggacttggtgcgttgcgcaaaaagtgcggcgatttagcagctgaagactgcgtcgtgcggtagtggccattatgatctatttatctgtacatatccgttaacaccccccctagtcttagccggaggagtcccgatgcaaagactggaccggaagttgcagaacgtcgacgaaggaaggcctttggtcatcacatcagcaaactggtgcccactcgggatgtggagaacgcgaagatcaccgagggcgacatgtttcgaacaaaatggatatccagctcgatgtgtttggttcgcatgtgatgtacggggttgctggacatgtaaaccgccgagacgtttgtggcctaccgcttgctcgaccatgaaaccagcaatttgctgaagaagacgtagtacctgaaagtggaacggtgggtatccgggcagccgtcccaatcggcgtccgtgtaggcggtgatggaggttgtcaaggatgcccgaagatgtaggccgagagatgtcgtcccccgaaggtagcgcaagatccttttcaggagagcaaggtgacagtcgcgggtatcatgcatgtgcaagcatgcttgctaaacagcgtacgaaatatccgatcgtgtcaaagtcaaatattgaagtgctcctgcgagactccgaaacattgaggggtcagccacctgagcaccttgggagccagataacttgctagcggtgtcaatgggcgtgagggggatggcttgcaggggggcgtccccgcgccgtcctgcaggccatcagcatatttatcctgagagaagaaaattttggtggcagaccgtcaaatctccatcctgaggaagaagtggagctcgcccacatccatgacaacgaattcggacttgagctggtcgacggtgtggcagagtatagtaatagaggaggcagtaagaatcatgtcgtcgacgtagagtaataagtatgccagatgaggtcctcgcttgtagacaaacaacgaggagtcagagcgcatcggccgaaatccaatggagacnccgaaatccaatggagacgacgaattgcgcgaatctatgaaaccaacgtgaggtgcctgtttgagtccgtaaagggacttggacagagcacatattgcgcctggcatggcgacattaacaaacacgaccggttggtgactgaacacatgttcctgcaagtgacagtgaagaaaagcattggagacatcaagttgtcgaacgggcagtgcctgttggttgctatggtgagcatcatccgaattgtgccaggcttgatgacaggggcaaacgtctcgctgaagtcgacacccggctgttgtgtgaaaccagtcaaaccacggacgacccatcgtgccttgtatttgttgaagc

SEQ ID NO: 24327 - DNA, 2736 bp, Zea mays
ctgcagcaatgaatcgaacctaggacctcccgtagtgtgagaaccaaattaccataacactatgccgtatctcatgtgtagttaaaggaaactaaactatctatatgtttctagtttggcttataagtatgtaaaacaaggttcaaaaacaagtttatatgaaattataatttcaaatttgtaccttttgtttatataacctttacaaacttacttcatgcataggtgtccatttttaggattatttactaatttctgtggtttaattgccttccctagccaggaaacataaataaatagtaaatatggtcaaaaaatagtgaaacttagcatggagtcatgttttggtcttagttgcttaagataaaaaattcagaggattatgaaaaagtgtgaatgtaggtccttcacaaacggacacatctctcattaagtttcgggacattgaactacaactccaaagtttgagctacatttcttactttttttgtttttccccttgaaaagtataccttttgttcatataacctttacaaacttacttcatgcataggtgtttatttttaggattatttactaatttctgtggtttaattgccttccctagccaggaaaactaaataaatagtaaatatggtcaaacaatagtgaaacttggcatggagtcatgttttggtcttagttgattaaggtaaaaaaattcagaggattatgaaaaagtgtgaatgtaggtccttcacaaacggacacatctctcactaagtttcgggacattgaactacaactccaaagtttgagctacatttcttactttttttgtgttctccccttgaaaagtataccttttgttcatctaacctttacaaacttacttcatgcataggtgtccatttttaggataatttactaatttctgtggtttaattgcctttcctagccagaaaaaataaataaatagtaaatatggtcaaaaaatagtgaaacttggcatggagtcctgttttggtcttagttgcttaaggtaaaaaattcagagcattatgaaaaagtgtgaatgtaggtccttcacaaacggacacatctctcactaagttttgggacattgaactacaactccaaagtttgagctacatttcttactttttttttgttttcccccttgaaaagtataccttttgttcatctaacctttacaaacttacttcatgcataggtgtccatttttaggattatttactaatttctgtggtttaattgccttccctagccagaaaaaataaataaatagtaaatatggtcaaaaaatagtgaaacttggcatggagtcatgttttggtcttagttgcttaaggtaaaaaattcagagcattatgaaaaagtgtgaatgtagtacacacatgttctaaagtaattggaaaatgcaaaaaaaaaaaggttcccgagaattgtacaccatgcaactaacataaaccactgagccatgtgtatgtcacagtaaatctgacaaaggaaatttatttaaccgatcaaagttctgcagattcaagcataagttcaatctgcatgctctgttccactgcctttacacaagaacgactgacccgacccgacggagatcacagagtatcagatagaaagaagtgtcagtccagatcaagctatatgtgtgctccactgctggtacactgctagtactacatcctacagcagctgcttcagttccagttcctaccacgagtggagtggagtggagtgcctgtcctgggctgggcgctccagcagttggtcaacaactagatgaacctggcaaacaaaagcctgcaaaatttagataaccctggcaaacataagttcaatattaactctcctcagccaatctgcaccgtaaaagtgcaatctgcaccgagcacattgaacaagtaaaaatgagagaaatgagagaaacattgaaaaagtgcctgtaatttgcagatgaaacattcagtcttttgcacatggactgctcaccgtaaaaattcagtctgcagaactcagcacattttcaaacattcaatctgcgcagccccgctcagtttcaaacattcagtctgcggaactcagcacagtttaatgacattcagtctgaagcagcaggttcaaacattcagttattcagtttaatgacattcagtctgaactcagcacagttttttgtcttgtctgtttaataacaagatctgaactcaacatgaccattattcataaaaccatgatctgaattgaacatggtccatccaaataaatatttcaagttacattcacaactaaatggcagaaaatactacagcctatccaaataaatattacaagtgtcatttcacaactaaatatcagtagtatcagctattcgtcatcactgtcaacatcatttgtagcaccttcttcggcttcgctgcaatactccaaaattgtatcgtcatcatcttcttcttcactatcactcccatacactttttggccattttcttgtaccaattgagcaatttcagcagcttcaaaaataagaccttgttcatcatctctacttaaaggcttctcatatatattatcggaaactgcttgtcgactagcattctcttcacaacactcattttcttgatatgcaggagcattatgttgggcaacatcattttcactcacattataaacatgtctatgggcaaatgtctgaacaacatgccaatttttaccaatttt

SEQ ID NO: 24328 - DNA, 1661 bp, Zea mays
cgaagggacacagagttgcaatggttggtgatggaataaacgatgccccgtctttagcagccgcggatgttggaatagccatgcgaactcattcaaaagagaacgctgcctctgatgcagcttcagttgttctactaggcaacagactttctcaggtggtagatgcgctatccctgtcgaaggcaacgatggcaaaagttcaccaaaatttggcctgggcagtggcatataacatagtagccattccaattgccgctggagtgctgctgccacaatatgatttcgccatgacaccatctctctcaggggggttgatggcccttagctcaatctttgttgtcagcaattctttgcttctgcagctgcatgggtcgtttcagaacacagaaaaacggcagggtgatctgagctcaagattaaactgaattgttgggtttagtttgacccagccgaaggacagtggtattgaattatagagggttctgatactggttttccagctccggctaattgaactgagtcagaactataagtagcaagctattcgtgtcagtagtagcatgttcctgtactgtttgtcaacccaactatagtagcaagtatgacccagaaggacaataatctaccacggccttcaaaaacattgtaaattagtaatggtactgctgtaagcctgtaaacaaagttaaggcgtatgactatcgttcatggtctagcaatgtgcaacaagctataagcttcatttcacacaggtatgggaagttcagtcaacagaactagtcgaatagcaagcagtacacatagcaactatggccacactataatggcaatcatacccctgaacaatagcatagctaggagattactggcgattcttctacttctacttctacttccatgtgttggttgttctaggcttctagcactcttcgtatccatcgttgttggcccagtgcaccttcttgccgctgctgctccgcatcaccttctcgtcgacggccttcaccccggcctccgcagctgccgccgactcggcctgcacacgcgccatcttcctccctcgctttctcgccgcggccgccttctccgtctcggcctcctggtactccctcgcccaacgccggctcagcacgcatgttgccgctagcgcgacggcctgcgccatgaacatggccagcagcagtagctcctccaggaacgccagcacgaactgctcccggcggtccctggcggagccgaagaggcggaggctgtggtcgtggcggaggaagaaggccagggaggccagcgcgtggccggacagcgcggcgagcgcgagcgccgtgctcgcggcgaggcagaggtgggtgagctgcgcgtggagcgctgcgagtgcggagagcagggtggttgcgtgcacggagacgagcgcccagccgaagggcgtcggccgcgggcggaggaggaagaccgggccgagcgcggcggcggtgaggacgaggagggagaggttgaggagccagaccagtaggttgggaagggaggaacatctccgtaggctcgagttcccggtggcggacgccattacttttctgggtgtggcgactctgcggtgcttgtgctcggtgcgacagtgatcgtgtgagtctgatttgtttctgaatgctgagttcagaggagcg

SEQ ID NO: 24329 - DNA, 2962 bp, Zea mays
ctgtgctggctatgcacacttaaaagctccagctccatgcagatccgggacaacgcagtggccacgaaaatatacaggacaagaatcactggatacgagacgcgttggcgaaggttaaagaagctgttagagcaagcaaaatgagattcttttctcagtattgtttttaggaagatttgcgtgttcttttagagttgttctaaggccagtagatgaaacgaacccatcacaaaatttgttttgatgtcgcacaatgtgcctgcatcaagaacaagccttccaaagtataaaattccgcaaacaagaactgtcaaattttcttccggcaaacaaactggcccgtgcccgtctaatgcccagaatttttggcgacaccagataatcaagttcggccgcgtttttttgttgtgcctttttagagaataaatccagactaagcatcattgcctgtctccagaaaggtctcgattatactcatataatacccaagataagtcgcaattcagctaagcaatcatgcatggatgctgtagcaaagtataaccgctcaggcgacacctataaggctataaccctttcttcacattaacggaggtaaaagaaaaaggaaaactcaaccacaagttgcagttcaccccgacctggtgcctcagttggagctcgctccgaaaaccctgattctctcttcgacttcagcgctgcagcaggggcagcgagtgatgcctttatcttcatgcagcttattgcagccaacacagaggacctggtgggcacactggagtaggatcacacacgccgccgccttcttgcaggcaacacagtcccggcggcggcttggcttctgggctggtggtggcagcgaccggttagatgcaggttgtggccgcaggatggcctgctgcttggctgcctgcgccgcgcttcggttagctgtgccaggaaagttggctgatgggacagctgtttgagttgcacctgctgacttctgcaggcggctgagttcatcctggagcctgtgtaggtcatccttgtagcactcggattcgacttctttcttgcgacgaagctcttcaagtcggcggtcattgtctgcttttgcagcttccttcttcctgcgctcatcttccaaaagcaccatgttttcttctttgacccttgtgtcttctcgcatcttcttctccatattttttattgccttgttgacctcagcaagctccctttcagcttgtgtaatatttgtcttgcattcagcaatgtcctccttcagcttcgctttctggcgctcccagacttcaagccttttgctatccttcttctctttccttaagagaccctggcattgtttttcagtctctgatgcactcagttttgcagcttccatctcagcacgtatctctgcattctccatttccagcctctgaactgttgcattactcctgtcaagctgcccactctttttcttcagctcattctccagatgagcaaggcgcttcattgtgtcatcctccatcacctgtttttccttcttacgccgctggttctcatcatgttccatccgcagcacacgcagctcagtaagatcagcaccaagcttgcgagcagcctgtatcgcctttccctgtgcccattcctttcgctccttaagctgcgtctccatctctcttgtctgcttaatgagttcacgcgccatctggttctttgggtcagggttcgcatctggtggatccttcttgtcaatgtccagtgcctcaagctccgcaacaacagactcgatgagttcctcagtggagagcttcttggtaaacgattccctgggctgcccttctggtgcggcgccactagatcgtgaccacccggcggccttcaggcaggagatggtggctgcagcgggaccctggcatatcgcaagtctcatgaaggcttctgggtcaaaaagagtggggtcctgagcagctgtggctgtggtgttatgatagtggatgtatccacgctgtgcggtctctgccacggctgggaggtgctcctcactctcagcaatagatgagggttcaccattgaaagagctgcttatggcgatcgcctcttcaatacggaggtcactggagagaaggcaccacaaggcctcggcgcgggtgagggtagggcggctgctctggaggaggcagacaagccccgcgagggagtattcctcgaggcgtcggaggtcggcgaagccgccggccgcgctggcgtggccaggatcggagaggtaggcgcgggcgttggccacgatgttggaaacgggatcgttgagcttgccgtaacagtggcccgagtggagaacggcctcgagggatgcctcctcgccgtggccgaggtcggcgaggcgggccagggccgccgcgtacgcctcatccagcctcttcagcaggcgctcctcaagctcgtccgccgtggcgcggagccacggcgcggcatcctctccgacggtcagatcgggatcggaggccggcgggggcgcctgtgcaagccccgcgcgggcggaccggcccttccgggacgagcggctaccacgctcgcggggttgccctgccatccgagcgcgagtcgggggcggcgggagcggtggtaatagggtttggaggatggatcggaggtgctggttggctgtgatgggggtgcggcggcgcggagaccacgtcgatgtgtgcgagtgcgaggggagggggggatgtttttttttatggtgttgtgagaattagtgaagatggggaggttaatttatttgttgaggaaggaggggagggggaagatgaagaggggtagagtaaaggggggggggaagggggagaggggaatgggggggggggagagggaggaggggggggagggggggaagggggggaggagggggggagggaggggagggggggggagtgggggagagaagggagagaagggaggagggaaagggggggatagg

SEQ ID NO: 24330 - DNA, 1621 bp, Zea mays
ctgcagtgaggtgattaaagagttagagcatctccaaaagaacactaaaaccaacccgaaaacgtattttagggtagaaaagcaaaaaaactccatccaacagttcccctttccttctccaaatttttagcgtcccgcatccgagcttcactatccctcaaatattcgcgagcaaagttgttccccaatcccctcgccggcctcttgctccctcgcaccgcgcatgacgtcggtgaccgaccccgacacgttcaccagctcgtccttgtcgttgtcctcggtgaacagccagtgggtcaggtagtcgtcgttgtcctcgttctgcgattgttccgcctcgtgggcgtcgagcttcatggagaagctgtagctggaggacttgtagagcatgatggctttgtgttcctgccgccattgtcttcgtcactgtcatccgcggcggcgcgctgcaggccgccgtctgcttcctgctgtaccatgatggcggagagaagactctatgacgacgtgagctcttttaaatgtttaagggactggttattagcattctgatatgagcttagtttttttttggaggaaattttttttcggcagcccccaatatgatgttttggggaacaatttcttatgttgctcttggtgttgctctaatataattccattagcttgcaaatgttctcttcagctggaacggaatgggggattacaaccggagacaccaccacggtccacaaccacaagtctccagtccaccacacataaccccacgcccccacgctcacggctcaccatgacaacaaccacctactccaacagcagcagcatccatcgagtgaactaagctgctgctacacgtactaatagctagctttagctcctccgatcctaacaccctgcgggctagctgtccagtggatgatccaacggcagtcagtcagttcgcccttcgccgggctagctagctagctagctagcttagctgaccctccgtatgagcatccactgggcgcgcggcgcgggcacgggcacgggcaccaccaccagcttcttacggcggcctcacttcacctgcgctcacggcggtgcacctgcttcttcttgtcgtcgtcgtcgtcgtcagcaacggcggcggcggcctgcctggcgccgccgccaacacggccggcctcgccgtggagcaggtccaccaggcacggctgcttgcagttgacgcaggtcgggtagtccttcttggccaccatgcagtacatgaggcaccgcgtgcaggcgccgatcaccatcggcgacttactgcccccggggctgctgccgccgccgccgctcgagctccgcccgtccgacgacacgcacgagctcggcgacgacgacgacgacgagtcgctgtcgccgtggacgcccccggcgccgtccacctccatccccaccggcggcggggacaggtccagctgcagctcctccagcctggcggcgctcctcacgccgccgttgctgctgccccggctcatcgctgaacgctgatggcttagtccttaggcgagctgagcgtggatcgaggacggatgccgacttgccgagagaggccgggggagacgggaacagagggaaggaggtgagccttgat

SEQ ID NO: 24331 - DNA, 507 bp, Zea mays
cttctgtcgtcgtcgtcagcggcggcctgcctggcgccgccgccacggccggcctcgccgtggagcaggtccaccaggcacggctgcttgcagttgacgcaggtcgggtagtccttcttggccaccatgcagtacatgaggcaccgcgtgcaggcgccgatcaccatcggcgacttattgcccccggggctgccgccgctgccgccgctcgagctccgcccgtccgacgacacgcacgagctcggcgacgacgacgacgacgacgagtcgctgtcgccgtggacgcccccggccccggccccgccgccgtccacatccatccccaccggcggcggggacaggtccagctgcagctcctccagcctgacggcgctccgcctcacgccgccgttgctgctgccccggctcatcgctgatggcttaggcgagtgtggatcgaggacggatgccgacttgccgagagagaccggggagacgggaacagagggaaggaggtgagccttgatt

SEQ ID NO: 24332 - DNA, 1688 bp, Zea mays
aaaaaaagagtcgtttccgctacgagtctaaatagatgtttttctagttgctgtgcgttttataaaacatattttttttaaaaaaaaaacggagggtgtagacatgctacgatcactttctccaagcaagtttttcaccgtatatcttctaacgaccctactacagtgtacatcacactgctatattgttatatgaccaagataactgcgcaatacaatcagatggctgtggcatttccaggggcacacacactcccagcgtgcacggtgacgaactgtgttgctcctcgctagcacttgtgaagtaataataatatatcttcactacaaagttcaagcctcctttctagttatcctgaagcaatagattccaagggcatccttgatttcatgcacaaccgacacagcgaggtgcaggtagagacccactgtatatgcacaataaagcagcagcagaacaagctcatcaactaaaggactcccatcgttgatctttgcaatgagagcatttgcaattggaaaacaaagaaacaccagagacatgaacatcccagattttagacctttgggttcatcacacaaatgagcaagtatcattcttcccaccaaatatccaaaattaaagccagttccaatcacgagcaaatgtggctggttcctcattatacttgaaggagaaagataacaccagatagcaactccagctaacagtacaataaaaggaaggatcatggctaatgctaatgccatgcttccttttcgtgcctcaactacctcttggacattgctgacattggatctaacagtaggtataacagcacatacgatcataagaatcagcacaagaacatataaaggaatttcaatttcagaaagaaatggaagtggaatccaaccaaaaaagggtagtgatttccgaaaatcctgtgcccaccattcagcgccagtaaaaaatgtaaacaaatgtgatacatagatcagcatcaggccctccgttggtccatttattgtaggcagaatgagcgtatttgtaaagaagtgttcccaggttgcaagatagaacgggacagcggcaactacccagaaacaaaatgtccatcctccacacatcaaggtgcttccaagggccaatgcttcaaaagcacacgcaagtgcatcacatccatgatcaaaaagttctccaagaggactcgatgagctagtacgccttgcttgtttaccatcaacagcatcaaaagtctggtacaagaagagaagtaatccatgggcaagatggacccacctagggggagcagtgtcaaggtgaggcgaacatatatagccaagcagcgctgatagtactagaaacgaaaatcctgtaagtgtgatcatgtttggtggcatccagagcgggaagagagtgacgcatcggctccagaagggctgcagcacgtacttggccaccaccgagcggtcctctccgctgtacctataccgcttcagcgtctccacgccgtgcgcgccgataaaccccatcctgctcgatcgagttcgccgctggctgtgggcgaagggacgctgggagcggaccgagtggttttagaagctctgaatggacgagaaggggacgcgattatggcgggcgggggctggagtggtcccggcccgccgcgacttccgcgagcggcgagaaggcgtggcctgcaggg

SEQ ID NO: 24333 - DNA, 886 bp, Zea mays
tttttttttctttttttaaatagatgtttatctagatttatagcgaaatataatacatattcttttttaaaaaaaacggcgggtgtagacaataaccaagataatcacatgctacgatcactttctccaagcaagtttttcacagtatatcttctaacgaccctactacagtgtacatcacactgctatattgttatatgaccaagataactgcgcaatacaatccctagatccctctgctcaacaaacagatggctgtggcatttcagaggggcacacacactcccagcgtgcacggtgacgaactgtgttgctcctcgctagcacttgtgaagtaataataatatatcttcactacaaagttcaagcctcctttctagttatcctgaagcaatagattccaagggcgtccttgatttcatgcacaaccgacacagcgaggtgcaggtagagacccactgtatatgcacaataaagcagcagcagaacaagctcatcaactaaaggactcccatcgttgatctttgcaatgagagcatttgcaattggaaaacaaagaaacaccagagacatgaacatcccagattttagacctttgggttcatcacacaaatgagcaagtatcattcttcccaccaaatatccaaaattaaagccagttccaatcacgagcaaatgtggctggttcctcattatacttgaaggagaaagataacaccagatagcaactccagctaacagtacctcggccgcgaccacgctaataaaaggaaggatcatggctaatgctaatgccatgcttccttttcgtgcttcaactacctcttggacattactgacactgaacaaaagaaccacttctaagcaaagattgtccacgcgtctg

SEQ ID NO: 24334 - DNA, 7685 bp, Zea mays
  misc_feature (7028)..(7028): n is a, c, g, or t
gtcgtgccagaaaaaagaagcctcctcggtcatcgatcaagtcagtcaacgacgcgaaccggcagcgacggcaacacgggcggcggccctcccggcgtccgcgcgaaacgcagccagccatgggcgcatcgaggtggatgttgtgttcgtcgctcgtatcatgcgtccaagaatattcattcagaccgcaacaaggctgtcccggacggtgcagactgcagaccgcagggcaatgtgggaccagccgtggaaaagtactgacaaatgtatagtcactcaaaatacggtttttttactgtggactacactgtttgtaaagtagaatttaattatgaatatggactatggtatgagttagctggtgaaatttctaacaacagaaagagagagagaaaaaacaagaccaggcctttgcaccgcagtaaaccgcggctactacagaccttgacaatcgaacggacgatttttttttttacaaccgctagccttgacaagcaaaaggtgttcgtcggagccgtctgtcttgatcggtgtccatttgctaggcgcaacatgcgcttttctcgatgcaagacagagaaaaagaaacgcaagacaaaacaactggtaataaatgctctactagtacaatggccggagccaccagccaaatcacatgtctactatctccttcatttcccgttagtccgtccgtccccaccaaggtacgttaataaactaacgcgagcggtaaaaatctaaaaactaaaaagtccaaaatattgtggtgtcacttgagtcacatttcaaagcttgtcgtggtttaactacgcgggcgggtagatagcaacagacaagtcaaggcaccacccccaccgagtggagtggccctcgctgtcactttaggttttggctgtggctgatgctgacaatttatacgtggattgtcatgtgcgcagggactgattattctttgttctgtcacggagagagctgactctcatcaaatcaaacgctaaaccatagcagagtgccaaaaataaaccaacgcggacggcttagataagagactccaccggtactgcaccagcttagaaagaaaataaaatacctgaaagaaccattactacagaaaagaaaggtgatgttgaaacttccatccccgcacatcggatgtgtatatagcacacggttagcttctttctgaaaagcttaaccatttaaacaccacattcctagcaacagacccagacaatacccatcaatatgcaccttatgaacagtacaagcaagcttaagagacagtataacattttttttaactacccaggacacgctgctaacgttaacccgctacgttttcaagaaaggtaacgaaaccacgagttggaaggtgatatcaggatttagatagacacatcaagaattacagatactacaagcactagcagtaactgaacaaaaaagagagagagagaagagagagagacatacagaatcgtaaactgatcttacagcttacattacatgcatggtcatcacatcccctgctgatgcgacgatagaattgaccacccagcacccgacgcgagctttggcgcctcaatattgtgcctctggtccgtccatagcaaggctacacatataatatatataataatcatcgacgagcctgacaaaaaacatttccacaatccaatcggtgatcagcgtcagctagctacatagtgtccgaatcgtccttgttataggccagcgggaactcgtcgaactgctccgtggcgtcgcggccctctccgatgctcttcagggcgtggtagacccggtacatggagtgcctctccctcacgcgaggctgggtgcacgcaaaggctaccttcaagaactcctcgatctctgcctcgtggcccttcccgcgcaaaagtttgtcgacagcatcaccgatccggccagaggccttgagctgataaacccagtccaccaatgtgcccttgaacccttcgcccgtcacgtcgacggtgcccaccgcagcagcagcagcctcctgcccgctaacgagctcgaacagtaccaccccaaacgcgtacgcgtcgcctttcgtcgtgccgaccggattgctcgcgcactctggagcaacgtagccgaactcccccaagtctcccttgaggaatgggctagtatcgccgccctcgccgggcgccatccggaccagcctcgtgaggccaacgtctgtgatccgggcctcgtagtcctcgtcaagaagcactgcgctcgagctcaggttctggtgaatctgcggaacctggaacccgtggtgcagccacgcaagccccctcgctgcccccacggcgatcctcagccgtgtcgcccagtccagcagcggcgcctcctcccctggcttcttcttcatcaccgacgaaagagccccgctctccatatgcttatacaccagcagcctctcgtcctccacgacgcagaagcccagcagcggcacgatgttgggatgccgcagctgcccgatccgacacatctccgccctgaacgccttctccgagagcgggcacgagtgcaggcgcttgaccgtcagcgcggacccgtcccgtagcacggcgcggtaggccgtccccgcccgcgagctcccggcgaccacgatgtggctgctgctgaagtcctgcgtggcggccatcaggtcggcgagcttcaccttcacgatgggcttctggaacagcgacaccggggccaggcggttgtgcgccgcacgcagcctctcggtccaccagctcccgtcctccccgccgcccgactcgctgccgccgcgcctgtggcggcggcgtcctcccttgcccttcccgctgcaccgccagaagaagtaggcgaggagcaacgacgcggcggctcccaagactcccgcggcgatgacgctcccgaggccggcgctccccagcccgcggccgcagcgcgaggacacggggcggccgcagaggcccgagttcccggagaaggagtccctggggaagcggtcgccgagctggggcgggatctggccggagagctggttccccgagaggtcgagcgacttgagccggtcgagccgcgcgagggaggcggggatctggccggagagctggttcccggagagcgtgagcgagttgaggaagcggcagttggcgagctccgcggggatcgcgccggtgagctggttggaggagaggtcgagggtgacgaggaaggggagccagtcgcagagggccggcaggatcgtgccgacgagcgcgttgctagagaggtccagcgtggtggcggcgctgcagtactggagcgaggaggggatggagccgacgaggccgaagccggagagcgagagcgacagcacgcgggactcctgcaggttccagcagccgatgccgccgtgcctgcagacggcgccccccgaagtgttcttgaagtcccagtcggcgaggcgcccgttggggtcggcgaggtcgtgcttgacgccccggaggcagcgcaggccgtcctgctgcggcgccgcctccgatccgggcgcgggctgcggcgccgcgggaggggccaggaggaggaggacgatgatcgggggcaggaggcgaggaggaggcatggcggacggatgcacgcggattggggcgcggcggtggtggtgggggaggggagcggtttgaccaggtgggagactgcgtgcttgctgcgggctgcggcccggggtggtggtggtgggattggagtggatggggagggcagggaaactggcaggcaggcaggcaggcagcgaaggattgaagagttgtatactgcgtgtgcgctgcgcgctaggctctaccgctagtggcagttggtctgggttttgggacgggctgtgcgtggaccgcgccgcggggtcgccgagatggcggagggaagcgaggcggatcagcggccagcggggcacggggtcggcgcgatggaaacgaatgagtggttgcctgattgggctgggtgaggcggatcatcggctgggccgtacaacccattacccgtataagatctatatctgcataaccaaagtttaccaaaaacactattttataatgttccactcgtagagagatttataatgttccactcgtataagatctataactgctgcagatagttttagaagtaagatggtctacagtggaccctataaaatatgggacatagactatatatgatattgtttgacactgtttgtggaataaagtttaaaataatagatgagataggacatgagataggaatccgatagagataacataagtgtaaaaaaacacaagaaacatatcttagtgaagaacatctttagcacagttttagatatcatataactcatataaatataagtcgtatattaagcgattctagtgaataagatatattggattctataaaatatttcttatgtatatctaatacatacttagagaactgtaacatgttatttaagttgtacatggcctatggtcgccctagcgggttacaggaaattcaactattttcccggacattagatggagaaaaaaatcgattcctccgacaaacgtttgttgaaaaaaaaattgataccgaatctcaaataaaacatatttttcctgttttttccgggaaggatccaagaaaagtttatgattataacccttataacccccataatcatttggtcgggatcttgtgcatatctctcaaataaacaatctccatatggtatagattcagttatttctggatagatacggtctgtagaatccaaactagatgcagacatccaccaagtaagcaagaatcgatcaaacacgaggaaattgttgaggctttggtgttaaatcactgtagtttttgtcaggtgctttatttagtgctagagcaaaatgttggttttggaacagttctaaatttcataaacaggtggctgatatataacccacttctatatagcattgttctatatatatgatataaaaatcgattgtgctctatatttcttcttttgttaatttcgtacatcagttgcttcctcgttttctaggtccgaaactagggggtcgactgacgactagcatatcgtgaagtgtatttttttaaaattaaagtctgtttggatccatgaattaaaagtaaagtgaccaaataacagactgtgcaccacatatacatcacatattcacatgtataattctaatacttcatagcttattattgttgttatttgcttattttttaagagaaggtatatttgcttgactataatatatactagtaacttaggcgcgtcttgcgcgcgcacggaacattagtaataaatggtagcagtgttaaatctgggattaaatgaagccctgttccgattttaatataataaaaagtataatatgacaaccacctgacgattggtctgattgatacctatactgcatatttatgctagcaccggtggctgctacgactcttcaatcttgcaaacaaccacctgacaggaagctttcatagtgagctcgggatgaagtatggtagcaatatgatgtccgtatcagtagtaaaatcgtaagatttgatagatttaattaagtgctggaccgcgctcactatgaaagctcagtatgaaagcaaacatggactatggttctgaagtaatactgcatattgattactaatttctttgtcattcgagtgtgctgaggaaatgctcacgaagagggtgctgggctgaatagctagagggtcccaaagaagctttttccttgctctggttttttagcaatctcagcagttgtgtccttttcaattgtaaaaaaacgaaagatcagtatgctaagactactaacttcaatcaagctctaacatggagattgaatgtaccaattagaacgtaccttgcttgttaagctgtttatttagcagtagaattatatatttgagatgagattttaacgaaaaaactttttctttcaagcggcaatcagttggtaccttgggagggggaagggctggtgcttcttgctacccagctaccggacagaatgctcaggtcggtccttccccattcgctccttgggcagcggtggattgaaggtgcatcattcagatatgcagggaagacgggtatggggtagcgacatggtggtggagagggccaaatcttcgatgaatgcaaccggcaactgatccatcggccatggcgactgctcttcacagcgtctcttcatgatagactcggccacctcctcctcttcgtcgtcgttcgccaggtgaccgcgccggaccaccagtgccccctaccgcgccgacctgtgcgtttcgaggtggcgatgtctgagggggcagattcagactcccgacggtggcccaaacaccgcagcgtcgtttgacggaggaggtgggatggtgctccggttggagccgccacagacagtgtcggtagcacgacgacgtttgaggagggagcgaggacaccggcggcgtctaaggaggacattgtgtttgggggctcctcgcgacggcccaggcacttgcgacaatgtttgaggggtagacgggaaggcgctccgctcggatctgctggagaccacgtcgaagccgtcagcatgacatcttctgaggatgggtggaggggaaggggatggtgctcatctaggcgtctggacgcatcattggtggggggtggagcctcggagctccatcgcgcaacgaagagggcgctagcggccgaagtccggaggggtctggaagcattgcgtagcgaagatgttaggataggaacgctttcgcgggggggggcccggctggaacccgttgagacgtgatccaacggctggagcatttggagatgacgtggacgcacagatgcgcgcgtttgcgtcgcactctatatagtagtaatgctgatggtaacacatacaaataagtggggccaataggtctaatatgtttacagctgattattaccggtatctttcatatataaaatcctatagagccataaatgatgctttaaatgctacggatttgaagaaacntcttgtggtttgagaatttagatcttcaattagacattatatgaacttttttgtcaatttaaaatatcattatatgttgtattagactattatgtgattagacattgttgtcctcgtattgtaaactattatattatacaattgtattatttagacgtatgtaatgaatttacaacccatctaacaaatatccaatattatgtatgtatccatttgaataatatcctatatatgttttctacccatctgaataatatccgattttgtcgtatatccaccttttagtaattgaacccgatgttaattttaagtcaaaattgttaaagcgggatacccggtaagtacctgtaaaactaaactcgggtaggatacgagtacccaatactcacctggctggaacccggagcctggccagttgtcggttggctcttctgtgcgctgcgccttgcgtcgacgggtgagggcatgaggcctggctggctagcccattagcacaagcccaataagtaaaaggatgtgctagcaactgggtcccacggagtgaaaagctacacactgcaacgttcgtgtgatttgagatttcttgctaacagcaacggatcccattttttgttggcttcactgcacactgttcggatttcttgctctgttcgtgtg

SEQ ID NO: 24335 - DNA, 1015 bp, Zea mays
ttttttttttttttttgtagaagaataatcgaactttgaaatagaatctcacaatgtggctttgctataagaagcaccttctcggcctttctcatggttttgacagctttggccagcacaggacataagtaccctagcaatacaatacttagaaaacaacaaatgcataaaaatcttggtatgtgccatgaaaccaactcaacatcagtagcactgatcttatccggtctgcaaacataatcttccaaatcagcctcatcactcaaatccatcttagcagtatagacttggaacacaagcctcttttgccgccaatcgggacaagggaactcaactttcctgtcaagtctacctggtcacagtaaagcaggatctagagtatctgccctattagttgccattacaaccttcacattcactatttgatcaaatccatccatctggaagtagcggccgcagcagagcacaactcagtgctgcctgggcctgccgacggcgaggatgcccccattgatctcggcagccaaggcgctgtacccgcacgatctgcctctaacgaggtggggtgtggaggggagagcatgacaagcatgtactagcagccacttcatggtctcgccgtcggacttgtggtcgagctcccgcgtgatctagaagatccacgcgacgcagagcgcgggcatccggattcgacggccccgaccatcgaccatggtgtggcggcatccggatcatgggatgcaggagagggaaccacgcggaccttccatggagagcctggttgaggtcggcgcaagatcgtgccctttcatggccatggagagcacagtggatccgtgtggttgccggtgtcgggtcggggtcggcgtggtggagcgagtagagtggatctggggagatgcgcgcagatggagacgcgcacatacggcgagatttgggcgcggataggagaggagaacgggggcgagagagacggccagacgcgcgcagatggcgggcggggatggcggttggt

SEQ ID NO: 24336 - DNA, 2294 bp, Zea mays
agcaatgtacttattagtctatttaatttcattataagttgaagttaaacttgtttagttttgactaagtttataaaagaacatacaaccacctacgatgtctacgaacccaaccagccttccagtgaattgtccagtgcaattccccattaacaacttttggattgaactggtacatgcaacttaataaatcttccgtccaaaaagtttattcaattaaatccttatcccattgtccagtaaccgggtctgtcagatcattgacaaaagttaacatgtttggtccccttggagtgcacggtcctcgcagcaggcctctaggaaaccattggccatcccccttcttgagaagatccattcccttcagaatgctcctccaagtataagacataccctcacttggcttagcatgtaagatatctgtcgaatgaaaatgtttagcttttagaagtattgcacacgaggaatctggattttgagctaatatccatccctgtttagaaagctaacaccatattaaaagcatagatatctctaaaatccattccatcacaagttcacaactctttagcattttcattttagcccaattcacccaatgcactttgtttcccttgtcctgttgactccaatatctgaatatggcattgctgatttgagcagacaagtcttccttaagtcaaagcatcccatagcgtatgttggaattccttgtgctacggccttaatcagcacttctttaccggcttttgacagcagcttttctttccaaccttgaatacgttgtcacattatcatttaagtactaagaagtttttgtcctggactgcccaaagcgaactggtaagcccagatatctgtcgttgaaagtcccttgtgttaaatttagagcttgcatgaccgccatcttcgtctcacttctcgtatttttagtgaacagaagacttgtctttgttgatgacctgcccagagcatgcttcataaaggtccagaataccttgaaaatgtgttgcatcgtccccgtttgcacgaatcaagatcaaaagtttgggactcggttgctttaactttatcaaaccctaattacctttagtagcttcggccatacagggctacaggcaacaccatacaggacgcttattgaagtgacaaagacttaatcatcacagaaatgatccagcatcttcaaactaaattgtcctggtctactgaagtcaggcggacattcttctcatggagatcatttcatgttgaaatgtccaagtgttgttgagttgttcgctgctacccaatccaaaatagatattgcatgacgatcatgacagctgctaatgctgctaaatcacattttcatctccaaagagatgacaaaaacgtggattagaccggagaccaagtggaattaacaaattggcctagtagattagtcacctttcgtccagaatctggcatagatttatcattcattgcatcatcaatcgtgacatcctcgttgatgtttataacatccctttgagatccctggccagtatttctttcataagcaataatctcttcatatgccttctgtaagatatcttttgctgccttatatactgcctccgatccagctcctttctcagcacatctgatggcatcagcacatagggtattgtagcggcttgtggtggactgagaagcatcctcatcatgagtattgttgttattatcttctaacaaagcatcatcatctcttgccttccttgtccaacgtttcataaaatattcagttggaagtgttcgtggatcaactattatgtatactccaagaatatggcggcacagaataccggagaattcaaagtacttgcaactacagtttgccatcttattggaagcattataagtcacgcagaatgtgtctgatggatcttcatattttgtgatgctgtatttacttatgcagccgtcttcggttttctgaatgataaaccctagagactctgtaaattcctcctgaaccctactgaagactgctttggtataggtccctgctgcctgtttttctattagcgatgcagtttttgtagttgccttatttaagtaggcatccatatctgcttttgcctcatcctcatatcggcctgccaagctcaaatcgaactgattaagaaaaacttcaagcgttgtttttgtattgaaatatttcttatagaaatcattcatggtttccaatttccatgtggggaacgtttctgcaaagaatgtatccatcaggtacaaaggaacccatttttggcggatattgtatatgc

SEQ ID NO: 24337 - DNA, 2328 bp, Zea mays
taaactgtaaattgttacgccgtcgttttttttttgggtaaaagtaacataacatctcattccaagaggattaagatatcagaagtatccagcaatgccacaactcatttctcaaatgaaaagctgaaacaacattaaacatgtggggattgttacacgagctaacaggcattttctgccacatcagtactaaatcatagcacatccctccatgaataaaccacaacagccgactgaaggtctctgtcaatcttgaaatgtgagtggaaaaacctcctcatctcaagaaaggaattgtgcagaagcaactggagaacatgtctttcttctgactcgaataatacaatgtgactgaatgcagataaatttccaaaaacatcgccgacaaactcagatggacttgtaaggaaacgatctgactcatccaaggtccctttgctatcactaggagtgcagtccaaaaaacgcataggtagattgtaatgtaaggttgagtagtaaggtgttgaatgacaaggcatgagaaagagaacactcctcactcttccatcataggcttcttttgacaaataatacataacgtcttctgttcccctttgatggaataaggacatatataaagccatgggaacattggttatgacgagaagaataacagaaagctgcagccttgaaagacttcctttcctatgctgatttttgcccttggactgtgacatggaagctaagcagtaacctgagaacatcaatgctaaaggtagcactggaagaacaaacctgaattctttatgtccaagaatgctgtaaacccctaacacccaagcaattagacctgaaagcctccattcctgagactttacaataccgcacaatgcaaatggtaagaatgtccaaatcatggatggaaaaccctgtgtaaagtaccaatggaagacatgtgttccatagtagtctcctccggaagacaataagttgaatttcaaaaaattaagcggcactatgacccaggaaccatacatccaccaatcaaggagtgttgttactgcaaggacaattgcccctactggaatgacatcaagaaggataaagcaacattttgatttcatctgaataaaatccaaaaggctaacatatagccatgttacagcacttgttggccgaatggcacatgataaggctgctatcagaagagccacttttcttgatgggatactttgttcacaggccgcatgctgctttgaaacgattgaagttgccttggaagactctattgcagcaaaccagtaatagagtccagccacggtcaaaacagtctccaagctgtttgatagagtccgtgtgatacagaaaaacatgaaccagttaaccaactgagaaaataacgtccacttagcaacttgaccattgaaaataagtttggaaagtttatataggtatagatctccaaaagctgcaaacaaagattgcacgagacgtggagccatcaccataacccacggagtgtccatatggagtagcgccagggtcttgtacaaagcagcaaagagcaatgggtggagataactgcgcaggccccgcttccactcccacgtgagatgaccatacccgaaggcgacgcggtgggcgacctcgagacactgccagtgctcatcagggttgaagtacgtgcgcacgagcagcgcgttggccgcgcggaacgccagcgcgaacaccagcaccttccggttcgacgctgtcgccgcccacggccggacccgtcccgacttctcaggagtaggggccgtacccgtactggcgtcgccaggcggcgagccggcagcccgacgccgccgccggcgcctcggcggcccccccgcttaggcttgttcggttggcgaagtatcctctgtaatttatcaaacaggtcttcccagttcccacctccccttcgttgccctgttttttttcaaaaataaaaaataaaaaaactggcgtcccacctctccaactcgttgaagcgcacatcaaggaaatcagccctctgcaaaaaaaatcaccataaaatcactatatccaatgggaaatcagctgtctccgcaaaaaaatcactataaaatcacttcaattttatctctgcaatcgcttcaagaatcatcgttgcttggggcggtctttgtcaggtcagacgcttggaaccccatacacattgatttaaagcatcagagcgggtgtatggtcgtctgcgccagatgcgggtgttggagggatacgacgacaagttttggagggaggcggcagcgggtggaggagggaggcgcggcggctggaggaggtagccggcggcgacga

SEQ ID NO: 24338 - DNA, 4219 bp, Zea mays
  misc_feature (1288)..(1288): n is a, c, g, or t
tctcgaagtcataaggctggaaaaaagattgagactcacgaattggctcacgagcgtcaagttagccaagccgagcctatttttcgagcttgttggggcaacgagctgagccgagtgctcgttctgtctcgtgagctatgccaaattaattatctatatattggataattctatatatagtaggctcgtttattagtttttgatgatgaatatatgataattaataatgtaaattactcgtgatattgaattatgctttttatattttacatttatgtattttaatttaatttataatacaataatatttaacagggtatggctcgcgagccctttcgagtcgactcatttccaactctagtgagacttatctcgtgctcagcgatacagtttaatttaattttttgaaaacctggaagtccagttcaacgattctttatgagtgtaagaagatagacagttaggggggtacgaaagaagcaagtgtcaaacataataaaaaaagagtcaatgttcgaattcataggtcgtgctttcaagcatgcagggtaccatttgcatcggatggacaaatagaatgtgcttacctcttgcctctcaagtctcaattgtttccggtaacattgtatgattatatcaaaaagattactgacaggccgtgtacaggcctgtgcgcccggtgcgcctgaacaaggccccacttttttggggccccaagtatctgacccattagtaatactaattaggtttaatcattagcgtctgctatttagcaatcttggagattctagcggctgctctagcacccacgatcgcacgcgacacgcgtagattgttttgtctgctgctcgtcaggccaggcgatggtgttgctcgatgcgctgctaggtgccagagtgcgagcggccagcgcgctcctacggtccttcactccttctgctgttctgcatcgtccactattgttcattcgtgctctagcggctgcgcagccgtggatcttgctttgtccgtggttcgtcctatcactctgtgtctttctctaaaataaatccatcaaatcataaggtaacattatacatatgcattgtatatttaattgtctaactttgttaataaaataagatattgattattttattcatctcgtatgcatgcatattaaatattaatatttcaagatctaattattggtgttatgtcttatgccaatcgatctagaaaatatgattctggttatcaaaaacgtaagagaaaataaagaatagaggatttaactcagtcttataanggagctatgaatagagaaaacaaagaatttttagtgattttgtaaaaaagggtctctattcaataatctgtacgggcccccgctttttgccggcacggccctgattactgatcattaccaacttcgtgaggtaccctgctgctgcactgtgtgtgtgcgtgcgcgtatccaagctccgggcgcacacatctgctgcagctgcactatcgtgaggcggtgtggtgcatgtgaaaagggccaaagccccagtgcattgcatgcatgcatatctctcttgctgaacaccacggcacgagggtcatgcgtagttattagaatccaaccggacatggaaatgatatttttttattcactggaccggttaaaccttcggttcaattatatcttggaccgattaacttagaccggccacaaatactttgaatcagtgtgtatatatacaatttagttgtactgcatataacataagcttctatcctatcttctatttcaatttcttaagttctactatataaatctgactataaatctgaccatatacacgatctggctatctctagcagtttcttgtatttcaaattcttaagttctactctataaatctgaccgtatacaccatccgatggctatagcttacatcccatctctcgtcttctccctattggatttggatgcctgtggtccatctgtccctacctgcagtacacactgattgagtggccgacgggcaaaatttttattttccggttcggaagacataatactgttgtcaaaccacacatgttaccgtccatcaaagcagacaacttggatctaggattgtaaaattttacagatccgtaatttacggtggttttagacttaaaaccagttccaaacagcccctaaagttgtccatccatcgtcgaggacattctctgccgagtacatagcacccggttttgtttaggtgacccacttagccatccatccaccactacaggtctgcaagtgacacagcgtcagatatgtcagaaggtttttgcatccctcgatgaattgcaaagctgcaaacggcacatcacccagaccacaccgatttctcacagctttaccagccttgctgtcagcgaagaccatggaacatgttaataatataattgttttacccatctgatcgcatacaacaagaggcgtttgcatctcgatgacttgagttgcccctctgcccatctcaacaaacatcaagggccagggcatggtagcaaaagaacaacaaatccacatccccccatgtctctttaggttagctttcacattgcttataaacaaactctatggtgtctaaatcctacaaagaatggatcaagaacaccttttatatatacaacagaacaccgtttgcaactgcacatgatcagcgggggatgcggaagtacgcatctatataacctctgtagttccttcttttgcctggtcaataaagaaaggcctttgcccgcactcttccttttatcaactcccaaaaaatcgagttgtaaaaagcttcccagaaggaccctcagttacaacaggggtcatgactgccaaaatatgtttgggtcattgctatataccgcacggtcttgaatctctaaattagcaacgtgccaatcaacaagccttgcttgaatgcatttcaacagcatgagtccggttgggaagagccaccaaccgctttcatccctggaaagatttcatggcaagtggcttaactgcatataacttttagaagatgctagtgaacagccgacagaaattatgcttacgttcccaggttccagggctgcacgctcgggtgtgttttggttgataacttataatgtacaaaaccacatatgaaagccacaacctagatattaacaagcacaggaaggttatagaggcgcaacacttgatagaaaaaaaaaactcattcaattgcagccattacgtgtgatagataccgatataacattgaaatgtaggtgggtgaagaatacttacaacattgaccagtgaagttatgttccacaatgcatacacacgagcaaggcctgctgaccgcctcggtccatgactaaatagagcatttataccggcaggaaaaggcgacaaaatcccaagcggtagaataaacaaaaccaagagaacatcgaccatagaatatgaatacagctggagaaaagtaagcaaaactaagctgaaatctgcaagaagcagtattgagattaccaaaccaacaagatcctgcagttaagttcaacagaaccaagatcagcattcagcacaaaatgaactgattcataatcactctgtggacagtaacagtggcagagaaagacctgatgcccaactggtttcgaattgtgcaagatatgagaaaatgggtaaaacaaatctctcctgtcttttagtgtccttaagctattactattgagaactccaccagtgatccttttgcgcattagagcatccttaatcctggactgacttagttgagtatcagcgagcatgttctgtgtgctgtgtagtacaataataagccatcataaataataatgatgataaacgaaatcaataacataaaacacataataactcacgtgttctgtgtgctgcgtagtataataataagccatcataaataataatgatgataaacgaaatcaataacataaaacacataataactcacggtgtgtgttgctctatttttactctagggcttccatcaggttcggtaagtgcagcttctccttcaacagcataaacaagaagaccaagttggcagtaccctaatgctgtagcttggaaccaggcaagatcaacacggataccattctcagctaaagagggatttgcatgagattcaagccagttgatgaccggaagaaacgttactttcagatttccaccacggaccaaacgcag

SEQ ID NO: 24339 - DNA, 1806 bp, Zea mays
actttagctcagacattagccatcctgtttggatcattgagcgctaaaatttagcaactggttgttagcccatggatccaaacgagccctcagccgtccattttagcccatggatccaaacgggccctcggccatccatccaccactaccggtccgcaagtgacgcaacatcagatactacagaagggttttgcatcaccccgtgatttgctaagctgcaagggcacatcaccagattttcacaccgatttctcagtctatcagccttgctgttagtgaaaaccctggagcatgttaataatataataacttgttttacccatctgatcacatacaagaggcttttgcgtctccctgacttttagttgccccctctgcccatctcaacaaacatctagggccagggcacggtagcaatagaacaacaaatccacatccccccgatgtctctcttaggttagcttttgacattgtttataaactctatggtgtctaaatcctacaaagaatggatcaagaacaccttttatatatacaacagaacaccggttgcaactgcacattatcagcgggggatgcggaagtatgcgtctatataacctctgtagctgcttctttggtctggtcaataaagaaaggccttgctgcccgcactctttccttttatcaactcacaaaaaatcgagttgtaaaaagctttccagaaggacctcagttacaccaggtgtcatgactgccaaaagatgtttgggtcgttgctatataccgcacggtcttgaatctctaaattagcaacgtgccaatcaacaagccttgcttgaatgcatttcaacaccatgagtccagtgtgggaagagccaccaactgctttcatccctggaaagatttcatgacatgtggcttaaccgcatacaactcttagaagatgctagtgggcaggcgaaggaaattatgcttacgttcccaggttccagggctgcacgcttgggtgtgttttggttgatgacttataatgtacaaaaccacatatgaaagccacaacctagggattaacaagcacagggagaaagttatagaggtgtaacacttgatataacattggaatgtaggtggttgaagaatacttacgacattgaccagtgaagttatgttccacaatgcatatacacgagcaaggcctgctgatcgcctcggtccatgactaaatagagcatttataccagcaggaaaaggcgacaaaatcccaagaggtagaatgaacaaaaccaagagaacatcgaccatagaatacgaatacagctggagaaaagtaagcaaaactaagctgaaatctgcaagaagcagtattgagattaccagaccaacaagatcctgcagttaagaacagaaccaagatcagcacaaaatgaagagattaataattattctgtggacaggaacaatggcagagaaagacctggtgcccaactggtttcgaattgtgcaagataagagaaaatgggtaaaataaatctctcctgtcgtttagcgtccttaagctattactatcgagaactccaccagtgatccttctgcgcattagagcatccttaatcctggactgactgagttgagtctcaacaagcatgttttgtgttctgtgtggtgtaataataagccatcataaataataatgatgaaaaacaagatcaattacaaacataaaaacgcataataactcacggtgtctgttgctctgtttttattctagggctcccatcaggttcagtaagtgcagcatctccttcaacagcataacaagaagac

SEQ ID NO: 24340 - DNA, 1544 bp, Zea mays
ttttttttttttttttttctagtgaaaaccctggagcatgttaataatataataacttgttttacccatctgatcacatacaagaggcttttgcgtctccctgacttttagttgcccccctctgcccatctcaacaaacatcaagggccagggcacggtagcaatagaacaacaaatccacatccctccgatgtctctcttaggttagcttttgacattgtttataaactctatggtgtctaaatcctacaaagaatggatcaagaacaccttttatatatacaacagaacaccggttgcaactgcacattatcagcgggggatgcggaagtatgcgtctatataacctctgtagctgcttctttggtctggtcaataaagaaaggccttgctgcccgcactctttccttttatcaactcacaaaaaatcgagttgtaaaaagctttccagaaggacctcagttacaccaggtgtcatgactgccaaaagatgtttgggtcgttgctatataccgcacggtcttgaatctctaaattagcaacgtgccaatcaacaagccttgcttgaatgcatttcaacaccatgagtccagttgggaagagccaccaactgctttcatccgttcccaggttccagggctgcacgcttgggtgtgttttggttgatgacttataatgtacaaaaccacatatgaaagccacaacgacattgaccagtgaagttatgttccacaatgcatatacacgagcaaggcctgctgaccgcctcggtccatgactaaatagagcatttataccagcaggaaaaggcgacaaaatcccaagaggtagaatgaacaaaaccaagagaacatcgaccatagaatacgaatacagctggagaaaagtaagcaaaactaagctgaaatctgcaagaagcagtattgagattaccagaccaacaagatcctggtgcccaactggtttcgaattgtgcaagataagagaaaatgggtaaaataaatctctcctgtcgtttagcgtccttaagctattactatcgagaactccaccagtgatccttctgcgcattagagcatccttaatcctggactgactgagttgagtctcaacaagcatgttttgtgttggtgtctgttgctctgtttttattctagggctcccatcaggttcagtaagtgcagcatctccttcaacagcataaacaagaagaccaaattggcagtaccctagtgctgtagcttgaaaccaggcaagatcaacgcggataccattctcagctaaagaaggattcgcgtgagtttcaagccagttgatgactggaagacacgttactttcagatttccacagcgaaccaaacgcagctgtgcattcaatccagctacaacacggtgccatatccatgagggaacagcctggcccgtcgcgcggcgaaccccactatcactattaagtaaaaacggagtcatgtaacttccatcgcctccaaagataagagacattggaaccctttgacgaagacgaggtgcaaccgcccgcgtgg

SEQ ID NO: 24341 - DNA, 1318 bp, Zea mays
ttttttttttttttttcttttttttttttttttttttttttttttttaaattctgaaatgaataaaaaaaagaaccagcatcgaatttaagatgttttaaatccaacaggttacctcaattaattgaatcccaatctaaccaggttctaacatggagtctactcacactgatattactggggacgatcagcactacaccaggaaacatcatgctaagcataaccagttttttttgttttcaactaaacagacagctaccacacagctaggggaggattattagaggatttcttcatccttggtatgattcagtagtcagcacgcagggcctcccagttgtcaccttgaccacataacatgggcggatggatttggtaacgagggcggggtcacacaatgtagccactggccaaggttctcgccattgaatccgcccgaaactgcttctggcgtttcctcgacatccatagaagttacttcagtctcatcagcgtccataggtacttcaaaaatccgtgtgcgctctggctcaacggcaacccagtcagatcttatagacacttgtggtggtctccaaggaactaaagccaagctgttcctacgttcaggagattcatcctccacctcgtgatagttcgcaaaagcatggttctttagaccacgtatcaagtctgaactcactatgaatgaagaacttgagatgccacgaccaaatggtgcggaattatctactggtttgtataaaacaagtgccatgtcctcactaggcacatgatgtgttgttagaccttccatcatgaattccatactgggtatgtcaacacagttattgattttctctcccagcatctggaatggcattgaaggagcaggtggttcttcttccataattggtgggagctcggcatccaatctgcggctcttggcagcggggccggagagggagaagtcagagaggccgtccatcacctgctccaactccttcctcttccccgcgaaccccaccattgtctcgcccgaaactagaaggccccgcgaaatcccgccacggattccgcagattcggagagtattacggaaccccccgctccggtcgagggctggctgagccccgccgctccggagtgatgctgcttccgctgtccctgccgcggcccccgacggcggccggtcgggggggtttgcttccgcgcgccgcgggagggatccttgagcgaggagggttttcgcgctttgggtttcgcacgctccgctcgtgtggttgggagttgggttgcttgctcggttagttggttggcttggttcgcgttgtgtggag

SEQ ID NO: 24342 - DNA, 1258 bp, Zea mays
gaataaaaaaaagtaccagcatcgaatttaagatgttttaaatccaacaggtcacctcaattaattgaatgccaatctaaccaggttctaacatggagtttactcacactgatattactggggacgatcagcactacaccaggaaacatcatgctaagcataaccagtttttttgttttcaactaaacagacagctaccacacagctaggggaggattattagaggatttcttcatccttggtatgattcagtagtcagcacgcagggagactcccagttgtcaccttgaccacataacatgggcggatggatttggtaacgacggcggggtcacacaatgtagccactggccaaggttctcgccattgaatccgcccgaaactgcttctggcgtttcctcgacatccatagaagttacttcggtctcatcagcgtccataggtacttcaaaaatacgtgtgcgctctggctcagcggcaacccagtcagatcttatagacacttgtggtggtgtccaaggaactaaagccaagctgttcctacgttcaggagattcatcctccaccacatgatagttcgcttgattgaaagcatggttctttagaccacgtatcaagtctgaactcactatgaatgaagaacttgagatgccacgaccaaatggtgcggaattatctactggtttgtataaaacaagtgccatgtcctcactaggcacatgatgtgttgttagatcttccatcatgaattccatactgggtatgtcaacgccgttattgattttctctcccagcatctggaatggcattgaaggagcaggtggttcttcttccataattggtgggagctcggcgtccaatctgcggctcttggcagcggggccggagagggagaagtcagagaggccgtccatcacctgctccaactccttcctcttccccgcgaaccccaccattgtctcgcccgaaactagaaggccccgcgaaatcccgccacggattccgcagattcggagagtattacggaacccccgcgctccggtcgagggctggctgagccccgccgctccggagtgatgctgcttccgctgtccctgccgcggcccccgacggcggccggtcgggggggtttgcttccgcgcgccgcgggagggatccttgagcgaggagggttttcgcgctttgggtttcgcacgctccgctcgtgtgttgggtggcgggctcccctcctgccgaagttagttggttgcctcgtgcc

SEQ ID NO: 24343 - DNA, 3839 bp, Zea mays
cttgctttttccccttttcagtagttgtgctcgccgcggccacaacagatcttcctcagtcatttttaggagtatgttatcaataacttcaagtgtgtcttctaggttcggatcttctgtggccccggtttcagccctggcagcttcggctgcgccagtttcagcttcgaaggtttccgctctggtggcttcggctgcggcgcctttagcttcggcggtttcggcagtctggtcaatagcaattcttgatgccggtgtcggtgacggtgtcccatgaattacatctgctatttgaataatccttcgttttttcggcagtgcaggaccttcttctgccgaagctgccttgtccttctgaaaaaacttcgtcagttccagcgccagcggacttagcttgacaggcaagggttcagtcattaccttcataatctcttctacttcaacagcagaaggcgttgcaggagtaccttcttctcgaaccaacatttttggttctggagatgcagttttcctctttcttgcagtggccaccttcggctcagggttcaactcttcagggctaagtttttcagaatcttcccttttctttttggctaacttggcgacctcttcgtcagcagcgctggcaattctttttctcttcgggccttcggcatctccgcctagttgctcataatcaggatactcaaaattcaaggcatctagcacccgattcaatcttcgtttggggcgactgccgaaggctgctgtcatcaactgatcttccttcttagaataatttccgaggatatcgttgcacataatctcgattgtgtctaaccattcctggcggggttctttaaagtgtttcttaaacttgtagtaataaggtaatcgaacaagttctccctttttcttttccccctccagcttcggcatctctcaatccctcattgttgggaacactttaaaagccagaaattcctgcaccaagtccctagtgccaatgtgatctgaaatcacgcgaaattcagccatagcaatttggctcgggctcccccttatcatgttgcatcggggccttgtttctccgaaggttagctctagtggattctggaccaatttatcttcatctttatcaactttaacataaaaccactcagatttccatccggctggccatttgcttcggtaacttatcactggaaacttagtagtcttgcgataagcaaagttgtaacatccaaaattctcatgaagaccatctcttctggctttagtctgatagtgtagttcatggactcagcagaaaccttcgtcgaacggttccactccttgactacaaagggcccaaatataaacacttaatctgacaatgacattaggggtcaactgatgaaggtaaaccccaaatttcttcaaaacatcagcaatcatcccattcaaaggaaatcttaatcctgctttaaaaaagcttttgaacactactacctcattcttttccggcttcggagtagtttcctctccgccaaaacgaaccagctccttttttgcttcgctgaagtagcccagcttcaccattttttgaaggtcagcttcagagatggtggacttcccaaagtccaaatgactaggtttagttggtaccccgcagctgaactcatcctcagaaccaacttcttcaacatcagcttgggttgcttcggcagcaggtgtgccctctgctgtagctagcccggagcgcctcatcgcttcagaaatcggaacagtttcagcagcttcggcctcatctctatcacgctcaactctagcagtagagcgcactctggccatttgattttgaatttcttaaaaattccttggaaattaataaccttttttccgaagctctttttctaacgaagcagagactaaactggagcttcgtttgaatgcgaaagtcaagcttcggctatggttaaatttttggcagcaaaacagtgcaatagcaatgaatgttgtggtaacttcacacctacctgtctgtttatatagtgctgcaggtaagaaggtgaatcgtcaggatttttacaccgggaaaacagtcgctcgcacccactgcacggtgggccgcaaaaaccaaaaagtgaacctgcatggtgggaccgttccgcgctcggaaactgtatcatttctcgacaacgagctcaaggaaggtgttttttagactgcctgtttcaattgtcaataagatcagtacatggcagagaaagtcaaaccaattttgaatttcagactcatgcttactaggtctctgtagaaaggtatctgttcagggagcaatgcaaggttagcgtctacccttttactagcatattgctccccatatctcctggtatctagcagaccagctccataatcaggagcaccagacagaaaagcaaatactcgagctgctctccatatgacaaggaacaaaagtaaattagcataaagatactggttactagattgtttgcaaagtgtaaacatacatcatcttatgagttattaagctaattgcctgattgacaccagatatttcatgagatatggaaagtgtgtccactcacccaaagcaaaagtagaaccatatcctgaacttaggtactcaattaaagcagacatggctgtcccaaaaccacgtccgccaagcaaaacagcatcctcttcatgcccagaagcagcccctctctcccatgaagatgtaggtcgcagtgtctccagggcagcagcaattcgatccttgcatgtgtcaacctgccaataaattatcttaccgttagcaataagtccatgtctaaatctctttgtaattctgcagtgggccgtggttcaggaagctctcgctcgccttccgatctgcctcaagggtcgcctccgggtcaccgtcgtccctcatctccagattggctgcatcaataagaagtttaatttagcttcttgtccagtttttttttactgcagctttaacgatgaatcatcaatggatcccaaattaatattttcagttttttgtcaggcaatgtgcttccagcgaatttcgtcagaacatgtgttggatttgcaatacttacattggctacattttgtgttgttcttgttgtaaagggttactctgcatgtgacataactactgaatacgatgaggatttatctttgaacttccccgtccgattcattgacctctcggaaccaaccaggaaatccagtttttaggcagaaactgtgttaatttaaatgctgttactgagattaagtactaaggccgaagcgatcacatcatgctatttgttggcatgccaactaggatcttgagtacagattgtcagcgagatggtcgcagggccagattgcagcgtattgctgctgcctgcgctgggacgtctcgtagctctccagctgcagcgttctctggttcacgaagctctcgcccgccttcaagtcggcttcaagcgtcgcctccgggtcactgtccctcatctcaagattggcgtcgagacggtcgtgaggccagacgaagtagccccagtcccacctctcgaagtcataccggggccgccggagcttcaccagcggctcccgcacggcggcggcaaacccgaacccggggcccctgggaatggggaccccccggtccgtctcgatctccgttctcaaccagaagccgccgctgcggtgctgtcgcccagttgtccacccctctgtgtccgccaccgtctccatggccgtcgccgtcgttcctccccctctctgtctcgcccaccgactccactcgcgctgtggcgttcgttctgttgtgcgcgctggcttcttgcgtgtgtgggtctgggaatcggatc

SEQ ID NO: 24344 - DNA, 1556 bp, Zea mays
  misc_feature (76)..(81): n is a, c, g, or t
  misc_feature (1538)..(1538): n is a, c, g, or t
  misc_feature (1552)..(1552): n is a, c, g, or t
ctttaggtttcgaacggcttcaatttaatcggaataaacagcagcattaatatacaccaaaatttgagttctccgnnnnnnttcagacagccgccgcctctcggtgttttgttggggtactcgtccctttaccactgtgccagaaaggcttctctgattaatcaagcctaaagcagttattgccagaagcaactacaaatcatgtggcccctcttattattttgacattgtttctccattttggctatctaagttaactaatatgatattaattagggttaaaagcatccgagttgatacgctctgcagcgggaccaaaagggtcttctagctgaaactagcttccaatttcttcctgtatgatctctcctgcaacattcctcacgctctcacggaaggctacaaaacctgaaccagttgtaaaacctgatccatcgacatcttgctcttcaatgagatagctctcaaacaatgttgaatcatcttcccctccatggatgaatgtaagctttggggttatacatctgtcctgcttcagtttattgattgttgttctcaaaagacagtcacggggtggaggaaaaggaaatgaaggatcagcagttgaggaatagtaaacaataaggttggtaaatgtgtcaagaagaaatattgggctctcgctcatgattagagcagcacggctgagagtgtgtcgtgggaatgcttgcttgtcaggcgaggaatacgatattaaaaccggatatatagctttagctagagaagatggctccagtgcactgaaaaggcattgtagatatatcctgtaatctgggtgtacaccttcttcatgcaagcgaagaagaggacttctcaacaatgcaaaaacaagttgaggtatcgtttgaagctgcgggcactgcgagaagtcaatgtctatgctcgatagtggagttcgcacatcagaactcaggacctgattataccgggctgcaaggagggatagccaagcatgaacttgatgcctgccttctctaacccccttatccacgcattctaaaataaccttatgaacaaggatatgcagtacaacctctggatctacactgtcataaatttcactgatattcctagctggacggtactgcaatgttcttactctcagccgcctctttagagagaacttataacttgcagatgattgtgatccatcgcctgatgtctccttggcaggttcaatcacgctgtactgaaaagcgatctgcacaacagcaggatctgtatgcctggagaagccgttgttatgggaaaacccaaagtcatatgcataagtggcaaatgaatcacagcagatgatgtgttgcacactttcatattgagggtcagggaagaaatgtccataagaattgcctggttcaaaatctgaagatgttctcagccttagaacacaaccaaatgcgtagggtcgacttagtaagcggtatatgtcttgaggaagtgttgaatcatctgcatttgcataaagaaatagatatccaccacttcaaacttaaaaattncagtgaagccaatncaga

SEQ ID NO: 24345 - DNA, 1345 bp, Zea mays
gtttttcttcatcatctttcaccaaattagcagttcttatttcaggacgctagcaactctcttctttcttctgtccttcggcacttcggttccagtcgctcataaccaggatactcaaaattcagagcatccatcacccggtttaaccttcgcttcggacgagtgccgaaggctgcagtcattagttgatcttcttttttagaataattgtcaagaatatcgttgcatatgacttcaattgtgtctaaccattcttggcaaggcactttgaaatgtttcttgaatttataatagtagggcaaccgaacaagttccccctttttcttttctcccttgagcttcggcatgtcccactctttcaaagttgggaacactctaaaagccaagaattcttgcaccagatccctagtgccaatatgctccgcaataactcgaaattcgcccagtgcaatttggcttggactcttcggtgtcatgttgcactggggcctggtttctccgaagattaattccagtggactttggaccagcttctccttctcttcatcaactttgacgtaaaaccattcagtcttccagccagctggccacttggtacgatagctgataactggaaacttcgtatttttgcgataggcaaaattgtagcagccgaagttttcatgcagcccatcttctctagcttttgtttgataatgaagctcatgtactcggcagaagccttcggcaaatggttctaccccctggcttcggagggcccagatgtagacactaagcctaacgatggcgttaggagttagttgatgaagataaatcccaaacttcttcaaaacatcagcaatcatcccattcaaaggaaatcttaatcctgctttaaagaagcttttgaacactaccacctcatccttttccggcttcggagtaatttcctctccgccaaaacgaaccagctcctttttttgcttcactgaaatagcccaacttcatcagcttagacatatcaccttcggtaatggtggatttcccaaactccaggtggctgcgtttagatggcacggcgctgtaatcatcttcagattcaatttcctcagcatcaacctgctcagcttcagcggcaggtgcatcctccgatactaccagccctgaccgttgcatcacttcagagattggagcggtttcggcaccttcggcttcctctccatcgcgagtaaccctagctattgagcgtactctagccatctgacagttgaatttcttgatttttgacaaagttgaaaatttttaatttttccaaagctctttcttgttacgaagcttgagcaaaatgaatagcttcagggggatc

SEQ ID NO: 24346 - DNA, 2655 bp, Zea mays
ccttaccctccaatatcaaaaccgagcattaagggtttgttttctctcaaatttcagtctgccaggttccgacggtgtattattgtgtagtaaaactcgtctgttttagcatagagacagacagtgccgctgtaccagaaaggctgctctgcctagtcaagcctaaagcagttgttgacagaagcaactatacatcaagtggcctccttttattattcattgaattgtctctccattttggctatctacgtttcagttaactgctacggcattaattaaggctaaaacatcctagtcgataccctctgcagcagaaccaaaaaggtaatcgagctggaactaacttccaatttcttcctgtatgatctctcctgcaacgttcctcacgctctcacggaaggctacaaaacctgaaccagttgttaagcccgatccatcaacatcttgctcttcaatgagatagctctcaaacaatgttgaatcatctttccctccatggatgaatgtaagcttgggggttatacatctgtcctgcttcagtccatttattgtttttctcaaaaggcagtcatggggtggaggaaaaggaactgaaggatcagcagttgaggaatagtaaacaataaggttggtaaatgtgtcgagaagaaatattgggctctcgctcatgattagagcagcatggctcagagtgtgccgtgggaatgcttgcttgtcaggcgaggaatacgagattaaaaccggatatatggctttagctacagatgatggctccagtgcactgaaaaggcattgtagatatatcctgtaatctgggtgcacgccttcctcatgcaagcgaagaagaggacttctcaacaatgcaaaaacaagctgaggtatcgtttgaagctgtgggcactgtgagaagtcaatgtctatgctcgacagcggtcgcacatcagaactcagggcctgattataccgggctgcaaggagggatagccaagcatgcacttgatgcctgccttctctaacccctttatccaaggattctaaaataaccttatgaacaaggatatgcaggacaacctctggatctacactgtcataaatttcgctgatattattagttggacggtactgcaatgttcttattctcaaccgtctcttcagacagaacttgtaacttgcagatggttgtgatccattgcctgatgtttccttgacaggttcaatcacgctgtactgaaaagcaatctgtacaacagcaggatctgtgtgcctggagaaaccgtcgttatgggcaaactcaaagtcatatgcataagtggcaaatgaatcacagcagatgatgtgttgcacattttcatattgagggtcagggaagaaatgcccataagaattgcccggctcaaaatctgaagatgttctcagccttagaacacaaccaaatgcatagggtcgacttagcaatcggtatatgtcttggggaactgttgaatcatctgtacttgcataaagaaataaagatccaccactttcgatacttaaaaacttcagtgaagccaaatcagtgtattcatcagttacagcaaatatgtctatgcatactcctgactgaacagcaacagctgctaggtctctgtagaaaggtatctgttcagggagcaatgcaagatcagcatctacccctttactagcatattgctccccatacctcctggtatctagcacaccagctccataatcaggagcaccagacagaaaagcaaatacccgagctaaagcaaaagtagaaccatattctgaacttaggtacccaattaaagcagacatggctgtcccaaaaccacgtccgccaagcaaaacagtatcctcttcctgcccagaagcaacccctctctcccatgaagatgtaggtcgcagtgtctccaggacagcagcaatttgatccttgcatgtgacaactggagccaaaaaacaaagtaggggcatggcatctccaagggcaacaggccccacatcttcttctaagtccggaggaataaaaacattcttcacgagtggaatcgggccttggacatcatacaacccaatcttgtggctgaatgtcataagcccaaatagggagcccggaacaagagcttctagggccgcaagaagcgcactcttgacgagttccaggaactcttcagaacatgcgagatccactgcggccacatagacaggcagcgcctgcacaccgtctcctccgccctctgcctcatccactaggatttcgaggtctacgaaagaggacttgagctcggggcacacgtcgggacgctggaaccgtcgctcggcctcgtcgtcgaatccgttgagcgtgccacagagcgcgcaggtccagccccagcgctccagatcgcagtggctgctcaagtacgcccagcagtgctcgcagcgtgggacgcggtccccgccggcgccggtggtcgggggttggccgtgctcgtccgcggcggcgaagggcgtcacggcgacgccccactggacggcgcacgactccagcgcctccggcgtggccgggaagcgggagaccgtggctcgcaccgccatggccgaagcagtggggaccagcggaggcgctggagctgtcgggattcaggagtcgcggctgcagccgtcttcagt

SEQ ID NO: 24347 - DNA, 1293 bp, Zea mays
ttttttttttttttttctttttttttttgatgggaaagcgcatgacatatagtttctagtcaatccaagtaaaatagatctgaagatatcgatgcccgtgttttagaagtatgacggcatgggttctaggatgttaccggttcaatttgctccaggccgctttgattaagcaggcattaaaaaaaataccaaatggaagctctgaattatatatattcaaggtctccacaagctgcatcgtccaatacactcctgtcgaggcctgagcttgcttcttcttccaattcattatcaagatgtatactttctacctctccgagttcatcattgtcagggtctcctcttgccgcctcttcacttttactatcagggtaaactctaattctgatgcgcttgcctttgatgtatcgatattcccatttcggtggtgggtatttcttttttaacttttcgtatttgtccatcatctctatcttttgaaatacatcacctagcatcctgataatagaaccatctggtcttacgcctagttcctccatatcagcaaaaatctcgaacatcttatcatgctctccagcactgtaatagaaagaaataattctcatgaaaaatgtacgaggcaaaccctccatatatcgtgagaataccattccaaataactcttctgcttcctcaatccgtccgtcctcgatcaaagcattcaacaaggtgtaatagctccccattgtcttcccctgacctttgttgaacatccatttaatgacctggattattcgtttccattccttttcgtcctcaagtttcttcagtgccttctttactactatcaagggaaactccagttcccatgcaacaaaagagtcaagtgctccataaacttcctcctttacattagacagacctttaatacattcaacaagcttctgtgacttggaaatagtcccaattttcttacgagttttccatacacggggatatctcggtcttggacccctggcaccacaaaccactacacaattaaactttatatgatgtcgaacaggcccctcctttactgaagcaaatgcaggcgaccagtagttcctcaagcaaaacattcttaatagagtatcacaagagcaagcctgttgtgtcctgtatttgtaggactggaggagaaaacaggaaaggatgggccgccgccgagtggagtaaccgactgccggcacggtcgctgcttctggccggagtcgggaaggggagcgaccgcaaccgcacagcgaaagcttgcaatcccccaaggatttatctttc

SEQ ID NO: 24348 - DNA, 1461 bp, Zea mays
ttttttttttttttttggtgaaaccaccatgatgtcttgaaaagactgctgatggcaaagcctggcatgtagtttctactcattctaggtagtaaaaatacttcagaagatagcgatgcccatgtcttggcagtatgacgacacgggttctaggatgtcaaatcaaaacagagagtatgttaccagttcaatttgctctagaccgctttggttaagcaggcacaaaaaagtaccaaatggaagctctgatctacatatattcaaggtctccagaagctgcatcgtccaatacactcctgtcgaggcctgagcttgctgcttcatccaattcgttattaaggtgtgtgctttctaactcttcgagctcatcagtgtcgggatctccttttgccgccacttcaggattactgtcaggataaactctgattcttatgcgcttgcctttgatgtgtcgatattcccatttcggtggtcggtatttcttttttaacttttcatatttgtccatcatctctaacttctgaaatacatcacctagcatcctgataatagaaccatcaggtcttacgcctagttcctccatatcagcaaaaatctcaaacatattatcatacgcttccacgttgtaatagaaagaaatcattctcatgaaaaatgtacgaggcaaaccctccatatatcgtgagaacaccattccaaataactcttctgcttcctcaatccgtccatcctcgatcaaagcattcaacaaggtgtaatagcttcccattgtcttcccttgacctttgttgaacatccatttaatgacctgaattattcgtttccattccttttcgtcctcaagtttcttcagtgccttctttaccactatcaagggaaactccagttcccatgcaacaaatgagtcaagtgccccataaacttcctcctttacattagacagacctttaatacattcgacaagcttctgcgacttggaaatagtcccaattttcttacgagttttccacacacggggatatctcggtctcggacccctggcaccacaaaccactatagaattgaactttatatgatgtcgaacaggcccttccctcactggagctagtgaaggcgaccagtagcccctcaagcaaaacattctataatatgtagttagcagacaagagcgtcgccttcacgagaccaagaaaaccctcatcttcacgccgtaccttaatagagtatatcacaagagcaggcgtgctgtgcccggtatcagtaggactggatcagaaaacgggaaaggatgggctaccgccgccgccgccgccgcgtggagtaatcgactgccggcaccgtcgctgctgctggccggagtcgggaggggagcgaccgcaaccgcacagcggcaacttgcaattgcaatcccccaaccccaatgatttatctttgttttatttatttttttgtttctttcag

SEQ ID NO: 24349 - DNA, 440 bp, Zea mays
tcctcctttacattagacagacctttaatacattcaacaggcttctgtgacttggaaatagtcccaattttcttacgagttttccatacacggggatatctcggtcttggacccctggcaccacaaaccactacacaattaaactttatatgatgtcgaacaggcccctcctttactgaagcaaatgcaggcgaccagtagttcctcaagcaaaacattctttaatctatattagcgaaaaacttaatagagtatcacaagagcaagcctgttgtgtcctgtatttgtaggactggaggagaaaacaggaaaggatgggccgccgccgagtggagtaaccgactgccggcacggtcgctgcttctggccggagtcgggaaggggagcgaccgcaaccgcacagcgaaagcttgcaatcccccaaggatttatctttcaat

SEQ ID NO: 24350 - DNA, 1436 bp, Zea mays
  misc_feature (664)..(664): n is a, c, g, or t
cctccccccccccctctttcttttttcttttagtttctactcattctaggtagtaaaatacttcagaagtagcgatgtccctgtcttgggagtatgacgacgacatgggttctaggatgtcaaaccaaaacagagagtatgttaccagttcaatttgctctaaaccgctttggttaagcaggcacaaaatagtaccaaatggaagctctgttctacatatattcaaggtctccagaagctgcatcgtccaatacactcctgtcgaggcctgagcttgctgcttcatccaattcgttattaaggtgtgtgctttctaactcttcgagctcaccagtgtcaggatctccttttgccgccacttcaggattactgtcaggataaactctgattcttacgcgcttgcctttgatgtgtcgatattcccatttcggtggtcggtatttcttttttaacttttcatatttgtccatcatctctaccttctgaaatacatcacctagcatcctgataatagaaccatcaggtcttacgcctagttcctccatatcagcaaaatatctcaaacatcttatcatacgcttcccacgctgtaatagaaagaaatcattctcatgaaaaatgtacgaggcaaaccctccatatatcgtgagaacaccattccaanataactcttctgcttcctcaatccgtccatcctcgatcaaagcattcaataaggtgtaatagcttcccattgtcttcccttgacctttgttgaacatccatttaatgacctgaattattcgtttccattccttttcgtcctcaagtttcttcagtgccttctttactactatcaagggaaactccagttcccatgcaacaaatgagtcaagtgccccataaacttcctcctttacattagacagacctttaatacattcgacaagcttctgcgacttggaaatagtcccaattttcttacgagttttccacacacggggatatctcggtctcggtcccctggcaccacaaaccactacagaattgaactttatatgatgtcggacaggcccttccctcactggagctagtgaaggcgaccagtagcccctcaagcaaaacattctataatatgtagttagcagacaagagcgtcgccttcacgagaccaagaaaaccctcatcttcacgccgtacctttaatagagtatcacaagagcaggcgtgttgtgcccggtatcagtaggactggatcagaaaacgggaaagaatgggcctccgccgcgtggagtaatcgactgccggcaccgtcgctgctgctggccggagtcaggaggggagcgaccgcaaccgcacagcggcaacttgcaattgctatcccccaaccccaatgatttatctttgtttttttttgtttctttcagggaaatctacctgttcggggttgggctttt

SEQ ID NO: 24351 - DNA, 867 bp, Zea mays
tgctgccattgattgctattcccagtttattgaagttggtacaatggtttccccaaccatttatgctcgacgttgcctgtcatatctgatgaatggcatgccacaggaggcattgaatgatgcaatgaatgctttggtaatatctcccacatggtcaacagcattctatcttcaggcagcagcactattatcacaaggcatggagaatgaagcacaagaagcactcaaggatggttgtaacttagagcaaagtagcagtggtggacattgattgtgaacatatttgtagtccccaaaatgcacataatgtcaggtgcttgtttgaagagagagtaatattggctttggctatggaagcagcaggcgttggtaatttgtcaatttggctaggggtttgttaaccttattcagattttgtgcttgtggaacgtcgtccctcgtccatatcttcatgtaggaatgtacatatggaagaaagcgacaacagaggctctgaaagagaggacaaagacatccaagaggtgaataaggaaattattaatggggagaagaaagtgaaacttttttcttggtcctactgaaacaagagaaggaaaacataagaagaagaaaaaaaaaaagattgctgatgtacatgtctgtctttgctggtggcaggtgacctgtacagcaagcggttgtttttaccctgtcttaattcttcgtttcttatgcgttagctcccattggtatatttctggataagatagtggaattcttttaaaaggacaaaaatgtcagcgttctggttgttcaagagttcaacaacgctttcaccccttgctccagataatttttttaatggaataaattcatatgctagttaac

SEQ ID NO: 24352 - DNA, 945 bp, Zea mays
  misc_feature (504)..(504): n is a, c, g, or t
gagatgatgaccatattatattatattgacgagatttgagcacagcagcaatagcggaagtttatcaagtagtagtaatgcgcgcgttttttttttcgcgttcgatgctcatctttttgtacatccattttcatcatctctgataaaggagaaagagaggagaggcggagaagaattaagaagacagaagatacaagcaaaacgaagaagctgacacgagacgcctagctacacggccgagcgaccaccagcgaagaggcaggagcaagggacacggaaggagcttcgaccgtcagcgctcgccggaacgaaaacggagtgccgggcggggctcacgtcacggatctaccacctacctctctctggcctccgcctaccgattggagtccgggttggggccgctagggacctcgtgcttgccgtcccggagcccctgccccgcggagttccacctcccgcgcggccggggccgccacgccgccgccgcgtacgcgcttgggcggngcgcgggaggtcgcggcggccccacggcgaagacgcggcggggagctcctccgtctcgtcgctgtcgtccccgtgctgccgagccgccggcgcgagcagcacgagcacggcgcagaggaaggcgcacagcaggagtagggcgaggaggagcggcggcggcgcggcggcgcgcggcccagctgtggcggcgcattgagctcctgccatgagcagggggggaggagccgcgggcgggcgtcttcagtggctggagcaagagccgcggccaacgcccatggagcgagcgagactgcgggagagagcagggcagccaagcaagccagctagagctgtgtgggtgttgggtatccgttccgtgggaggtgaggtgaggttaagtgaccttgtttcacttgacgccgctccactccactccactcgacacacacacagtgactgact

SEQ ID NO: 24353 - DNA, 2429 bp, Zea mays
  misc_feature (12)..(12): n is a, c, g, or t
ggggtacccccnggtcctccggcgtcgctctctccccgttctggttttcgtctaatctagattggatgggatgatgattcgaggcgttagcttattttagctgtaatcccagactaaaccctggctcgttggttcggcggcctcccggtgagaatcgcatctccaatcaggatggagacgaagaaagtgaagtctgtccctggtcataatcacgcggggagtggatgataagatcataaaaatcagacaatcatcggtcacaactcatactgttgtgtctttttttcccctgagccaccgaggccaggagtgattgattggtttaagctcagcgcacccagagtctgtgacattcatgggtagtgcctgttcgaggaagaggggccagctggtccaagaggatgatctctacagtgcgaggttctccaagagcggcagcttcaagtggctgctgcatacgctgccccgcagcaactttgctgatgtgcagcggagagcacagggcccagctccaaaccggtgcccgtcgcttgtggagctgtgcgtggccaaagtctgcaaggacataaatatgtattctgatttatccctgctgcccagagatcttagtcagcagatattcaatgagctggtggaatgtggatgcctcacggaggcatcgcttggggctttccgtgattgcgatttgcaggatatttgtctgggagactaccctggagttactgatgcttggatggaagtagtggcttctcaagggcagtccttgctatctgttgacctctcttgctcggatgtcactgatagtggattcaatcttcttaaagattgctcaagcatgcaaagtttggcatgtgattattgtgatcaaatctcagaacatggacttaagacattatcaggcttttcaaacttgacatcactgagcattaagaaatgtgctgctgttactgctgaaggagcaaaagcctttgcaaacttagttaatttggtaaacttagacctcgagcgttgtccaaagattaatggtgggcttatacatttaaaaggcttgaaaaaactggaaaaactgaatctgagatactgtaatggcatcacagattcagacatgaaatatttgtcagatctcacgaatttgagagagctacagctctcttcctgcaaaatatctgcttttggtgtttcttatctgagaggtttgcacaagctaggtcatctaaacctggagggctgtgcagttactgcagtttgtttggaggttatatctgagcttgcttcgttggtcttgttgaatctgagtcggtgtggcatatgcgatgaaggctgtgagaacttgaaaggtcttacaaaattgaaggctctaagtttagggttcaaccaaattacagatgcatgtttaattcatttaaaagatttggtcaacttggagtgcttgaacttggactcatgtaagattggtgatgagggtctatttcacctaaaaggcctcatacagctaaaaaacctggagctttcagacactgaagttggaagcaatggacttcgtcatctttctggtctgcgtaatttgcagagcatcaatctctctttcacattggttactgacattggtttgaagaagatctctggcttgagttcactgaagtctcttaatcttgacaatcgccaaatcacagatactggtttagcgtctcttacaggtctcactggattgacacacctcgacctatttggagctcgcataactgattctggcatgagctgcttcagatttttcaagaatattcagtccctggaggtctgcggtgggttgattacggatgctggcgtgaagaacatcaaggacctgaaagctctgacgttgctcaacctatctcaaaacggcaagctcacggacaaaaccctggagctgatctccggcctgactgcgctggtgtcgttgaacgtgtccaactcccgggtctccaactcgggcctccaccacctgaaaccgctgcagaacctgcgctccctatccctggagtcctgcagggtgacggcaagcgagatggataagctccggctggtcgccctccccaaccttatcagtgtgcggccggagtgatacgaccgccagcgctcccacagcgacctgtaactgtggagcaagtggcgcctggctagagcaggccgccttgtacatacttttgcaaaaacgaggtgtctgtacatattgttcgtcgtgtcgtgtcgtgtcagtgtgcctgatggcaacgggctaatacgtccgtgccaacgtgtgcatggtatcccacggaccctgtggtagtaaggagcagttgtaaatatgccgtgcttcctctccatgtggggtgctgctgtataaatagattggtgcattgctaaatacctctgcttggtgacatcgtggtatcggtgctaggttccctggt

SEQ ID NO: 24354 - DNA, 1204 bp, Zea mays
tttttttttttttttttaatgggatgtgaccgctttcctttagtattcagaagattcaattacaattcgttgcctgttgtccagctctcctctcccactgtctcggcttatatatatatgtgccaaatcagtcgctcggtacagccgttgcctgtttgtgcgaatttgataatgcaagtcaatgagcttgagcaggactttatgctacaaacgtaaggtcaccctctgctcagtaagatggagtacaatcacgatttgacggtgctgcaagtatggccgccattcgtcaataattgccataaagattgccaaacactcctcgatgaagcttggtttcttggacaaaggtgcttattcaaataagccacgagattcttcgattgcatgaagacagctgtttctagcacgaaacccttgctgaagtcgttaggaagacctagaacaggagcttggaccaacttctgtttgagcaaatgaaatgtccgatcagcaaccgggggcaattgaattgggtgcccttcttcagtaactccattaatcatgccgtagtgcatgattaaaccaaattgcggatgcgatgataaattctgattcaaacatttcgtcaagcacaaggtgtgtgatgcactagagttcctttcttctccacctcccaactcacacaaaaacatacgtataaacaacagtaaggatttgatgccggtagggaaatgagtaggacaagaacgacatggcctcaccagaacagcaataaggcgacgacgcaagatgagagtgccgtgacggcccaagacacgacaagtcaggggatggggcgagctgcaggagcaagggagcggtctgcaggcacgaccgaagttgaaaccgagcagaggatgggcgagctcggaccttcctggtggccggtgagcagggagggagcgttggcgagctggagtactgggctccgagtgcaggagcagagagggaggcgctggggagggaggagatggaggagaggcggccatggtttggaagccgagggagcagggatgaccggcgaggggaaggcgcagcgagccgcctgcgttggagagctcgcggtcgacggcgaccagcagctagggccggcgaggtgagggctggagggagcggctgagatgggcttggtgaggagcggcttggggagagagagacgtgtttttcccggccgccctctgatgta

SEQ ID NO: 24355 - DNA, 5878 bp, Zea mays
ttcccatcatgcatgtgcatgcatttagagctgtggcgatgttgttatgtactaggtaatcaacacgaggctagctccgattccatcccgtttggaacacatgcatgaaataatttctggctatcgaggagaattgaactgttcttatgaaactttcattaattatgtgtaggagtactatataaggtgctgctacatagaccccccggcccctaggaagagtgggctagcttgagtttgattgaaccctgcaagctttgagattcaccttttcttctgtttgggcatatgcctatatggaagaaaaagtgaatctcaaagtttcacagttcaacattttagatgatgctatatatagttcatatgattatatggctttgttttttgtgtatatattaaatacaatatgtttaaacaagagtgtgtagaaaaaggatgtccttggcaaaaaaatgttttttatcagtgacatactgcgaaaactacacagctatatttaattgttctatccttaatgaacacatatttaggattaatgatgttttaccagagagaacgacagtgcactgactgttaggaaatagattaacgtaactgtccctgcccatgcatgccgtacttctccagcaaccattacatcttgttccctagtcattgggtggagccggcctaaaatgcatagataacacttttaagtactccatagaaaacaagtcccgccgtagcaatgactcagcgtccaaatacaacacgtgcatgaaaaatggaaagtaggtccatggtgctttcatgcatgcaaaatgcctagagagccacagcgcaacgcatgcagctggtcaagaattccaaagctatgggggtaggcgagtagcacggcaccgggacgtgctgctgctaaatcataaaaggggtgtccctgtcgttgtagacctcgttcctagcacgcttctactcctgcatgcatgccaggtgccaaattggctgtgctgggactgcccgttgctgcagtaaaaaaccggcacatacacgtggtcgaaggacaagattactgttagttactgacatgcacgtacgtacaacagtatagctagtagctagcggctcatgtactgtattgatgtgtatacatcatgtgcgtgtatatatgctatatacagggaggtgtccgaggagtacggacgcgaggtggtgcggctgtgcgagctgctgatgcgggtgatgtcagtgagcctagggctggacgaggcgcaccttcagcgggcgttcggcggggcgggctgctgcggcgccaccctgcgcgccaactactacccgcggtgcccgcagccggacctgacgctgggcctctccgcgcactcggacccgggcgtcctcaccgccctcctcgccgacgagcacgtccccggcctgcaggtccgccgtagcgccggcgactgggtcgacgtgcgccccgtccgcgacgccttcatcgtcaacgtcggcgaccaagtccaggtaatatagcaaccaacatcgttccagctaattaagctaggtatacatcttgtgcatgttggctgtatcgtccctactctctactatagctagcgtgcccgatcgcgcgtcgtccacagctcgtctagatgcgtggcttcctggagctacgtactagtcgatgtcgacgacagatctctgtcacgtattgtacaaacgtgaagtatttggtcttgtggttggtcggcactcctacacgcgtacagctagttagtgcgctgccgctcgccttgcatcggttggaatttaaaagaatcgatagctagctgcatctctggatagataactcgtgaatgattagttttattaaaaacactttaaggacaaaaggatccgatcgatggatcttatctgtgtatactatacgtcaggaacagtcttaattcagctctgcttataaaaaaaacctgtattaattcagcaggtagttgactctgaaacaaactaatcgtcggtgtacgtgcatgctggaatcaatactagatagatgctactagctagtactactcctatatcagtactagctagtagtttgcatgagaacacatgcatgggcggtgagccggtgacgatcatcgatcgagcgcaatcttaagatttatcgtgcacaagcagcaaccgaggacagagttgcatgcatgttaccgtactgtacggtgacaactgacgaatcgcgcgcaccacgcgcgaaagcacatgcacaggtgcacaagccaatcatctgcatatcccacgtatatgttgcatgcaccggcggccagccagctggcagccgctaacaatatttgcacctgtgtagttgtaggctctgtgtagactgtagtacaactgtacaagttagctaatcccctgctccacatgcatgaacagaattactgttaggccccgtttatttcgttggaattgaatttcattttaataattataatttagacaaaactaattaagtttatatatttatatatctaatatatttgtatattatcttaaatcatatgagagagatagttatatactacattaatgttatagcaaagcaagtagaaaagtgtcttataagttgtacatcgaaaaaatagcatgtaaatctatagaatcaattttcatctctcaccatatgaatttgagatagacttatatgataactttagaaagtggtgaaatgtcacattctaaaaaatagcatatttcattagtaagattttaattcctcaaaatgaaagaaaacaaacggggccttaccgtaattaataaacttcaactagaagtaacagaccaacgaccgtaccgctgtatatctaatggtgtaagtatatatgtgtcaatgtatgcatgcatgctactgtttacgtacgtaactccacctttccttttgaatacgaatgctagatgcatgtaactgtccgttcatgcatgcatcgaaaaaacctcgctcatatatagctataattaatactgacactgagaatgttgaattatttattcactcatgcatgcatggacagataatgagcaactccgtgtacaagagcgtggagcaccgggtggtcgtgaacgccgaggaggagcgcatatccctcgccatcttctacaaccccaagggcgacgtccccatctccccggcgccggagctggtcacggccgcgaagctgccaccgctctacccgacgatgaccttcgacgagtacaggctctacgtgaggagtaagggcgccaggggcaaggcgcagatcgaggctctcaagggccaggcatcaccagaaaattaattaattcgccaccatgcacctgcagcctacgtacattaattacagtacgtacgtactagcttgctagttaataaacaactgcgtgtgtatcctagctaatggcaattgctaatataatctggagttagttggctacatgctatgagttggctggctccaccggcggaccaagtataatcttatctgaaataacacatgcatgtgtaagaccaacctactaccttcggtaccacttagtacatatataatgatcgcatgcatatatgcgcgtggtgcatgcagttgctcggcagtcaactgccgctcagagttgtgcacgtacgaccaatcatatttaaatttaagcaatagtctatattattatatatatcgtcgtatacataatgatagattcatataaatgggagactgtactgtttacaagtttgaaatgagagataaggatgagtaagggtggggaatcagcccacagagaccgtgcaaattaatgggatgtgaccgctttcctttagtattcagaagattcaattacaattcgttgcctgttgtccagctctcctctcccactgtctcggcttatatatatatgtgccaaatcagtcgctcggtacagccgttgcctgtttgtgcgaatttgataatgcaagtcaatgagcttgagcaggactttatgctacaaacgtaaggtcaccctctgctcagtaagatggagtacaatcacgatttgacggtgctgcaagtatggccgccattcgtcaataattgccataaagattgccaaacactcctcgatgaagcttggtttcttggacaaaggtgcttattcaaataagccacgagattcttcgattgcatgaagacagctgtttctagcacgaaacccttgctgaagtcgttaggaagacctagaacaggagcttggaccaacttctgtttgagcaaatgaaatgtccgatcagcaaccgggggcaattgaattgggtgcccttcttcagtaactccattaatcatgccgtagtgctggatgaatccgcattgataccacgtaaggtcgtaagtacgagcaatgtttacaagtcgtccgattaatcgtgattagtcgtaattaatcgtccaaatcggttcggaaaaatagcgattaatcgctaagtcgtctgactacttggtcaagtcggtcagccagaacgaccagcaagtcgtccgacttgaaaaaattgagtacgaaacccttgtgcattcctcagcacaacactacactatatgcctatcaagagtattcatcccataatcatgtaataacccatctaatattatatcaaatcatgcatctacctatcaaacatgcatataaccatattacgacatataaggagtcatttcatcaaaaatttatatcgaagctaatcctaacaacactccgaaacataaacgacataccacttaatttaatctttttttctatgaatctctgatctacacccagacacacaataacaacttcaagctataggtaccgagtggggaatgaatggagaaggaacaacgagtctcaccatgattaaaccaaattgcggatgcgatgataaattctgattcaaacatttcgtcaagcacaaggtgtgtgatgcactagagttcctttcttctccacctcccaactcacacaaaaacatacgtataaacaacagtaaggatttgatgccggtagggaaatgagtaggacaagaacgacatggcctcaccagaacagcaataaggcgacgacgcaagatgagagtgccgtgacggcccaagacacgacaagtcaggggatggggcgagctgcaggagcaagggagcggtctgcaggcacgaccgaagttgaaaccgagcagaggatgggcgagctcggaccttcctggtggccggtgagcagggagggagcgttggcgagctggagtactgggctccgagtgcaggagcagagagggaggcgctggggagggaggagatggaggagaggcggccatggtttggaagccgagggagcagggatgaccggcgaggggaaggcgcagcgagccgcctgcgttggagagctcgcggtcgacggcgaccagcagctagggccggcgaggtgagggctggagggagcggctgagatgggcttggtgaggagcggcttggggagagagagacgtgagggagaaggggatttgggaggggcggcggctctctactgcaggaagaagggcagagccgcagcccgcagagggctgttggcaagaaattccagagggctgttggctgaaagcctggtcggcatgagacaaggagaaaagggccacggagaaaaagaaaaaaaatggttttttcctcttcaggttttgcatttaacaagatcaaatgtataaatcccgattatgagatttgggtttttaagaagtgtaaacatgtcaaaccaaattaatatggacaagaatattttagacaggttttgctttgcttagaaatcagacaaaaatttatctggtaaggaatagatttgattatcaggttaaggtttgagcctgacgttgacggatcaaactaaacga

SEQ ID NO: 24356 - DNA, 1008 bp, Zea mays
acttctcgtcagcttttgcagtggtagacataatttgttgagcaagcaacaactcagtgatggcctttaatttgttcttaccttattggaagatactctaagtgatgctccaagggccaccgagtaccttggacgactttttgcaaggtttgtggaggaaagcatattgctcttggaagaggtaggtaaattgattcaagaagttggagaagaaccagggtatctaatacgagatggcatcgccgctgacatccttggtgctgttctggattccataaaatcagacaaaggggattcattcttgaatgaggttaagtcaacttcgagtttaaaattggttgatttcagaccacatcatcttaagcgatcaaagttggatgccttcatgtagctacatgagttattattacctgattcaccaatgggtgcggccgccaagcagtttactttgttcgcacgcaaatacccatcggcctttttgatgtactgtgaaaaattcctctgatgctactcctacttgctgtacctgatcgtgcactatttataagatggaaggcgatgggtcacccattttttcagagttgatgctggttgtaaactactgtcaatgaagggtcatgggtgggaagcagctagctaggcccccataagaggatcagggaatatttttgcgatcacagggagaagtctgctaaccaatattagttggtagttgggggaactgtaggttgaacttaatgcctcctgcgggcttctgaccaaatactcctttgtgatcagaattggtagtcggttaacttagcggcattttcgtgatagccaatgtttctcgtgatggtctgaatatgttgatgttgcttaaattttgctgtaatttgctatttttcctcgttctttgtttttgtacttattgagaattgatgcctcggattctctgatgtatgtatgattgggctcaggctcagggcactttgccaaaaaaaaaaaaaaaaaaaaaaaaaaacttct

SEQ ID NO: 24357 - DNA, 1094 bp, Zea mays
aaatgacgaagaatctcattttattcattataaatggtacatatttattaaattgaaatatagagtcctcgaaatacgttgggtactggctaaaataaccctccgcatgatttattagcaatcctgatggtgacaatggtgaagccatccagagaataatgtggatccattcatccatccagtaaattaattgccatcgccaacgccggcaagaaggggctccgtcgtctcttctgatccttcgtagattcctgatggtgacgatggtgaagccagaggatgatgtggatccatccatccacccttgcagtaaattagttgccatcgccgaaaccaacaagaaggggctctgtcgtcttcgaatccgcccatttatttaaccttttctgtgcttcctctacctctttgttccaatcagttctcaaggtggcccacactagaatagccgtctgcatgaaagttcctccaatcataccactccaaatgccctttacaccgagcttgaagacaatagcgtggtcgcggccgaggggaacaccaactatgtagtagcagccaacgttcacgtaggctacgaattcttgccacccacacccaacggcgacacctgagagaacaggttggatgccgttgaggacgagcgtgatggcaagcagtgggcagagatctgccaccgcgtttgacaccacctcaccctccgtgaagatgtagctgatgtagttgcgcaggcagaggatcacaatggcaagcaccagagatatcagtgtagagaccccggtcactacccacactgagaagtaggcagattttgggtggccggcaccaagctcattgctcactctcacactagcggcagcattgaatcccactgcgatcatgaacacccacgcattgacagtcatgcatacggacaaggcatccaatgcaagctcagggttggggagcaacccggcaatgagcaccaggacctggtagtacctgcccgggcggccgctcatgaccgcggacgcggcggagagcttgaagaagccccacaggcccgagaatgcctgccaggtgaacccggtccaggtgtggcggcacctgggctcgtg

SEQ ID NO: 24358 - DNA, 1047 bp, Zea mays
gaaaataaattgctggcttaagctcaaggatgactattgacagaatatgaaacattacaacaaacgtctcagagacagacatctatgaaaccatgaataatttgctcataaatacatgaccaacaagaccacctctttgtcgatctgggcatactttagctgctctgatgatgggtgcccgtaaaactgaaaaaactgtacctaagcacctccttgccataccccacaaccatgtctccgctcatttgtcgcaaggggcagatagttaatctgacttaactggtgcctgtggtcacatctagtcagatgagtccaaaccataatcaagcatttcttttatgtttagcttgatagaagtagcgtggtcgcggccgaggtacgccgttttccagtatatccccttagcaccagatggcttgttcctctcaacagagcgaacaacagacatgaagtttgcaatgagatcttcctctggaaagtcaaccttgccaaagggaatatggacaattcctgatttatcaactctgtattcaaccttccctttcttgaactcttctatagcctgagtaatatttgaagaaacagtgccagctttggggttaggcatcagtcctcttggtcctagaatcttacctaagcccgcaaccttaggcatcatatcaggtgatgcaatcaatttgtcaaactccataaatcctccttttatttgttcaatcaaatcttctccacctacgatatcagctcctgcagctctagcttcatctatcttctcaccttgtgtgagaaccgcaatcttcaccgactggcctgttcccttgggcaaattcaccgtggcccggagctgctggtcattgtgctcgccccggcggcccctcgggaagtgcgcctccgccgactcgacaaacttggcgctggacatctgcttcatcagcgagatggcggtgggcacgtcgtagtccttcttgctctccctcagcttctgtatctcgaggaacctcttggacctcgtgcggtcgcgcttgagcggtagtgcggccttgccggtgc

SEQ ID NO: 24359 - DNA, 2279 bp, Zea mays
ggcttaagctcaaggacgactattgacaaaatatggaacattacaacaaacgtctcagagacagacatctatgaaaccatgcataattttctcataaatacatgaccaacaaaccatctctttgtcaatttgggtgactttagctgctctcatgatgtgcccgtaaaactgagaaaactgtacctaagcacctgcttgccatacaccaaccatgtttctgctcatttgtcgcaaggggcagatagttaatctgtgaaggtgataacgatgccagctgacttaactggtgcctgtggtcacatctagtcagatgactccaaaccatagtcaagcatttcttttatgtttagcttgatagaaggtcccatggatgagcacaagtacgccgttttccagtatatccccttagcaccagatggcttgttcctctcaacagagcgctgtgaatgaatagcaagaagtatatcaacactatcctcgataatatgatgaacagaaacagatgttttgtaggaacatagatcttacaacaacagacatgaagtttgcaatgagatcttcctctggaaagtcaaccttgccaaagggaatatggacaattcctgatttatcaaccctgtattcaaccttccctttcttgaactcttctatagcctggaaccagttgcacaatctatttcattggtgtcctaagacaattatcactacaattggactgaactgattcaattttacagccatttttcgaatatgttcaaatctgaagtaatactcccttaacttatggacaaaaggagcagaatgacttgcacatggtttttatcgacttggaaaaggcctatgataaaatacctaggaatctcatgtggtgggcattggataagcataaaatcccaacaaagtatgttacgcccatcaagaacatgtatgaaaaggttgtgattagcgtccaaacaactgatggtgatacaaatgttttcctgattaacataggactacattaaggttcaactctgagtccttatctatttgccttagtgatagatgaggtcacgagggatatacaaggagatatcccttggtgtatgcttttcgctgacgatgtagttctagtagatgaaagtcgggaaggagtaaatagaaaggtagaattatgacgtcagaccctagagtcaaaaggatttagaattagcaggactaaaaccaaagtcacatctcatatacttggtactacaattagtgaggatggatatgtaagcttgggaggccaggtatttgggatcgatgctacaaagagacggtgatattgatcaagatgttagtcataggatcaaagcagggtggataaaatggcgtcaagcatcgggagtcctatgcgacaagagagtgccacagaagttgaaagacaagttctataggacaacaattaggtctgctatgttatatggggctgagtgttggcctactaagagacgacatatccaacaactaagtggcgcagagatgcgtatgttgcgttggatatgtggacacacaagattggaccaagtgagaaacgatgacatatgcgatcggctaggagtagaagaaaagcttattcaacaccgattgagattgtttgggcatgtccaccgaagacccccagaggcatcataagatgggacaataatgtgaagagaggtagaggacgaccaaacttgacatggaaggagacaatcaaaagggacttgaagaaatgaaatatcccaatggagttgtgtttggatagaagtgcttggaaagaagctatccacgtgctcgaaccgtgattaggcattttcccttttagcgctctcaaaagcttttccccctcccctttctctctctctctctctctctctggtgacttcttgttaggtttcaactctagtctaccccaacttgcttgtgactaaaaggctatgttgatgtttcaaatatgttcaaatatgaagtaatactcccttaacttatggacaaaaggacatctggaccatactttaactgtcattttcaaggtagatctattattaagataccaacatcaataacattaggccaatggtggtcacacctaaatcgcgtatgactggcgcgctcgtcagcgcgactatatttgggagagagagaagggaaaggttatgagcatgcatcagaagtttacaaccataatatgtatcaaggtgtaatatttgtattgtgtcctccattgatacagcatttaatatttcacaaggatggctgcaggtcgactatagagg

SEQ ID NO: 24360 - DNA, 1995 bp, Zea mays
tgccaattttggtcgcaaacaatttgtttttgatcttttggagagattgaaccaaagggaccatttagaatcaaatcccgttttcttgattccaacttccaaatacactttaatgtgaatcaattctgtgatcagcaattgatatgcttgaaagctatagagatattcataatcacctttctatccgtgcatacatgctaccatgtgatttttcgctttgtgattcctgtatcatgcatgcgctagcatgatcttttaatagtttgccgtcatggtatgaaccgaatgtttcgtaagtgctttcatttactgcaggaaatgaacaccaatgttgagactcaaaacttgtatgggtgggtaagtggatgaaaatacaggctgactcgcaatacaaacataaacggcaagtaaaagacagatgcagtgctagacactcccatatgtaggtagggcctagttaaaagataaactaaagtaatccttgtaatccttctcgtaacctgctggctctacgtcgccgacctttttttcttttttttttttttttttatgaaaggtaattaaattaatgacaggtgaaaacaaattgttggcttaagctcaaggatgactattgacaaaatatgaaacattacaacaaacgtctcagagacagacatctatgaaaccgtgcataattttctcataaatacatgaccaacaaaccatctctttgtcaatctgggtgactttagctgctctgatgatgtgcccgtaaaactgagaaaactgtacctaagcacctgcttgccatacaccaaccatgtttctgctcatttgtcgcaaggggcagatagttaatctgtgaaggtgataacgatgccagctgacttaactggtgcctgtggtcacatctagtcagatgattccaaaccatagtcaagcatttcttttatgtttagcttgatagaaggtcccatggatgagcacaagtacgccgttttccagtatatccccttagcaccagatggcttgttcctctcaacagagcgaacaacagacatgaagtttgcaatgagatcttcctctggaaagtcaaccttgccaaagggaatatggacaattcctgatttatcaactctgtattcaaccttccctttcttgaactcttctatagcctgagtaatatttgaagaaacagtgccagctttggggttaggcatcagtcctcttggtcctagaatcttacctaagcccgcaaccttaggcatcatatcaggtgatgcaatcaatttgtcaaactccataaatcctccttttatttgttcaatcaaatcttctccacctacgatatcagctcctgcagctctagcttcatctatcttctcaccttgtgtgagaaccgcaatcttcaccgactggcctgttcccttgggcaaattcaccgtggcccggagctgctggtcattgtacttggggtcgaggttcatgcggaagtgcgcctccgctgactcaacaaacttggcactggacatctgcttcatcaacgagatggcggtgggcacgtcgtagtccttcttgctctcccgcagcttctgtatctcgaggaacctcttcgacctcgtgcggtcgcgcttaagcagtagcgcggccttgccggtgcgcgggcgcgtgggggccgtgaacgcggggccgcgcccgccctcatacccgtcgtcgtcgtcgtactggccctgctggtcgacctccgcctcctcttcgagcacggccccctgcgggtcggcgacggcggccgcggcggggcggcggaacgcgaggaggagccgcgggtacgcacgcagcgacggcacggaggaggggaacagcagcgcgtttgacgaggccggcgccgtgctgctggccgccggcgcgaggagggaggaggaggcggtggccgcggcggctgtggccatggtggaggccggggaggatggcgcagcagataagagggagtggagggatagaaagccggccggc

SEQ ID NO: 24361 - DNA, 1030 bp, Zea mays
cacaagccttttttttttttttttttttttttttttttttctttttttttttttaaatatgaaaggtaattaaattaatgacaggtgaaaacaaattgttggcttaagctcaaggacgactattgacaaaatatggaacattgcaacaaacgtctcagagacagacatctatgaaaccatgcataattttctcataaatacatgaccaacaaaccatctctttgtcaatttgggtgactttagctgctctcatgatgtgcccgtaaaactgagaaaactgtacctgcccgggcggccgctcgacaccaaccatgtttctgctcatttgtcgcaaggggcagatagttaatacctcttcccattgccaagcaagagagaaacgcacgcgagccgcgagcagaacagagcagcgcggcgccatcccgatctcgctatttcccttctcccccgatgcgatctcgccgaaccctaatccccacgcccgacgcccggccgtcgccggagccctagccccgaatgcggcggtgacgcgcggcgtgccaccaccaccacctcagcgcccgcgcccgcgcccgcgcccgccaccgaccgtcctgcccggccgacaccagctgccatgggcgccgccgacaagtggctgctcccgctcgtctccgtctccttcgtctcgctcctgctcttcctctccgcgctctcgggcttctccgcctcctccgcactcttcgcgcgcctcccgccaccctcctacgtgcgccgaggcgccgccgcaccgccctccttcgcctacctgctcgcgggcggccggggggacggcaggaagctcctgcggctgctcctcgccgtctaccaccccaggaaccgctacctgctccacctctccgccgacgcgccggcctccgagcgcgccgagctcgccgcggccgtcgcgcgcgccgctcccgccgtgcgcgccttctcgaacgtcgatgtcgtgggcaggcccaccgcgggcaccccaatgggatcctccggcctcgccgccacgctccgt

SEQ ID NO: 24362 - DNA, 11693 bp, Zea mays
  misc_feature (3340)..(3340): n is a, c, g, or t
gctctctctctctctctctctctctctctctctctctctctctctctctctctctctctctctctgtgacacggctctaagctcagatccggaggattgatgccttgatcgcactgtgccacagcccgccaccggagtctttgtttaccgtgcgagctcccggcgatcttcgtcgtgcggcacggcacgccacgccacacctcggatttgccattggctgccacttgctttgcttggcactcgctgcaaaacggagccgcgacgatgaggtcacggaggacgtaaacaggaatcttcgtgtggttttttattttatctccgtcaccgtgcatgcatgcacggatcggtatgcggcggtggcgcgcgcgaacgaaagacgagcagcacatgcatgcaaaccgtcgcaggccgcaggcgctgccgcaggcgcagagcgattcaagagcgcggtaaattcagaaattctctcctctcctactcctactgttccggcgtttagccgttttttactggcggtttcggtacaggtttctgatgaatccgcagcgcagcggaggctttctcggcttttccaacgtgctctgactttggaggaccggttcgcctttctagcgcagcgcctctcttttcttaggcgaattgcaggaccgtggaccgcggtgaaccggtggcatgcatagtggctggcaaccctgccaagatgtagggtcggtatgacctaagcagaggatcagtgaaggagatcagcgatgacctaatcaccagaggcatgcaaattatgcccaagtttgaagctgaagcaaggctgcaactgctcaattctgatgacctagtgatgtggtccaactacacatacacagcaggaaatggaaattgtagcttcaaaacaatttttttttgtcttagtttttttttttgtcgtggtcagagtactcaggctttacgatgttaagctgcaaaaatcaatcccaagtaatttgtaatcgaactacggaacttacgagccttgattctgggcagcagtgaagtctcctgcggaccgtgagacgaatttcctgtaccagtaatcgtcgcagtgtcagatcagatgtcagcatggcgtcaccgctgacactacaagtctacaagtgcccccccaagcagcaggagaggtcgaaaatcccattgttctaccttgcattggacatacattagtcaaccatgcagactgagtaacctaatgtttgacaaaaaaaaaaccaggatcgccaatcatggccaagttgtttactactagtattttagaggcaatcaatgatcgcgcttgcctcgatccaattgcggcatctctgatggtttttagtgagttgaatccattgacgtcccgacgaatgaaatgacgaccacatgcatttgggggtgggggggaggcttgccagcctcagaacagcagggaactcaacctccaggggaaaatgagaaacgcaccaatgagtagcaacgtgctagcagcaaaatgggggttcttgttacatacttccagcccataattttttgcatatctttatcagatcaacacggcacgggggtggaaaaaatatcttggaaacaagcaccagcacattcatcagataatgctaggtctgagctcaaattattagcggattcaggatcagggatcggcagctttctgggatgcccaactaacgtggcaaaccaatcaaaggtcaacagcctaagagcggtttccctgggtccgcacccaactgcttacgatgtcaaacaggagaactagtcacctgtatctgaaattcgatcgacaaaatgaaaacttgcagaacaacagagcaggaaaagttcaaaaaaaaatgaaagaattttgtatacttgagtggcacatatatatatctggctgttcccgcaatacaatgggaggggaacttacactcagctgagactaacatttctgtagtatatatatcaatgagcaattgataagggggggcaaagggagagagtcagatctgatctactctccaaaaaggtctacaaaaaggtacaatccacgggtcctgccatgaacaaccgctgacgcggagatctcaaaggaccaccaggttgattatgtacaacactggtccatgtacaattcagcaggaggagcactgagcatgtgatgtcttgtaccaacaaaccacacgccatgtgaggtgccaaaactgccggtgtagtttcagcagatgctccagctgttgttcactggtgcgccggtaagccatagttctggaacgacctgatcttgccatcccatcctgcagtgactatcacttgaccccacgagtttggtgtgctctggaaacagttccttaggaacttgtactgcgactcgtccagaattgcacgaatcgagcgagacggcaggatttcctctggccaggtcgctgaacttctgcaagtggactcagaggagaactcctgattcaaactgaaaataccaggagcaaaccttgacacaaaactgttgatagcagaatcttcgctctgactcgaactgcacttgacagccttactcatgcaccacaagttatctccttgtggtgacaagatttgggaggccagagagaccgggttcccggccggcgcgccattccttcccattgcgatggctgcattgttggagtagaagcgctctgaggaccatatggttttcgcatgtttcagtgaagcctcgtcttggttttcatggttccatacataaatattggagtcttcgcttgcacaaactatatgctgcccatcaggagtgaatgttgccaaggactggcaagacccagtacggagtcctgattgaatgaataaaatgatgagctcataatacataaaatgtatcgattgcttagatcaataagaatgaaagctaagcatgtggaaagtaccactataattctgagtcacagtggttccttcaagaattttaaccttcgagtcagcagaggtaaccattaatttacttgggttgcttggtgagaactgacatgaaaaataaaataaacagtcagaacatacgagcgaaaaaaatgactgatgaagtgaactgtgcaataaaagccttccttctcgtcaagatatttacctcgaaagcagtgattcttttaagagaagactttttcttgccactgagtgcaacttgtgtttcaaacctcaggagattatctgatccatcaagatgtagttatagtcagtatttatggagtatcattcaagtaaaagcagagaggtactgaaatggtaacgaaaagctagtagagatttcacttttttttttgtacctgatgcatcataaaatcgacaattcccagtnaatggttccgaccactgctccctgctaagatataaaagacagagaaaatctattctctcaaaccactgaaataacaagttagccataaaaaccccacttcagaatgcatgctgatacctttccgtcaggtcgatagcaaaccgctgttattatgtctctaatatccacccaatcaatgacactgcatctgggaatatcccacacacggattttgccatctatggatccactgatgaattgattctcattggttggattcaactggacacaagtcactgcaaaagtaaattttcatagcgaaatggtgaggtcaaattcagaagcatagttgaaaagttttggagcagcaagtaagagactatagacctaccaaagttgctgtgcggaaaaacagtgatgcagtttgcagatccaatttcccacaagcgaacagatttgtctgttgatgctgacagtagatgctgcaaggtagaaaatttcaatcatcagaaaggaaaggacaaaataaataaaaaaatgcaatcaaaccttacagaggggggcaattcattcaataattgtactgaccttgttgttagaccatgacagactcagtacgtcaccagagtgaccacggaactcatgcagtggttgctttgagatctggaacaccactgttggaatcacaacacaggcagaatctgcaggttgcctcacgcccttaactttgcatttcttctcattgtcagcatcaacaggacccaagccactctggcgatgagctttgaggtaaacacaagaaggatcatccattgggattttgcagtcctcagactgcgcgacgccccagaccctgacaactccatcttcccctccagtagcaagaaactgcccatccgggactaaacttcatagccaggatggccccatcatggcccttaatcacttggccttgataaactgctgacagttctttcgacctcttcctgtagctgcggaccttgaccctttcgtaccttccacccctgttttgctcactctcagaggagctggtgctagcctcatcgcctccatgatcgaggataccagccctcaagcccagcctccgaagccatccgtttctcctcctctcgaccgccttgggaacaccagagagcttaccactgcggctcatgagcctctggatgaaggacaacgaactgaaactcctgctcaccttgctgctagcatcatcccggctggatccactgacagaattgtcatccgagacaccatcctctaagctcctcgtctcctccgtggaccaactcgacaggggggggggggactagtgagactgcgaccacgatctcccaaattccggcacagcctcttcctccttgtcgacatcgcccacggtggccacggcatcggcctgcggaggagccgggcagcactctaggcccatgcttctcatgaaccgctccctcctctgacacacactgtcgaggcttcccgaccacggcaatgcagggcccgggctgggcgccggcgacgccgtgagctcctctcgcgagtcaaagaacgcttcctcctccatctccatcctacagcctactagcagttggcacccttccatggatgggatggatcttcagcacaagagcacacggcgctgcgaggagagaaagataaacacatctcagagccctggtccggtgcggaggcgcggcttatataacagtaaagcggcgctgaattggctcggcggcaactggggacgagaaaaagggagagagcggacgcggagggagcacgggtcgggaggagagggcgatcagcataaacaaatcacggcgaatcccacgcattcaactgcacgcatctcccaaatcccgcagctcgcacggcccaagcgctcctgcctcctgagcaatgcatctggcctggggcaagccaaccagccgcgcggccattattaaagcgggcagccaggccaaggaaccgctgacaaaatttcagggttttttttttaaaaatcccttccccctctcaagacccgccgaattcaccaccacatatctcgtcgaaaccaatagattgattgatgatggtagagggggaataatgagggattagaaaaggaagaaactgatggcaggggtggggggtggggggagaagctcacctgggcgaggcaagcagagaattcgcgcgcacgcttgggattgggagcggctgggatccaagagggaaaaggaatccgttttggtaagcctgggtgggtggctcagggatgccgcgcgtgttcttggctcgtcgtggtggccggccgcggcagcatggcgcaaatgggtgccggtgcgtattattggagaggattggattcgagccgatctcacgcgggcggggagaaaggagaggagggggggaattggagacgacggggcgatttattacgacggacgtgggaggcggaggaggaggaggagaggagctggccagccgtgctgggtgtgtgggggtcccagtcccgtccgagtcccccatcaccatcgccagatttggaggacggacgcaaaaataaatttctgaagatgcactgtgctgctcagagggaaaaaaacgaggaaaatactgcacagttcccgctaaaacaatgcactgtcgcagatttgcctcttgcctcttaatcatttcttgctgctgggttggttcatctcacacacctctgatgacgcctctcacactttcctttctttttatctttcctttgttcttctgttcttcggtatgtatgttttttctctccttttcgtctcacttccggtcgtcgttttgtagcagtaataggtggtgagctgctgtagtagcagcggcaataaatcgtgcaggtctaggcctgggtctatgcgtactgcaaccgggtgcatcggcgctgcagcacaccgatctgctcgtgtaacccttgcctgataggaccgtccgcagagagaaagagatctttttttctgctgtggaaaaccgatgtgctgaggttagcattagcaacagcaggcgcatggcctgcatgccacgacacgagccattcgtcgtggcagtgaattgtaacagaaacagcacagtacagtactgctcggctctgcattgggcagaacgaacgagagtaggaggattactactacgatcgatccctgccgttggttctgagcagcgacgaagggggaacacatgtatatgtatgttggcacaaatctgactctagctagcttgtgttgtgtgctctgcagctgcaaagtgttgcttggaaacggcaaattactagctgggctgggcgctcgcgttgcgccaaacaaaggcgctcatcaaagcgggggaggggaacagtttgatgcacctaacatgctactgccgtccgctgcttggtccccccttgcgcgtacaggtgcaggatgcaggcgcgcggtgcgatttcttcttttacctattcacgcaagaaaaagaaaaaaaaaacgggaacacgtcaaaactatttcacagagctcgatctcttgttggcgagtggcgactcggtctgggtcaacccgtcagctggggctgctgctctgtctgtgttcgggtcagacggtcagtagtgccgagcattttgattttagcctgcatcaattccagccctttttggacgagggaatttatttatttattaacagtcgttgcagcggctagccggctctaggtattggagtgaattatataatctagatgtctaggttatgataattcataaataaattagtagatgcttattttagattattgtttagctttttatctactaataatttatgtaaacaaacatctgtaataggattatataaactagattacacaatccagattatataatttatataaaataagctggattacatacgggccctaaagacgcatcggtcagcagtgacgttaaaaaaaactctgcatgcatggaacgcagccacctgctctgcatgtgtggtggcttttgatacatgagtgagcagtctggggaaaaaaacacaaagataggtgctgataatgggctaagtacgtagattcgagctgtacgtccgctagtttaaagaacccagctggatatgcatgagcagatgcatggacgacgtatccatctctagctaaccccaacaaccctgcagctccagagttgattcgtggttgggcgaagatggcaacgcgagcgcgagggcggcacggcagcaaccccatgcgtccaagcctttgtgttttgtttatatctattttatccacgtgcccatctttgcacgaaagctgctgctctctgctgggagcctgggagggaagggaggtttaccagctggttgatttggtgacaacgagattacaagaggattagaggattaaagggtagtttatttctttttaatccctcgatcctctcgtaatctctggtcactaaatttcgtccttagacttatccggcgtctcggtctaccacctccgttgggacgtacggacacggagagcctcctcctgctccgaaagatttcccggtcacggcaccgaagcaggctcggtagttgatcaggtgtccactgctttcttttctttctttttttccttctaaaagatggggcggcaagcatctagttttgtccgccagatattttaattctcgaatacagatttcatccggacttgaattattcccgccattcagcgaaagcagaggtctagtcagagttccatcttctctggtgttctgccgttcagtttgaacaacgtagccagtttattcctgtgtgctgtctccttcactctgacagtgacaacaaaatacatactgctagctagtccagttaacaacgttctgtccaaaggggctgggctagaggaaacaccggtcgtggttgccttaattgaaccgtatctcgttggaggaccggtcggacaactgctcgttcgctagctgtcatctactaatgatcagctagatctttttttttttactgctagtgttaggaaggcctagccacaagaaagaatatatgcttctctgtactgtcctagatgatgaagtaacatgggctattcaatacttccgcttttaataacgcgattatttaaagagaaaaaacgtgatttgatttggtgtggaaatatgccatatatatgcatagacaaacatatattatcaaacatattaccttcattctctcgaatatttattgctttttagtttactttttaaactaaactacgataaataaaacagaacgaagtaatataagtgtttttttgtgtactcgggaaatgtttttccctgtggcagcacagccgacctaaagggcctttgaagtagcaatagaaatagcaacttgatagactgtcactgtttctgctacaacatgaacgacctgtgtctgaaatcataccgccaatcattatgatgcgtccttcgaccgtgaaatgccggttaggtgtgacggtcatttaagcggaacagctccagttcggcagttcgtccctgctggtttgttggtaacgcatccctattctggggcacaaccgcacaagcatgtgcgtatatatggccagaaacaattaataatcatgtgctagcttttaatttggagcatgacactcaacctaaaaaatcatttatatatttttaaaaaaaaactttaaaaaacaatcgtccaaaattaagctctctgggtaacctaattaatattatttctgctcgaatccggcattattggctgtatcaatattctcatgcatgcatacttgctgccgctgataattatcttggtatagttagaaaattatatcgtatgcccgtccactccaatttgttgaatgacgataatgatgaccacggcgacacgtggatgattattccatgaactaatctcagcacacaaaataatactactcacacgtacggactgccaattgtttgtcaaattcatgcgcgcacaaatgtgagaaagaggaaaatattctccatgttctgctagctacttgtttgtgtacgttgctccccattattggccaacatattgattggcaaatgtgtattatggctaagatcgaagaggataagggctggaagaggattaagcactatgtttacagaagtagcaagaaccaaacaaccgaagcaaagctagctcgaaaggaagatggatcatcaggaccactactgcagccctcgtctgcacagttagaatgatgtaaacgattcgccccccaaaaaaaaagaggttagagcgatgtaacacctgatgattgtatgccgctgctgctggctaatctaaatggtctacatcatctgtgtgtctgctactatgttgcgttcctaatgtgcaacaacaagctttcaaagtccatgtccttgtcagcactgtgtatgaggtacggacccctgcacagtgtgctgcttttttggcgttatttaccaaaaagatgagggtgtgagtgagaccatataataagccatcgcatgccttgtccttgatggatcagtagacttgtttggccgttgttgttggcacattaacgtaagcaaagacacaaatcgggtgtcacgttcatggaaggacgatccctgtctagctagggttccaacagataaactagaccacagcatggcggtggcgccatgtgacggtcgagaaaaaaggtagtaggagtagctatagaagaagctacttgcctttgtcgcattgtgccgtgagatcaaaataacaatggagctgatggtatggtagtcaaaataaatgacaccacacaaataagataataattaaggtgccgtccaaggtagcccacagacacacactgctgccactctacacgtacagtacagtgtatgtatgcatacggttgacatatatctaaactgttctgtgtggctgatgaaactctctctatgtcaacggaggaagtgtaacaacccctgcactgcactgcatgcatgcagagaatccagccaggttgtcgtctcgtaaaacagattaaggggaggaacgaaggcacggtaggacactaggacgcttccgttagacggtcgaatctgtcactgtgttcaccgtatcggcaagatttggatggcatttcctccggtaattacgatgcacagcaatgatcgacgcgcgtcggtcacgtgtcaagttgcataacatgaaaacgagaagtcagggctgcatgcatggtttggctcattcatgcatgcagatcgatgcatgtgcatgcatggccggcaaggcaagaacaattggtacgtgcagtgcagataaagctgggcgatcgaggggcgagatagacctccactccacacgccgacgacgcttttaacaagggatgtattatcgtcgattttgctggtagtagactagtagtggtaccaccgcacacgtacaaaatggtcgctctttgcatggttgcaagcgtgaaataataaatcgatcgatctagatgcaacgactttaaagttgaagatgtacgctgtacgagccgaccgaacgcaatggttgcgtgaaaggacgtacgggtgaagcaggatagtaggacgcgtgcggtaaagaggccgtactggtactgctctctgggggcaaaaggcacgagcacgcaccgatcgaatgtagtgtagggcatggaattgttcgtacgtgtgtctatcagtgtgtgcactagtcctgtacgtacgtacagacacacacccttgtttgcgtgctagttctatacatatgtatctaactatatataatatatatgcacctctctagtggtgttaggtgaaaattacattattcattactatagttaatctccttcgtagtattatatttatagttatgttatataaatctccactccatgctggccacgactcaatggatctctgtggtacaattaattgggccagcggtttccgagtcagcgcaaacgtgactagaccgttcttgtctgcgcgcgcgagtcatccggcccgtgctagctagtcagagtcgtgtccatggacttgataggatctctcttcgctacgatttggcgcccccacggcacgatacgcgtcgaaaaagacctgtctcgatcgctctcgctttgctggttcgctttctactactactcctagctagctaggtagttcaagcgcggaattaactgccagcaaaaccattgtaccggcaaccggacaaaacagaccgactaggcccatacgcagacggtcagctcccgttcgtcgcagctagcagcacgctcgcgcggtcgcgccccgcctcttcgtgccatgcatgggacgcgcggccggcgcaaggtaccccggaccgggtccgggtcccgaaagccgatccaccgcagcggcaca

SEQ ID NO: 24363 - DNA, 765 bp, Zea mays
tcccgtctaattttatcaacgcttctcctgctggttacgtcgtgtctccgcgcgccttctctttctctcccggacgtcgatcgtgttcgtcagcacgggctagctagctccctccctcccagccatgggcgacgccgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatccaagctcgctgtgctgctgtgctgactcgaaaggagaacggatcgtgcagcagctcaagtgatccaggatgatgggagcgccgagacaccatggaaggcattaattatttcagccacggtgtttcgccttgctttaaccttttgctcatctctaccgaggaacactagttccatcggctaactgaacctgcaaatcttcatgatatgaaactgtcgcatcatttgtttcatgtctcgttatggccgtatttgtacaaaactcgacgatcaccctgccggcggcggcggcgagcaacattgcaaaccatcgcatctaatcattcgccaatcacaaagtttaagtcattttagggcg

SEQ ID NO: 24364 - DNA, 704 bp, Zea mays
aactcctatgggcgattgggtccctcgaggccggccgggctcccgtctaattttatcaacgcttctcctgctggttactccgcgcgccttctctttctctcccggacgtcgatcgtgttcttcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtgctgactcgaaaggagaacggatcgtgcagcagctcaagtgatccaggatgatgggagcgccgagacacgatggaaggcattaattatttcagccatggtgtttcgccttgctttaaccttttgctcatctctaccgaggaacactagttccatcgggtaactgaacctgcaaatcttcatgatgaaactgtcgcatcatttgtttcaaaaaaaaaaaaaaaaaatttgcggccattcggccggcc

SEQ ID NO: 24365 - DNA, 712 bp, Zea mays
agggcgattgggttcctcgaggccggccgggctcccgtctaattttatcaacgcttctccggctggttacgtcgtgtctccgcgcgccttctctttctctcccggacgtcgatcgtgttcgtcagcacgggctagctagctccctccctcccagccatggcgacgccggacaacaaggggcacgggcatccgctgcccaagtttggggagtgggacgtgaagaatccggccacgtccgagggcttcaccgtcatattccagaaggcccgcgacgacaagaagaccaccaccggccctggggctgggaacgcgcgcgcaggcattccgccggccttcaggaacggcggcggcgacggcgggtacaggcccgacttcggcgacggcaaccagtacacgccgcccaaacggaagaagtgggccttctgtggctgctgaatcgaagctcgctgtgctgctgtcctgactcgaaaggagaacggatcgtgcagcagctcaagtgatccaggatgatgggagcgccgagacacgatggaaggcattaattatttcagccatggtgtttcgccttgctttaaccttttgctcatctctaccgaggaacactagttccatcgggtaactgaacctgcaaatcttcatgatgaaactgtcgcaatcatttgtttcaaaaaaaaaaaaaaaaaagggacgaccggcagaaaaaggggcggcc

SEQ ID NO: 24366 - DNA, 2275 bp, Zea mays
cgctctttttttttttttttttattttttttttttttttatgttaaaccagataaacaatagcatagaatgacagaacagagtatctcaaccatctggcatacttcactatccaatagcaaacataatttttcaaagcagtacatatcgcatgcaggggcctcctgcaaactaacatataacaaaaattccttgtttgaaacaaaagcaccttttcatctggttgcaagtgcaagcattggtgaaatcatcccttgaatgccctgcagcatgtgctgtatctgaatctcctctgcaaccattctcttaagattcctcatatgcaccttcagcttctcatctgatcggatatcagcctcgcgcatctccacaaccttgtttgccaaacacaacaacaacttagcataccttggcaaagttgcattccggtgaaggaactccaaaagaagaccaagttcctcattatccaaattcccgatgcatcttatgagctttcttcttgaaaccagctcctccataacagccacaacactcctcgggttgttcttgaccaatgctgaaaccagagcatccttgtgcctgaactttctcagtaacttatcatgctctgcatatttcaccttcttcggcttctcaatcacaaagtcaccctcctttgccttctcattctgcccacggcggaagtacctaaagtaatttggcctcaacactgacttctccggctctggagatacccagtcaatctcaccaccaacagatttcatcccttgctcttcctcatccacagccttcttcttcctatttctcatataaatcttccctttcgcagaccctgccaccaccacagacccacagggcgagacagccacagaaaggagcggctgagggtaccgcaaggagtgtgtcatcttaagcttcccaaaatcaaagctcttcacatacccatcaatgcccgcactaagcagccgcatctccccagtgttgaccatcttgccaagagtcaggtccatcactgtcttgacatggctctccacagagtgcacgagccggccaccaccaatgacgtcccaaatcttgaccacgttccctccggccgtggccagcagcccgccggacggaaggaatagcacgctttccaccaattccccgtgggagaaggacaaagatgggccggtattgctggtgcgggcatcccacaatttgacgctgcggtcgtaagagccagtggcgaaaatgttgtgatcagcaggggaggccgcaccgccgcgaatgtagtcctggtgcgcggcggggatggagaagacgggagtctccgagggcacgtcccagtaggcgaggagcgcgtcgtcgccggcggtgaggaggtgaagcttgtcgccgccagcgactgggtaccggaccacgcgggtctcggcggcgtgggcgcgcagcgtgcggagggcccccgtggcggccttgtcggcgcggaatacgcggacgacacccttcttgtctccggtggcgaggagggcgccgtcgcagcggaaggacggggagaaggcgagatcgcccgcgacagagatcctacggagcttctcgagggggtcggaggagaagacgtgcacggaggtggaccaggaagcggcgagggtaggggcagctctgtcttccacagaggaggcgaaggtgagatcggtgacggggaagccggcgtcggacacgagctccgaggagcggaaggcgcgccagtaggagctctcagggaacgcgcgcgaggcggcgctcctggaggggcggagagccgagtgcggcgccgccgggaagaagggcttcgaagtgtcagcggccatggctgatggcggcggcggctgcggcggcgattttgggagaaaccctagcggaatgaggagagggtttattagtttggtaagcccccgtggggactacaaaatgacaagaatatgacatgtggccctcaaacggattctcaattttccaagtcttttttaaataaaaaattgaaattacagttcttcccgaaagaaaatgagaatcaggacttcggaatttttttttatcgtagactcataattactttttatatagtgagcttgtgttgtagctcttgtgtctgaaagtgaattaggcttacacctagttcctaaataattttggtggttgaattgcccaacacaaatctttggactaactagtttgctctagtgtataagttatacaggtgcaaaaggttcacacttagccaataaaaagaccaagtgttgggttcaacaaaaggg

SEQ ID NO: 24367 - DNA, 851 bp, Zea mays
agaaagtaagcacaacaccatcagattctgagaaatattctacatccacgatacatgtatgtacattttgcatgttttccaaccaaaaaagggagagagaacaaaatcagctcatcttacaaactaacgatcagtacaaaataaatcatatgctcggtgttagctgagcttcggctacttgtggtgtctgagtgtctaacccaggaaactgaccgatatcatgcccttcaactgcatttaggtcgtcgtgcacaccaatcgcaaactcttcaggccgatcttgggtgctcacgaagtagtcagctatatggtttgcgagcgacatcccgcttaaaacagctgcttctatgcttgagccagtaagccagtcgccgcagatgcctgctcgccctaggggatcaaatatgcatggtactcctggagtgttcatgggcagagctgcaccccataactgcactcttgtgtaaattggttgctgaagagatccttcggataaccctagagcatgttctactcctccaagcatgtcttccttcaccttttctgcagtgagttttgggatattttcctgtggaactttgtttctttttccccccgcggcagtactgaaaaatgtccagcactcgggtgcgcctgtctgcattggaaaaagtttgcgggtattgttgcccatccaagagagagaatcgacatctctcacaaatgctccttcaaatgctgcattggaatcaagaagtggaatcggaagaggatcttcaaatgctgcaaggagagcccagacagaactgagctctagtcactgatcattgaccgcgggacctggtgaaaaaatagcccggccggcctcgagg

SEQ ID NO: 24368 - DNA, 706 bp, Zea mays
aaggtaatgctgcatttaaggaaaaaacaatggcattgggctgggaatttctccactgtcgccacgaggttaaatgaaaaagtggctacatactacagcaacagagctgctgcctttctagaactaactagctaccgtcaggctgaggcagattgcacaagtgccatcgaacttgattccaagagcgtgaaagcttatttacggagaggccctgcaagggagatgctaggttattataaggaggccgttgatgatttcaaccacgcccttgttctagaaccaatgaacaagacggctggtgttgccatcaacaggttaaagaagctgtttccttgaatatgaagctgcatgaagatatgataacctcatattttgtgcacacacaagttgtgcgtgtcagtggggtgggattgaagtacctgagttcaaccgacggatgctgatcacagttttgagctagtgggaacggatttcaacactgagatcaggttaagggtcaatttagcggtttctctccccacccaaagttttggaaaagcaaaataaagaaggttttttgggaaccggaaagcagtttacgggtgtccgccatccccaccatgtatattatggtttcgccaattatttgttcagacgctttgccaatcgaactttttctgccaaacttaaaaaaaaaaaaaagaaaaaacctcgagaaaaagcggcc

SEQ ID NO: 24369 - DNA, 2380 bp, Zea mays
ttgggtacctcgaggccggccgggaaattctttcttcggcgcagtatctcctaggtctgctagaaagcaatcgcccgcggtattatccatccaccacgctgcatctgcttctcacgccgcctcgccttcctcttccacccctcgccgtccgtcgtcctcagcgcttgtacgcttgcctcaaaacccctggcgccgtgctaaaaccctagccctcgaattccttcccctgcccgcgcggagcagacgagcctgagcccgtcctcctcgtccatggcgtcctcaggggccgccgctaacctctgggtactgcttggtctcggcatcgcgggcgttctcctggcggcgcggcgactgaggcgccctgcgcgccccgatcacggcgccttcgtcgcccgcctcgagctcctcccgccgccccagcctccgccgccgcaggcgccccacccgctcaccggactctgcttcgccatcgctgacgcattgcatgtcagtggttatattacaagtttcggcagtcttgaatgggcaaagacacacgatgcagaagtgctaacatcttcagtggtttcagctcttgtcgatggtggtgctatttgtgttgggaaaactgttattgatgagatggcatacagtatccatggtgagaatagatattttgatacaccaacaaatcctgccgctccagatcgagtaccaggaggatgttcaagtggatcagctgttgcagttgctggtggaatggtagattttgccctgggtattgactcgattggaggtgtaaggatacctggtgcttattgtggtgtcttagcattcaggccttcgcatgctgtggtttccaatagtggtgtcattcctgttgcacctagcctggacactataggttggtttgcaaaggatccaagtgttttgcatcgtgttgggcatcttcttcttagacttccttatgctggtattcgccaaccgagaattttttacatagcagatgattgctttgaactttcaaagatacctgctaggagacttactcaggtggtgacaaaatctgtggagaagctctttggaagacaagtccggcatgtgaatctcgaaaattatttgagttcaagaatatccagcctgggtaactattcaaatgggcataagaatggggattcaaagttccctctgttgctagcactttgtaactccatgatatcacttcacaagcaggaattcaaagataagcatatggagtggataaattcagttaagcctgctgtggatgcacgcatagtcagtgatttgtctgaggatggtgattcagatattgatggctgccaaaatgtgaggaaagaagcgcgctctgctctaagtggacttcttaaggatgatgggattctggtgattccaactgctttggggtgccccccgaagcttaacgctaaggaactctcgtctgaaagctacaattctcagacactacgccttttgtctttagctagcatgtcagggtgttgccaggtttccattcctttgggtacacatgataagtgccccatttcagtttcgttgattgctaggcatggtggtgatcggtttttgttggacaccacacaaaccatgtatacaaccatccaagagcaagtggagatactagcgaaatctagtgtttcaagtaaacaggcgatgaatgaagaagcagctgaagctgctaaagagaaaggtaatgctgcatttaaggaaaaacaatggcaaaaggcagtaaatttctacactgaagcaataaagttaaatggaaaagtggctacatactacagcaacagagctgctgcctttctagaactaactagctaccgtcaggctgaggcagattgcacaagtgccatcgaacttgattccaagagcgtgaaagcttatttacggagaggcactgcaagggagatgctaggttattataaggaggccgttgatgatttcaaccacgcccttgttctagaaccaatgaacaagacggctggtgttgccatcaacaggttaaagaagctgtttccttgaatatgaagctgcatgaagatatgataacctcatattttgtgcacacacaaggggtgggattgaagtacctgagttcaaccgacggatgctgatcacagtttgagctagtgggaacggatttcaacactgagatcaggttaagggtcaatttagcggtttctctccccacccaaagttttggaaaagcaaaataaagaaggttttttgggaaccggaaagcagtttacgggtgtccgccatccccaccatgtataatatagtttcgccaattatttgttcagacgctttgcaaaaaaaaaaaaaaaagccatgcttaaaaaaaaaaaaaaaaaaaaaactcgag

SEQ ID NO: 24370 - DNA, 5258 bp, Zea mays
  misc_feature (832)..(832): n is a, c, g, or t
  misc_feature (1569)..(1569): n is a, c, g, or t
aactctcttttttcgataaagaaagttttatattaaagattatcaagagcgatacatcaagaggatacatagtcttggtacacaaacttagcagcatcacacacatctcattattcatgtcggcctatcgttaattgaaggtcgtttgtttacatatatagctggcgcaaactcaacaatgctagacgccggtgcctcactacacttggccacccaactgtgtcgcttagggcccgaacaccggcgtcttacgggtgcaatcagttgcaaggtcgtacccgacgggcccgtccaccgcttcttcatcgaaagggaccagggcctcgacttccagcagcgttgctgagggtggattcgcctccagcgacggctcatgcaggatggctacttgatccactctctcgaaagcgcgggcgccgtgcacggatgagacggtggccatgacaacaacaatgaggaggaggagggttgtgaggctggcgagcttggccatttcgttcttcacggcttgcttggtgatggtcgtgcgtgcgttgtgtaagcaggtgtagtggatggaaggaacggcttgcgctggtctaggaggagcgagggaggaacacctagctggtttttataggtggaaatatttcatataataataaagattctatttatgaaactgcatgcggtggcgttattagtggccgctctagctagttaatttggccaaattaataaccataggagttttaatcgagagagaaaggttaataactacttaggagttatttgatgcatggagttgcatccaaaacgtgcgtgcatatcttttctatgcatttctctcagntatcaaataataactattcagaaaacttttttgcacggcgatggtctgcagatatatagcagctagcatgacgcgtgtatggatgttatttactattatacgaagaggaagacatatatttggatgactcacgtaaacctcaagccaaagctatatatatatatatatagttacgagtagtataagcacacgtgtacagtacgtacgtgacaaccacagacacgtatgtcactcatattaggcgttgccggtgacgatccgggcggcggcgtggagctgctggtcacacgcgacgacgacgaagctcctcggcgccctgctgcccaacaccgcctccgcctctctcgtcgtcgtcggcggcggcggctcgttcaggaacgcccagctgctccgagtccacctacgcgagcgagcatatatatgcgcagcgtacaacagtacatgcatgagaccagttctgactagctagctagctagttgtgaacacgacggtacggtaccagctgccgcggttcgcggcggagctatcggcggcgttctcggggaggaagaagccatcgtcgtcgctcctcgtgcagcagtattgtaccggtaccgcgcggggagaaccggcgttcggtatgctgccgtgctgcctccagaacgccgccacctcctcctttgtcagcgaccggttcctcatcaaacgagctataggcacgcatgtacgtacgtacgtgtatatcggtgagtgaatnatgaacatcagacagacggcaaccaaataataggcatgcatggatgctatagacgatagatataccttccttgtcactcagcactgaggagctccaaccggacatcagggatcccatcgcgctactatatatagctgcaggacgatcctactactctcctatagtcctatagctgcaggacgaagaactgtgtgtgtgtgtgtgtgatagagagagagagagagatgatctgatcggcagtgataagggagagttgtggacaagcaaaagcatacgtatatagagagagctatagaagatagctattgtgtctctcgctcgtgcgcgcgcgcacctatgcgtcgagacttattacgcacacgtgtcactgcccaagagatcgccagtgcgtacatgcatgcatcgttagccgcccgcacccatgccatgccggcctcgacctcatcctgccgtcgatgagctgcattgcggctcgtccttatcaggtggattcagggtcaggactcaggaagaaggcacgcccatctcctgatccttgtccgcatccggcttttgagtcaagcgtaatggaacggaatgctggatttatcacgttcctgttgtggtgacagcgtgccgagctcatgtttcaaagctgtaggcacgaagaaattttggctagggccaaacaagccccttggatagagagacaaaaaatgccctttttttttttttttaacgcagaatattgtactggtatagactccccttgacactaaggttcaccttaagctcacaacattttacacggttaataaagagcagggtgagggaggccgtgtggcagcaactgctgacaatgaataaacccccttcaacggggggaaaaatcagaacaaataatacacacatttttacaatgttaactatggcactcttcaacagtaaaaaaataataatcacgattttcccccaacccaatcgcaacaaccctaccaatagcccatctcatcaagcttgatcattgttttcttacatcggtggctgcaggaagcttggctgggtagctagacagatcaatatcaagcaattctgtgaggtcgtagagccctccaggaggatcaactttgtccttgattggggttgtcattgtttcttcctgatctgcctggttggatgatacacttgacgtcactggactgtttgaggccgccacggtgatgccagccaactctacaccctgcccacttgtggcggtgctccccgagggatactttgtttgtgcactgtctccctcattgtgattgtagagcacatattcattgtatgtaggagcaaactgcatgacaatgggggtttcatcagacaaaataaatgctacagtgttatggtgtattaggatgtgtttggtttgggtcacagagacgatgaactgggatcatccccagaggactatccctccatatctgggacgagctcgtaaccagaaattggggggaacaaggtgggacgagcagatacaagagtgcacgagcaagcctcagactccacggcatcagacagccgcaggctcgcttgcctcgggcatggtggcctcaagcgcaacaaactcagatacttcagctgcaggctcactggcctcaagcacggtggccacaggctcatcggcatcggacccggtggcctcagcaccaggcgcaccgattggggaccatgcggctctctttcttttaatgcaaggaagaaacgtgcagagtggataacaggtgggccccacttgcctggaacgatcattcatgttttccagccaaacacaagcttgaggacggatccatccccctaaccaaacattaaaatgggatgatcccgccctccaaataagggacgggccgatcccatcccatagtgtcttgaaaccaaacacaaccttggagtgtgaaagatcctagttacctgatgaacggtgtcatggtagaaatcattgaatttcaaagcatgaagaaggctttctctgaaaccacgtgaagggcgggcattgggacctgtatattccttgtaggggaaggcaaataagtgcccaacggctgctattagcatctcaacacacaacacaaagttctggagatcagcagccttatcagcattcttgataaatcgagattttgcagcaaggaaaaccaggacgccctgtaataacaaggtccaatttgtggcttgaatatcacataaaaatttattggcaaagccattgcaaacagaaatgcagttctgaatttagtttagtaaaggagtgtgaaaaggggaaatacttgaaaagtatttacctgccaatatgtgagaaacaccactgatttgatcatgatgaattttgggacaggattatatggccgaagtagatctctgcaagccgcgtagaacaatgcaagggcatataaagccattgagtatgagattgtatatatgatagttatgtagagataggattggttgacactgaagtttccatctttgtattttccttttgcgtaaagtatgaaggtgatgacaaccaaaataggcttgagaatcacaaactgcaagcaaccttgtttgcatcttcgtataaaacgcctgttcaagaccaaagatttttgtcagacagcacttcgataataaccacaaaatgtagtagacaaacactaatcacttactatagagcaatgtcacagaaattttttaaaagttgtagtagtcgcttggtaatgcaccaaggacacatacgcacccatctagaggaatagctggataacagcaagtcatcagaatccatgatggtttcagtgttcggccactcaaacttaccaccacagcaccaggacctcccacccatgccaaagcagagtgagagaaaattgtagatgacccaagcatcatagctgcaataacatgaatgtgatgtttcagaaaacgctgattttgaaattactagttgtaagaacttctggaacagcaccaaaaaaagccaacagcacatgggcaaactcacacaaacataaagataaacagtgcctaaggtttgcactatactatttaggcagacatgttcatgaccttagcatgcaccaaaaagggagaaagaaaagagtaacaagaatctaggcaacgttatgacatgagaagacagacttattatcaaatattagattaaaagaaacaaaaaggttaaacttactaccaataccaaattatgacctgtgaaaatccttttttgcaattttacaaaaaggaggtcatctgctaaattgtatccaccttgtttcaaatttaccataagaaaacactcaaaagcagacagaaccatgatcactctccgttgtttatcaattgatgaagcactcatgggatcagaccgatattcataaaattggacacatgtgcactagttcacagaggatactggataatccatttatttactagagatcatcaaagattatccgcacggttgctgacatatttgttagtatataaaacatatttgctgtttctatctacaaacatatggaatcatggattagaagccacaatgccacattgtactaaaaaatcatttgaggtgacaagagaggtccgcttacaagtagaacttacatctcccgaatagaattaaagtatatcgcgttgttagggaggataagggaaaggaatgacatcacagcatatacctgcag

SEQ ID NO: 24371 - DNA, 2105 bp, Zea mays
ggtgggattaatagtcatgggtatatggtctgacctgttgcaaagaaatgctctatggtaggtgctagctagagataacaaaatcataattatcagaactatgattcgtcgtaacaagaaaaatgcaaatgagtatttactaaaaaaacaacaataagaaagatcataaacatatatattatgcacacacgaataactcccaacagttttttttttttttttttgacactagaattctttattcattcagatatacatataacatatggatccaaattgataggtactactagcttatatcacatgtaagctctatgactcgtacggaagaacacaacatcacaaatcatatatagctactatacaacagacacgtacgtgtgcatgagggaaaatgtgcagataaccgagtctcggactgtacgtccgctcatggtttcgcctccggctccgggtagtggccctccggcttcggtggcagctcagctttcggtagaggcggcagctcgtggtttggcacctccggaacctctgggtgcggcagctttggcacggtcgggtgaggagggagttcaggctttggcagctctggcgcgacttggtgaggcacctcaggctttggaagctctgggacggccgggtgaggaggcagttcgggcttgggcagctccggcactgggtgcggcacctcaggtttcgggagctccgggacggctgtcggctgcggtggcacctcgggcttgggcagctccggcactgggtgcggcacctcagacttcggcagctcgggcacggccgccgggtgcggtgtcagctcgggcttgggcagctccggcactgggtacggcacctcaggtttcgggagctcagggacggctgtcgggtgcggtggcacctcgggcttgggcagctccggcactgggtgcggcacctctggtttcgggagctcagggacggctgtcgggtgcggcacctccggtttcgggagctctggcacggccgccgggtgcggtgtcagctcgggcttcggctgctccggcaccggatgaggcacctcaggcttcggcagctcggggacaacggccgggtgcggtggcaactcgggtttgggcagctcaggcggcacgacgtcggtagggtgcggcggcagctcaggttctggcagctccggcacggcaggatgtgggtgctcctccttgggcggcgcctcttccagcaaccgcgccgcgctgctcatgccgctgcagctgagcagcagcgccaccaggagaagaagtgaaaacacggtgctcctggaactcgaagccatgattggttggatggtttacactcgactgtgtgctctatttgcttcttctttcttgaagatcgagctgagatcccggccggcctcgagggtcccaatgtttatagccttcagcgaaggcttgagctctcgtcgtctcagaggctcagagctggtagtaggtcatctgcatcgatgtggttgtttaccttttcgtccttggcgatgctttcttgatctggacttgtgtgtatggtttggttaattagttgggaatactgagacgacctgagtgatctggttggtcgatgcagcggcgataatgcatgctgtacctacacgtgtgccacgtatctcatccatcagcagttgtgtttggctaccggattgcgcaaaggtgtggacttgcagtcctgcatgccaagaaccgactaagaaagagaccaacatgaatacatctatgctctaaataaaatacttaagcgatcctgttgaaaacgaccctaacactccataaatttattcaaagcaccatctgctactttttatatgtggatgaatatgagctaggctgacgacgcggtgacgtctaatattcaaaagttcttatctttgcatgaccacttgcctgttcatattgtgaaacgtacaatactcatcgtagcgatgttttgaaattttgtctagtcaccaatcgcttgatatggttctttgtttctcgcactcaagttttttctttttgtgctgcacctaaaagtgcgcttgacatatgtgttgttaaaaaagggcaaaatcatcattttagtcccttaactatagt

SEQ ID NO: 24372 - DNA, 1162 bp, Zea mays
tccaccgcgggccctttttttttttttttttttatataacacaactagaattctttattcattcagatatacatatggatccaaactgataggtactactagcttatcacatgtaagctctctgactcgtacggaagaacacaacatcacaaatcatatatagctactatacaacagacacgtacgtgtgcatgcgggaaaatgtgcagataaccgagtctcggaccgtacgtccgctcatggtttcgcctccggctccgggtagtggccctccggcttcggtggcagctcagctttcggtagaggcggcagctcgtggtttggcacctccggaacctctgggtgcggcagctctggcacggtcgggtgaggagggagttcaggctttggcagctctggcgcgactgggtgaggcacctcaggctttggaagctctgggacggccgggtgaggaggcagttcgggcttgggcagctccggcactgggtgcggcacctcaggtttcgggagctccgggacggctgtcgggtgcggtggcagctcgggcttgggcagctccggcactgggtgcggcacctcaggcttcggcagctcgggcacggccgccgggtgcggtgtcagctcgggcttgggcagctccggcactggatgcggcacctcaggtttcgggagctcagggacggctgtcgggtgcggtggcacctcgggcttgggcagctccggcactgggtgcggcacctcaggtttcgggagctcagggacggctgtcgggtgcggtggcagctcgggcttcggctgctccggcacctgatgaggcacctcaggcttcggcagctcggggacaacggccgggtgcggtggtaactcgggtttgggcagctcaggcggcacgacgtcggtagggtgcggcggcagctcaggttctggcagctccggcacggcaggatgtgggtgctcctccttgggcggcgcctcttccagcaaccgcgccgcgctgctcatgccgctgcagctgagcagcagcgccaccaggagaagaagtgaaaacacggtgctcctggaactcgaagccatgattggttggatggtttacactcgactgtgtgctctatttgcttcttctttcttgaagatcgagctgagatcggaaagcccggccggc

SEQ ID NO: 24373 - DNA, 828 bp, Zea mays
ctcgagcccgcccggcccgcaggcaggcagccacacgcgcccacaccacacttgagttgagtggcagcaatttggctgaacgcccaccggagaacaacgcacttgtgttgcgtacgtcggtcacatgcattgcatctgcatccggagtagcgagttctagacacagcaggcaacagactgaggtagcccagcgagcgagcgagcaatggcaaccctcagcgccgcccccctcgtcggcgcggccgccgtcgccaggccgtgtcaggctcaaggtttgccgcagctgagggtgagagccgagaaggcgaggtgcggcgccgcccactcgaggcggccgagccagcggcgggacggcaacaacggcgcatcgtcgtcgcttctggccgtggccaccagcgcggtgaccacgtcgcccgcgctggcgctggtggacgagcggatgtcgacggagggcaccgggctcagcctggggctcagcaacaacctgctggggtggatcctgctgggcgtcttcggcctcatctggtccctctacaccgtctacacctccacgctcgacgaggacgacgactccggcctctcgctctgaactcatccgtcgattattcctagctactgtattttttgttcagcctgacccgtgagttcgatcgatctatgcatgcgttggtgcagacgaagcttaagaccgtggttgtatgcgaccgtaattcagttgttgcatctcagatggtaatgataatgacgagtacgtagaaccattccagcaaaaaaaaaaaaaaaaaaggcccctagggccaaaaaaaaaaaaaaaaaaaaaaaaaaact

SEQ ID NO: 24374 - DNA, 2148 bp, Zea mays
ttttttttttttttttgtaggttttaaaattataagatatataaaaatagatatgaaatagacatatacataataagagaaatcagcaccatggcccgtatcttgtaaatatgaattgcaaacacaaaggaagaacacacaaaagcacacaatatgaagtccaaaaactcgtgttcaacaaacacatactgcagctttccatctcccagtattcggtagacccatgatttttcgctcagtgaagcatacgctgtgggaccaggtgccgaataggccaagactacagctttcaagaacttgtattttacaaactatccatccatcttgagtgaactcagccgtcttgttctttgatcaagctcagccaggacaacagtctcctgctttttcctttcctttgtgattgtatttgttggcattgaaccaatcttgtcaaacgcgaatgtcaggagttcatcagggtcatatagatgatgtgtggttgtttgcaaaatatcaatcacatcaccgatatgttggatgcgcagtagatcatcttctcgcatcttgaaaattgcgagagcaacacggaacaaaacattggctccttcattgaataatatatcccatacccgaagtgttgtctctgaaggcaggctctttgagaagaggcacaaaaaccattctgtagcaacaagtgaaacatcaaaccccattgcttcaaggtgagcagcaatccttggacacttcttagccaggagatctttgaacaccctctgctcgacatgacatccagaaagagtgtcagtatagcaatcactgacaagtacattctcaaggagtacagcaagcatccaaaatgcatcctcctctgtcttcatcacaagcaacaagagtgcagctacatagtttagaccctggcagtacccaacttctgaatcacggaatgagtaccccacaagtactcgccgcagagatgcctgacctttgtcactgttcaaccaaggatgacaagggaaagtgcgaggaagatcatgatcgatttgccttgtggctggtgtggttttcccctccgtagcacgaattagctcatcatagtatgtttctggcaccgttgaccgcttcttggctgctcctgacacagataaccagatctttggcctcaacaccggggggacacctttcctgatcaacctcctcaatgtaattgtattagtgagcactgacaacttgagtgatgtgacactgatcaccccctcgtttgaagaaatctttggttggagataccaatttgcacccttgcttgcctccagcgcccaccacaccctgccttgctccctgatcctctcccgcacctcgttcagcacattgacatcgtccacattgccctccaccatgaatccatacaggtcttcaaacttgacagacatgaggtgtacattgaacaaactcttgcctgtgttgtacataatgttgtggttgttcatgggcattgagacggtgggtgtgttccttaatgtcctcctccaggagttgaaatcttctgccacatccctggtttggatcccaaacatgttctccacaaatttcaccttttttttgccaggcttcttctccagctatttatttgctaataacctacaccaaaacaaaacctgtgtaatatatctaccaatctacacccaaatctttcctcccctcttcttagacgtttcttgcgttcttggtttccttcgtaatcctggacccctgccggctgcaagaacgctcacagatctttcctgctctgctgatttattgaagaagaaccaagaagaggagcggatcggctcggtcggtgctgctcgcccttgtggattaaagtcgaaggcaacaccgacggccgcagattgggagcagcgacgacgacgacgaccagctacggcaacggctaaaaatgggatgactccttgctctctggccctttttgaaccctatttttggaggcctatggctctcattgaaatcggacaccaggagctccatttccatcgccagcataatcgaatgtcgaaagtttttgatagtagtagttgttcccgcaaatcgcaactgtggattgctagcggctttcttgccaatttggtgaaagggtcccgctcaccggctcagcatacgggtttattattg

SEQ ID NO: 24375 - DNA, 1628 bp, Zea mays
  misc_feature (1575)..(1575): n is a, c, g, or t
  misc_feature (1579)..(1579): n is a, c, g, or t
  misc_feature (1592)..(1592): n is a, c, g, or t
  misc_feature (1594)..(1594): n is a, c, g, or t
  misc_feature (1605)..(1605): n is a, c, g, or t
  misc_feature (1612)..(1612): n is a, c, g, or t
  misc_feature (1615)..(1616): n is a, c, g, or t
  misc_feature (1618)..(1618): n is a, c, g, or t
  misc_feature (1622)..(1625): n is a, c, g, or t
tcgtaatatctgttttaccgattgattttgtgtgaacaggggatggtgcaaattttggattgggtattgctgctattgggggcggcgtggataatggaagactggaaggcatttctcccagctgctgcattcttctccacctgagctaggccatctctgatataggttctaaacgcttcactagcattctgaagctgagcaaatatatcaacctttgggtagagctgagttatccgatacagttcatagaggccaatggtacatgtttgcttgtcaccaattttcttgaaaatagcagcaagctcttgcttcaattgcgcgtcagctgagtgagtagatggatttggattgttcgatgcagcatcaccccagtgagtttgacccataggccccgatggcgtcaacattctagcggctgcaagggtctggagattgagatcaatgtatgctagaattattggctgaggttcagcatctataggaaccattgaaaggtgaccctttattgccgttccccgaagcttcacaagttcatgcaagacagttttgaccattctcaatggcttgtcatcagcaccagcccttctccgtatttcttccatcccaagttcttgtaaataaatatggatgctctgaagaattcgatcaaggtcaacttcatatattgtactctgaagaaccttcgtcaacttaattaaacatttgacaactaagtctgaaaacttctgattttttacagcaagagactccattggtgtaggcgatggccatcttgaagggtccaaaggcctcagcaaattaatcagcacaacaaacgaggatgttctctcagcattatccaagattttaagcatcaaaacatttagtgctttgagtaattggctgccatcatccataagaggaaccctttcatctaaaagccaaagaagtaactccgtaataaggttgtcaagggtaccctccttcacagcatgagcaagacgtttgatctgaaatgtctgcatgagtgtgtttaacacatatttgcaagaccttgaagaagcaccagataagctaaaattgaaggttttcggaaccataacagccaagcatgacactaatctgtcagcttccttaataagatcttcaagcaatgtgctttcagggtcagctgcctgtgttagctcatggcatataactttcataccttcaacggactgctcaggcaaacctaatgcaactatctcgagagcttcgcgccagtccacaggaccagttgtacttggaatctgcctaggtaccatgtgcctatccatatgagcatctgcatatccgaagtcccttgagatcattgatccagccactggacgggacactacttctccgctttgttctgctatatcagacccattctccctaactgaacgcctcagagctgctcgtgcatcaccaggccttccttctcgccttttatccatttctcttgccttccatttaaacctatcatcgagcatgcttctttgggcatcggggggggggcggggggggactatgagctctctctctccctgcagcccgggggatccagctagtggntttntcgtgcccccccnanaggaagggggnttttttnccnnancagnnnngtc

SEQ ID NO: 24376 - DNA, 1392 bp, Zea mays
  misc_feature (1382)..(1383): n is a, c, g, or t
ggccgcttttttttttttttttgcatttcaaaaaccatatatttcacaagtaacatttccagttaatttagaatgaaaaattctattgctgtacaccacaggaaaaccaatacagtacggcaaaatgtgtcaacactaattagcccttggagtagcaacaaggaaaacatttggctacctcttatctaaaactgcatccaaaggctctgcaagaatggcttgacacatgggttacgaaatgttgaccccgtgccatatagttcttccgacattcaaatacctatctacaaagaacaccatcactatgcctcaaatttacaaagaactacaatagttggtatttctcagaattgttatcgtatctattgtaattccatagacccactctttagtctctccattcgtgcttgcagcccagatagagctcgctcatccatgggtggtatattacttcgttgttggggttcaccgtccaatcgagttcccccatgcaccatattacttccgttcatacttgccaacggccgagcctgagcaccgtcaaaatgacctatagctgccgcttgaatgcttttcatcctttccctaagagcatccaacgtgcctgaggtatggtatctatcagtttgttggtcggtgatggcaccttgacctctgaagggttgtgtctcaccactggcattatcttcgttataatctgttttaccgattgattttgtgtgaacaggggatggtgcaaattttggattgggtattgctgctattgggggcggcgtggataatggaagactggaaggcattcttccagctgctgcattcttctccacctgagctaggccatctctgatataggttctaaacgcttcactagcattctgaagctgagcaaatatatcaacctttgggtagagctgagttatccgatacagttcatagaggccaatggtacatgtttgcttgtcaccaattttcttgaaaatagcagcaagctcttgcttcaattgcgcgtcagctgagtgagtagatggatttggattgttcgatgcagcatcaccccagtgagtttgacccataggccccgatggcgtcaacattctagcggctgcaagggtctggagattgagatcaatgtatgctagaattattggctgaggttcagcatctataggaaccattgaaaggtgaccctttattgccgttccccgaagcttcacagccaactgactccagaatggcagtcaaatcgtcagcggaggggctggcgttcccagcgaggacagcaagcaggtaggcagcaacaaacttcatcgtgctccgaggaaccggtcgactgctaatacctcgagaggagagggactaccgaactgctagggttttttttnngattaggat

SEQ ID NO: 24377 - DNA, 1111 bp, Zea mays
agaacttaaaagtctattctgtacccccccagcaaacttaatcaggtcggccaaattttgccaccctcattaagccttcagataataacttcaaaaaaaaccatttggttagtttttgtttaaacttccaatcaaagcccccccaaaaatggattaccttgccccaggggttacgaaatgtcggccccgtgagacgtacttcttccgacattcaaatacctatctacaaacagcatcactatgcctcaaatttacaatgaattacacgcgatggtatttctcagtactgttatcaatctatagtaattccatagacccgctctttagcctctccattcgtgcttgtagcccagagagagctcgctcatccatgggtggaatattactttgttgctggggctcaccgtccaatcgtgttcccccatgcagcatattacttccgttcatacttgccaacggccgagcctgagctccgtcaaaatgacctatagctgcagcttgaatgcttttcatcctttccctaagagcatccaatgtacctgaggtctggtatctatcagtttgttggtcagtggcgtcaccttgacctctgaaaggttgtgtctcaccactggcattatcttcgttataatctgttttgctaccaattgattttgtgtgaactggggacggtgccaattttggagaaggtattgctgctattgggggtggcgtggacagtggaagactagaaggcgttcttccagctgctgcattcttctccacctgagctagcccatccctgatataggttctaaatgcttcactagcattctgaagctgagcaaatatatcaacctttgggtagagctgagttatccgatacagttcgtagaagccaatagtacatgtttgcttgtcgccgattttcttgaagacagcagcaagctcttgcttcaattgcgcgtctgctgagtgagtagatggatttggattgtttgaagcagcatcaccccagtgagtttgacccataggtcccgatggcgtcaacattctagcagcagcaagggtctggagattaagatcaatgtatgctagaattattggctgaggttcagcatctatagggcca

SEQ ID NO: 24378 - DNA, 1363 bp, Zea mays
tttagcgctttgagtaattggctgccatcatccataagaggaaccctttcatctaagagccaaagaagtaactccgtaataaggttgtcaagggtaccctccttcacagcatgagcaagacgtttgatctgaaatgtctgcatgagtgtgtttaagacatatttgcaagaccttgaagaagccccagataagctaaaattgaaggtttttggaaccataacagccaagcatgacactaatctgtcagcttccttaataagatcttcaagcaccgtgctttcaggatcagctgcctgtgttagctcatggcatataactttcataccttcaacggactgctcaggcaaacctaatgcaactatgtcaagagcttcatgccagtccgcaggaccagttgcagctggaatctgcctaggtaccatgtgcctatccatatgagcatctgcatatccgaggtcccttgagatcattgatcctgtcactgaacgggagactacttctccactttgttctgctatatcagacccattctccctaaccgaacgcctcaaagctgctcgagcgtcaccaggccttccttctctccttttatccatttctcttgccttccatttaaacctatcatcgagcatgcttctttgggcatctgagagttttccaacatatcgccatacatcatccccaaggttcttgtaggctgttgcaagcgtattaagggcagctttcctaatctcaccatcacgctctgctgtcagtgctgcaacagatggcaagtttttcatcaacccaccaacctcggtcccatgatggtcaatgaaatatccaataatatcaacacattctatccttgtccggttattcttggagcggagcccctcaagtatatagggaagtagtttgggaagagagtaaatgttgaccatttgctttatcagctcccccattttttccctgactttttcaatgttatgaccagacttctctatgaggcaaggaagaaaaattgcagcttcagcttctgtcaacatgtatgactggtcttttaaaatatcaaaaagctcaggaagaaagtcaagaaccttcaacaaacatgttgtgttagattcacaaaagcgtaagacaaaccaccttaataatatgtcaagaagttcaatcacttctttccaacttgaaggaagtgccttttgtagcaattcaataccatcgatttgcctcttaaagtctgagttccataatcgcaggcttacatcttctcggaaatgcttaaacaaatcaatctttagttcatctatctgttcacgacgtggttcttcgaacttgaattttcttaccaaaacacgtctctcccgctcttccttgtttg

SEQ ID NO: 24379 - DNA, 1663 bp, Zea mays
ggccgcttttttttttttttttttggtctaaccatttcatttgacattccaacactaacaattttccacaccgaccactaagccggacgaatatacattcttttaaaaacatatatttcacaactaacattttcagttaatttagaacttaaaagtctattgctgtacaccacaggaaaactaatacagtacggcgaaatttgtcaaccctaattagcccttcagagagtagctacaaagaaaacatctggctagctcttgtctaaaactgcaatcaaaggctccgcaagaatggattgacctggcacaggggttacgaaatgtcggccccgtgagacgtacttcttccgacattcaaatacctatctacaaacagcatcactatgcctcaaatttacaatgaattacaacggatggtatttctcagtactgttatcaatctatagtgattccatagacccgctctttagcctctccattcgtgcttgtagcccagagagagctcgctcatccatgggtggaatattactttgttgctggggctcaccgtccaatcgtgttcccccatgcagcatattacttccgttcatacttgccaacggccgagcctgagctccgtcaaaatgacctatagctgcagcttgaatgcttttcatcctttccctaagagcatccaacgtgcctgctgaggtctggtatctatcagtttgttggtcggtgatggcaccttgacctctgaagggttgtgtctcaccactggcattatcttcgttataatctgttttaccgattgattttgtgtgaacaggggatggtgccatttttggagtaggtattgctgctattgggggtggcgtggacagtggaagactagaaggcgttcttccagctgctgcattcttctccacctgagctagcccatccctgatataggttctaaatgcttcactagcattctgaagctgagcaaatatatcaacctttgggtagagctgagttatccgatacagttcgtagaggccaatagtacatgtttgcttgtcgccgattttcttgaagacagcagcaagctcttgcttcaattgcgcgtctgctgagtgagtagatggatttggattgtttgaagcagcatcaccccagtgagtttgacccataggtcccgatggcgtcaacattctagcagcagcaagggtctggagattaagatcaatgtatgctagaattattggctgaggttcagcatctataggaaccatcgaaaggtgaccctttattgccgttccccgaagcttcacaagttcatgcaagacggttttgaccattcttaatggcttatcatcagcaccagcccttctccgtatttcttccattcccagttcttgtaaataaatatggatgctctgaagaattcgatcaaggtcaacttcatatattgtactctgaagaacctttgtcaacttaattaaacatttgacaactaagtctgaaaacttctgattttttacagcaagagactccattggtgtaggcgatggccatcttgaagggtccaaaggcctcagcaaattaatcagcacaacaaacgaggatgttctctcggcattatcctgtttaaaacagaaccattaaagaaagcacaactagagcaaagggacccggccgg

SEQ ID NO: 24380 - DNA, 1659 bp, Zea mays
gcacgagctagtcgggactctttttttttttttttttactgaatagacagtattattgttatataaaaaagaataatgtaagtttctcgaaaacatagaaggcaagtcatttattaggtgccgcagcgtaacaaaagaacaaaatctaaaggctcggcttcaaaagcccaaaagtgagctccaaaaattgaagaggattcctttctcttaatctatcaaaattgaagaaaattcagcctgtctagacagtctagtattattattcgtaatacttccatctcctattagttctggatctcacaaaattccttgcatcttttctggactctacacaggattgtcggtaccgtatttgaaatgaaaaaatatttatcctttttgaatagtttcgagtggtgggatttcatatctggaatatggtatgagaataatgctgccttccaaataataacttcatttcagtacatttgaattggagatccatgacaattttcttttgggtactaatgtcataattagatgctttagaatttgcataacctagttgccagatgaaacaacttcagcaaaggacacacttgaaggcctgaagatgtcattctctctgactactttgttatagacaagcttaaatgagcgtgacccatatgtcttgttaagcaaacttattgggattctcagagtttgtttccgacggcttttcccctttacatatatcctgaaactaccttcatcatgcttgttgtcttcttgcatttcaggactcagttcaattctagtggcatcctttaattgtttatcttgatcatcatgtttgttgcttatcaaattgccacttactgccactgcaggagtctccatctcctctttggccactacagcgctactgtccagtgaagggcctatactaacaacagctgcatcagattgaatatgcttatctgctaaagattgagaaataggatcaacaacatgtggtgtgggaatgaagtcaattgtatggctacttgaccatgccgacattggcacaaattctgatggcgctgggcccatataaggttgccatccataatggttaggccgaaaaatattagtgttcatgggaaatgtggtgtttggaaccacctgtggttgactatatggtggataaataaatggcacaggatgcatgagattaggagatcggggagcaggagggtataaatgatgaggggaagtgcacaaaggaggaccacttggcaccatagttgaatgcccaggatgcagggatacattcacaggccaaggtgctactcctggaatggcacctggtggcgggagaccaacattgccagaaagtgggctaagtacagatggtggagatggattaaacggtggtgcagaagcagatagcttcttattaggcatctctctcaaatcaatattacttagcactaagttaggcttggacttctcacttccatcacctccaagactccctgtgtttgtagtagatgctgaaactgaaatattttctatactgcggggtagagcttcaaaaaaatccgtatcagacttctcagtctgttcagtttttacagatccagttggctccgaaaaccccggcccgcctccagcattgctactacttgatagttcttgacttgtgttacttaacac

SEQ ID NO: 24381 - DNA, 1556 bp, Zea mays
aattctgatggcgctgggcccatataaggttgccatccataatggttaggccgaaaaatattagtgttcatgggaaatgtggtgtttggaaccacctgtggttgactatatggtggataaataaatggcacaggatgcatgagattaggagatcggggagcaggagggtataaatgatgaggggaagtgcacaaaggaggaccacttggcaccatagttgaatgcccaggatgcagggatacattcacaggccaaggtgctactcctggaatggcacctggtggcgggagaccaacattgccagaaagtgggctaagtacagatggtggagatggattaaacggtggtgcagaagcagatagcttcttattaggcatctctctcaaatcaatattacttagcactaagttaggcttggacttctcacttccatcacctccaagactccctgtgtttgtagtagatgctgaaactgaaatattttctatactgcggggtagagcttcaaaaaaatccgtatcagacttctcagtctgttcagtttttacagatccagttgactccgaaaactcaatggctgcaccatcattgctactacttgatagttcttgacttgtgttacttaacacattggcatcttttttactatttacaggctcacttccaattccagattcctcagcctttggtattggcaaatcttgtaccctgtctttgcacagattctcaatctccagttccccttcagagaattttgtttcttctaatttctggagttttcctagcacattggtttcttctttagaattattggtatttgcagagacaggtccctgttccacttggagtgaatcaaccaaagaatctttcatttcttgtgcaataatctgaccaagtgatggttggttctgtggtacatcgtctctaggtttctgtatttgagtcttggcaattgttccaggccgtgctagtgcaacatctttgtatgatggagcatttccactacttgcaactaaagttccatgtgactcacttcctttgtgatctgttgaggtaggattgtgtgcttgtgagtttgctacctgtgattctgctttaccactcatctgctctgtactcttaaaagtatctagcacctctgttgttgcagtcgctggcttaacccgataggtcacagccttgtaaatcttgcgaccaaacctggcaccaaatgtctgaactttcacatgctgttgaggatctgtgtacgttgtaggtacaactgttctcttccttaagaaataataccggttatttgaataggaattccttgccttgtattgtgaagtatatgttggatcatgactatcagggtcatacacctttctggtggttgggcgataatgtttcatctgttttcctgaacccccagctgttttaggtctttgaacaggctgccaaccatcttcaggttctgaattttcaacttcaataacttccttaggtgcattacccggcgcccctcctgtctctacccgtggctcagaaggtgctggatgctcaaatgattcaggagt

SEQ ID NO: 24382 - DNA, 4086 bp, Zea mays
tcgggcgaggcggagcttcctgttgcgcctgaggctgatattggatgttgtcagcctcaccctggcgggtggcacaacagtcggagaggggcgagcggcgttgtcttcctgttaggtcggtcagtgggagggcgaagtgactgcggtcacttcgaccttgccgactgaggcacgtgtgtcaggataaggtgtcaggcgatccgcgcattgaatgcgtctgcgatacggtcggttggtgaggcgatttggcctaggttgcttcacaacgaagtctgcccgagctgggcttcgggcgagtcgagggtgcgcccgttgcttgaggaggccctcgggcgaggcgtgaattcgcctgggactactgttatcgcccgaggctgggctcgggcgaggtgagattgcatcccttgagtagacgaagctttgacctgaattgcgcccatcagtctctgcagcttgtgttgatggtggttaccagccgtgtttaggagtgttgggggtacccctaattacggtacccgacagatcctgacacgtacatggttcgcattcggtttgctttctaaaaccgggtgtgacacataaccagattgagaatcaaacccacactctatgatttttactcgtggtcacgcatgtaaaatgttgatgttgccatccctatacaacaccacgaggaaacaaagcggcatagaaatttaaagcgtcttagtaatttttatggacatgctattaccaaaagataatgtaagctgacttggatagctcttatgcatgcgttttatcccttccatagaactttgtttgttttatttccatgaaaaggttaacttgtaatgttatttgtattgtatatcttgatcttcttctatatttaaatttgtagtagatctctactattataatatgagaataattgtgtgtcctcccctcacgcaggcgaacgctacctctccccttcactctatttaaaaaaaatgcacgccaaatttgttgtctaccattgtactgtgaaactgcttgtgtcacaagaagcttttaaatatatactaataatttaaaagcaaaaaaatataatcatgctttattaaatatttatttaaatataatttatatgatatatataaatcgcagcaacatacaaccaaactaactattatcttttatgtatcttcggtcaaatctagatcgctatagatgtggtggtgtttagcacttgagagcgacaaaaattatagcaacgcactgttttttttaaatatatgtgcaagcaaagaaacccgttgagcggccccagtcgtcattgagtccagcaagagcagatcaacccgaccgctttctccacccccattgcccatttgcccccaaggccccaagcccccaacacggcaacaccgcaccacgaccacggactaccgtctcctctcctttcctctcctgcaactgcaagcgaccccccctccacccccatccacccacccgcccgccgacgcttggatcccctcccttgtttgccgtgtccccgcccaaaccccgtagccgccgccacagcaatcgctgccgccgccgctggaggccgggccgtgggggctgaaatgaaggaggtggtgctccacgtgtatgacgtgaccaacagtgactccgagaagacgaacaacaccatcctccagatcaaccgcatcttcaaggaccgcatcggcctcggcggcatcttccacagcgccgtccaggtagtgggcctggctcccctctcccccttccctcgccaatcgctcagatcccagggaccgacgcttgcgtgccgcttctccagatccctaaatctcacgccatttcttgaacccctcaacgcaggtctatggcgaggacgagtggtcgttcgggttctgcgagtccggcagcggcgtgtttagttgccccataggcaagaaccccatgtacacctaccgggagcgcatcgtcctcggggagaccgagtgcggcatcgccgccgttaaccggatcctgcgggagctcagccgcgagtggcctggccactcgtacgatctcctctccaggaattgtaaccatttctgcgacgtgctctgcgagaggctcggcgtccccaagctcccaggtaagaccacggaggggcattccatggtttttctttttctgaatggcgacaacctgtgcaaggtgcatctcatagtggcattatgtacaattctcgagttgaaaacacacgcactatgtcctcgaattggtaggaagattgcaggttccaatttacatggctatttacattcttgctaggaaaagaatgaacaaactgaatgagcgaatgtgtaaactgaacattgctgaagcatgtgtttgctaccgctgaagtattgagcaatttaactggtgttatgtgattatcacacttgaagctttgataatagggggttcatgtatgaaactcagtgctgctagctttaagactcaactttggagcataagaccatgtacaacacagacgtttagcaggctcttagagtcagtttcattgttttccttgtgattgtggaactgagcacaagcgcattgcaggtgttgccccttgatgagttttttgatggctgccttgaaacttacatgctaggtggatgtctcccaagaacagtaattagctcaattattacattacctctgctaaaccgtttagtctgcatttgagacaaggctcttttatgtgtgcttaatgattcatgtcctaatgcgccaacttttgtgacaatttgaggaggtttagattcctaggtcaagtctttgcctgacatttctgatcatacaacaacaacaaaaccttttagtgccaagcaacatagggtagtctagagttcaaagttcgaaactgaacaaaagccacatatcaaggtccagatacgtggatagctgattttggtttgctcctattcaaggctaacaacattcatgatcataatgttgaattattgaattttgatctatgtggctagcaccagaggcctagcatgattgtgtttcttaggtttgaaatgccatgaacttactcttttattctgtctaaccttgcaggttgggtgaatcgctttgccaatgccggtgatactgctgtggttgttgctgagaacacagcagttaaggtaatttcagaatttgttgctgtgatacaatgtgttatctccaatttgcttaatcctagcataaaatttatgattgctccttgcttttttattatttttcctagtctatcactcatgttttagacctctgttttccccaccaatgcaaacatcccttatatttgtgtttgcatttttcttttgcacgtgttaggtttggagctttaaatatcgattatgtgcatagggatttctgttttatctatacctttctgttttatcgtcattgttttccttgtgaatttatgtattgcagttcaggcaggctaaaacagaaatcgtgaatgccagtagagtagcatacagatttatggcaggcctgacttccaaaaatcaagcctcacctgagtctccgggtaacaatcaaaacagaggcagccctagtttccagggagcttggttcaagaacatcgtctcagctggtgcaaagccttcatcgagtggatcgacacgcacacattttcaggacgctgatgatggaacccctttgcaacatcaaagttcaacagagcaatcaacacagttgtagttgcttcccagcatatcaaccaacaattgaattgaatctgtcaatctgttgtgtaacattagctaatatctgttcgaaacctgttgttaaattgtatcagtagtgtaacagttgctgagatttgttcaaaaactgctattttgcatttgtccgtgaatcagttttttgcatcattgttgaagatgaacgctctgatgtcatgcgtagctgctaatctgttttcaaggttctgtttagcacattctcatggactgttttttttaaccaaacattgttttgaaacagcttcataggtgaagctaccaacagtttcatgagcttttttttatcaaacttcaaattagcttcacgtttcatgacctgtttttttac

SEQ ID NO: 24383 - DNA, 1237 bp, Zea mays
gccccccattgcccatttgcccccaaggccccaagcccccaacacggcaacaccgcaccacgaccacggactaccgtctcctctcctttcctctcctgcaactgcaagcgaccacccctccacccccatccacccacccgcccgccgacgcttggatcccctcccttgtttgccgtgtccccgcccaaaccccgtagccgccgccacagcaatcgctgccgccgccgctggaggccgggccgtgggggctgaaatgaaggaggtggtgctccacgtgtatgacgtgaccaacagtgactccgagaagacgaacaacaccatcctccagatcaaccgcatcttcaaggaccgcatcggcctcggcggcatcttccacagcgccgtccaggtctatggcgaggacgagtggtcgttcgggttctgcgagtccggcagcggcgtgtttagttgccccataggcaagaaccccatgtacacctaccgggagcgcatcgtcctcggggagaccgagtgcggcatcgccgccgttaaccggatcctgcgggagctcagccgcgagtggcctggccactcgtacgatctcctctccaggaattgtaaccatttctgcgacgtgctctgcgagaggctcggcgtccccaagctcccaggttgggtgaatcgctttgccaatgccggtgatactgctgtggttgttgctgagaacacagcagttaagttcaggcaggctaaaacagaaatcgtgaatgccagtagagtagcatacagatttatggcaggcctgacttccaaaaatcaagcctcacctgagtctccgggtaacaatcaaaacagaggcagccctagtttccagggagcttggttcaagaacatcgtctcagctggtgcaaagccttcatcgagtggatcgacacgcacacattttcaggacgctgatgatggaacccctttgcaacatcaaagttcaacagagcaatcaacacagttgtagttgcttcccagcatatcaaccaacaattgaattgaatctgtcaatctgttgtgtaacattagctaatatctgttcgaaacctgttgttaaattgtatcagtagtgtaacagttgctgagatttgttcaaaaactgctattttgcatttgtccgtgaatcagttttttgcagcattgttgaagttgaacgctctgatgtcatgcgtagctgctaatctgttttcaaggttctgtttagcacattctc

SEQ ID NO: 24384 - DNA, 1511 bp, Zea mays
accgggccccccctctagttttttttttttttttttaaccacaagtgaggaaactactgcggtgtgatgcgtccatatacatacgcagcaaacttcttcgtactaccagataaacaaatacacggtaacagaggagaggatcccttcgcttcgcctgtatcagtagaaccttttttttttgtttgccagcctacggaagaacggtcctcacctccttcctgtctacaccaaacgactccaaaccgcagtcattaacataaacatttgtgaagagctcagatggatcaggcagtggacactccttcgctttagcaatggcagcgtcgacttgcttcctgatctccttctccatgtcctttagctcttgggccgttgcgaactcatggaccaacatgagcttcctaaccctttcaattggatcacgctcctgccttatgccagcgatctcatcccttgtgcggtaggtgctacctggatctgacattgagtgcccgtggtatctgtaggtgtccatctcgaggataattggcccattttcaagggcatgttctttggcaaatttgcaagcttgctttacagcaagaacatccattccatcgacctttaagccaggcacatagtccccgcgcttgtagtaagccgggctcttggaggccctccactctgccgtccccatcccatagtggttgttctcgcagaccaatatgacaggcagcttccagagcgcggccatgttaagcgcctcgaagagctgtccctggttggcggcgccgtcgccgtagaggtcaaacgtgacggtgccctccttcctgtacctctgcgcgaaggcgatgccgcacccgagcggcacctgcgcgccgacgatgccgtggccgccgaagaagttggcgtcccgcttgtagaagtgcatggacccgcccttgcccctggagcagccgtcccggcggcccatgagctcggcgaaggcggcgacggggtccccgccgcgcgcgaggtacgcgcagtggtcgcggtaggcggtgatgatggcgtcggcgcgggtggcggcggcctccatgccgacggcgacggcctcctggccgtcgtagaggtggcagaagccccggatgagcttggccttgtagagcgagtccgccgcgatctcgaagcgccgcatgagcgacatgtcgcggaagaaggacagcagctcccgcgccgaggtggtggcctcgcgcggtggcgggtccacgatgtgggacttgaagggcaccgaggtgtcaacggtgaccgcgtccgcggagtcggagaccccacgcgcgagaagcggcagcggcgccacgagctggctggcggcggtggggacaaggcggcggagaatggccgcggccatggcgtgcgcctacaacgggaactcgaacagagcggggcgaggacgcgaggtgcgtgaaacgtgtaggtgtcgagcgagccgctgggtggtgttcggcggagtggcggcctggcgggcccggccggcctcgaggtacccaatg

SEQ ID NO: 24385 - DNA, 820 bp, Zea mays
  misc_feature (768)..(768): n is a, c, g, or t
ggccgctttttttttttttttgatggacttgacaatggtgtgtcacaacgacacaacgtgatcactattgttttcgtgggggcactgttcagaaacagctatagttaacaaagaaactgttttgtaactaataaaaagctattagccgccccctagctaatgcagccaactactactgtttacgtgggggcactgctcagaaaggggatctgtggaagtgttgcagtagagcagaagacgaaacatcggcatgacatgagcacctgacaaaatctcggctgcacattgtgatagctcgacgagcagaggaaattataacccggggtccataggaccataaccacaagtgaggaaactactgcggtgtgatgcgtccatatacatacgcagcaaacttcttcgtactgtatcagtagaaccttttttttgtttgccagcctacggaagaacggtcctcacctccttcctgtctacaccaaacgactccaaaccgcagtcattaacataaacatttgtgaagagctcagatggatcaggcagtggacactccttcgctttagcaatggcagcgtcgacttgcttcctgatctccttctccatgtcctttagctcttgggccgttgcgaactcatggaccaacatgagcttcctaaccctttcaattggatcacgctcctgccttatgccagcgatctcatcccttgtgcggtaggtgctacctggatctgacattgagtgcccgtggtatctgtaggtgtccatctcaanggataattggcccattttcaagggcagttccccggccggcctcgaggtaccc

SEQ ID NO: 24386 - DNA, 1847 bp, Zea mays
gcgtcccgacgccgccgccggaaaacagacacttccgtttttattgtccaccctccgccgccggcgtctctccaaaacccaaccaaaccctagatccgccgcactcagttccggtgagaccctcctttccagcgaaaatgccgaacctcgagtgccggatgtatgagcagcggttcccggaggtggacgccgcggtgatgatccaggtgaagcacatcgctgacatgggcgcgtacgtctcgttgctcgagtacaacaacatcgagggcatgatcctcttctccgagctctcccgccgtcgtatccgctccatctcctccctcatcaaggttggccgccaggagcccgccatcgtgctccgtgtcgaccgcgacaagggctacatcgacctttcgaagcgtcgcgtctccgaggaggaggcgcacgcatgcgaggacaggtacaacaagtccaagctcgtgcactccatcatgcgccacgtcgccgagacgctcgagatcgacctcgagccgctctaccagcggattggctggccgctctaccgcaagtacggccacgccttcgaggccttcaagctcatagttgccgaccctgacgccatcctcgacgcactcacctatgaggagaaggaggtcggcccggatggccaggaggtgactaaggtggtgcctgctgtcacccccgaggttaaggattctctggttaagaacataaggaggaggatgacaccacagcctctcaagatccgtgctgatatagagatgaaatgcttccagtttgatggagtgctccatattaagcaagctatgaagaaagctgaagctgcgggcaatgataactgtcctgtgaagattaagctagttgctcctccactttatgttttgaccacacagacccttgacaaggatcaaggcatttcagttctcactactgcagtcaaggcttgtacagcagagattgaaaagtacaaaggaaagttagtagtgaaggaaccaccaagagctgttagtgagcgggaagacaagctattcctcgaccagattgattccctaatggagcaaaacgcagaggtcgatggtgatgctgacagtgaagaggaggaagatacaggaatgggggacgtcgacattacaaattctggcgtcgctgcttactaaggctacactggttgatttggatgagctttgctgtacagcaccagctaagttctaagccgttctgtttggaagcagtttctttctgttaggttttggtgaattcgctgaaactcgttacctgcgttgttaatgttttgggctcagccggtgttggggtagcgtttacttctgtcgagaatcaccaattttttcttgggagtgaaaacaaagcccgttgctataagtgtttatattcacttcatatacgcaagtttggcttcgtgctgcctattcgaaaaaaaaaaaatcgctaggcttgcggctctgatttactagtaaacatgaccgtgccttgtcattagtgataggatgtatgatttttttcgtggtgctcgtgctaacagaaatgagcgagctacttttgttaaaattacttaattgtacatggtctaacgttaaataattttagggcttatagaaaatgttaatgtaataaagtattagttaccaacataaggttaaccctaaacatgtggtttacaaatttgaaaggtacagccttcggggtgtttgaatgcactagaattaatatttagctagctaatttcactaacaatttttagtcagctaactattaattatagtgtattcaaatactctatagtaggatcggatggactctagacccacttgggaagtctcattccggga

SEQ ID NO: 24387 - DNA, 1462 bp, Zea mays
gggaccctcgaggccggccgcccagcgcagcgtggccgtccgattcgttccttctgccaagcacaacacagaccatcgtctgcccgcccgcccgcccaactgcacccgccgccgtcgcctcccaaaacccaaccaaaccctagattcgccgccctcagctccggtcagaccctcccccttcgaagatgccgaacctcgagtgccggatgtatgagcagcggttcccggaggtggatgccgcggtgatgatccaggtgaagcacatcgctgacatgggcgcgtacgtctccctgctcgagtacaacaacatcgagggcatgatcctcttctccgagctctcccgccgtcgtatccgctccatctcctccctcatcaaggttggtcgccaggagcccgccatcgtgctccgtgtcgaccgcgacaagggctacatcgacctttcaaagcgccgcgtctccgaggaggaggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccctgaggttaaggattcactggtgaagaacataaggaggaggatgacaccgcagccactcaagatccgtgctgatatagagatgaagtgcttccagtttgatggagtgctccatattaagcaagctatgaagaaagctgaagctgcgggcaatgataattgtcctgtgaagattaaactagttgctcctccactttatgttctgaccacacagacccttgacaaggaccaagggatttcagttctcactgatgcagtcaaggcttgtacagcagagattgaaaaatacaaaggaaagttagtagtgaaggaaccaccaagagctgttagcgagcgggaagacaagctattcctcgaccagattgattccctaatggaacaaaacgcagaggtcgatggtgacgtggacagtgaagaggaggaagatacaggaatgggcaacgttgatcttacaaattctggcgtcactgcttactaaggcaacactggttgatttgaatgagatttgctgtatagcaccagctatgatctaaatcgttctgttttgaagcagtttctttttgttatgttttgatggttgaaatctcgttgaattcacagaaacttacctgaggtgttactgttttgggctcagccagtgttggggtagcttttacttagggatgaaaacggccggaaacggtatttattcggtaatcagttttttagttgtaaaaaaaaaaaaaaaaagcggcc

SEQ ID NO: 24388 - DNA, 1541 bp, Zea mays
cattgggtacctccacgccgccgggcggccgtccgattcgttccttctgccaagcacaacacagaccatcgtctgcccgcccaactgcacccgccgccgtcgcctcccaaaacccaaccaaaccctagattcgccgccctcagctccggtcagaccctcccccttcgaagatgccgaacctcgagtgccggatgtatgagcagcggttcccggaggtggatgccgcggtgatgatccaggtgaagcacatcgctgacatgggcgcgtacgtctccctgctcgagtacaacaacatcgagggcatgatcctcttctccgagctctcccgccgtcgtatccgctccatctcctccctcatcaaggttggtcgccaggagcccgccatcgtgctccgtgtcgaccgcgacaagggctacatcgacctttcaaagcgccgcgtctccgaggaggaggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccccgaggttaaggattctctggttaagaacataaggaggaggatgacaccacagcctctcaagatccgtgctgatatagagatgaaatgcttccagtttgatggagtgctccatattaagcaagctatgaagaaagctgaagctgcgggcaatgataattgtcctgtgaagattaagctagttgctcctccactttatgttctgaccacacagacccttgacaaggaccaagggatttcagttctcactgatgcagtcaaggcttgtacagcagagattgaaaaatacaaaggaaagttagtagtgaaggaaccaccaagagctgttagcgagcgggaagacaagctattcctcgaccagattgattccctaatggaacaaaacgcagaggtcgatggtgacgtggacagtgaagaggaggaagatacaggaatgggcaacgttgatcttacaaattctggcgtcactgcttactaaggcaacactggttgatttgaatgagatttgctgtatagcaccagctatgatctaaaccgttctgttttgaagcagtttctttttgttatgttttgatggttgaaatctcgttgaattcacagaaacttacctgaggtgttactgttttgggctcagccagtgttggggtagcttttacttgtgtcaagaagcaccgaatttttcctgggagtgaaaacatatcccgttgttatacagtgagtattcccttcgtcgtccaaagcaagtcctccccctgcactccaaacccgtcttcggttgtactcaagacacgccaaacaaaggttcctcggccgggaccaccctaataaa

SEQ ID NO: 24389 - DNA, 3735 bp, Zea mays
ggccctaccccccccctttttttttttttttgaacggaagatgaataatatatacataatgaaaataagggttcaaaaccgtagttaactttgaagttctgtcggttgcatgatcgacagtggaagcaggtgcatatacaagtgggactttgatagtcagagggagaaggatgtagaagtagtgatcgccattcagaaaaaacagcaatatgcaataaaaacaaagaataagctagtcagcatcacctcccagcaggcttcaccagcttaagtcagcagatatgcagctacatatctgatgtgggaactcattcactaaaagctatatcctgacaaagctgagctgagacagttgatgtcaacagagttcctcgaaagccttcctcagcctgtagcatatcatccttttgttctgaaatctcatctgcaatgtcacggttctcatatatttcagagtctctgacccagagaaaatccccaggaaaaatactcttatcagcaagagtagcaaaatcatcttcaatctcaacagagcctttgtgaagcatttggttctccttaacaatccctaaagattcccatatcatcagtttcaactgatagacagatgtagagccagagactttcaaactgattgagtttccagagcttgttctccgggaacgcttcgatgtccgacgatctggtacagtaacagctttagatgcttctttaatagactttggtgcttcttttccatggacaaagtaaacgtggatatcttcattttgatagttgagtttttccaccaatgcacagctctccctttcgccaatacattctcgggatcagttctgatataaggctctctggctcccaaatcatcgtttgtgtcatcaagagactggcctagatttccatccgtaatcggcactgcttcagatgatccatgcagtttgtcttgagaactcttgctaaaagcaatttcagcagatataccttttccaggtgtagcactccactcttcagagaataatttccaatcatactctgggattatggttaacccatcagtatttgatgctttctgaatgatgctcccacgctttaaaacaagatccaaaggcctttgcagcaatcttgaatgcttttcacatataagtgacctggcaacagcttccagagtttgaggttctggtaatgaagaaatgtttttcccagttgctgtaatataagctctccattctgacaaccaagatgaaggaaccaaataatatttttgaccaggatgaagcgcaaagcttttcccagatatcaacttttcatggttctgtcgttgcttgagtttcactgctctaagattaacctccacagaagcaacatcagacaattctcggctgcaggtttcacatggatgactatctgatggaaaagtcactgtatcatcagccttcttctcatggactgtttggtagagaaatagccagaggatctctggtacagatacccgttttgcccctggagcatgttctggcagaaaatccccatggcaacatcttaaagcacttgttggtccgttatccccatcagaagggatatcagcattttttctacgcagccaatgagtcaaccatgtctttgagataaagtaagaaggaccatctggacaattaccagcaagtgctgcttctgcgagtgttttcaatgatgctcttcgttcacggtaaacatcagcagatactgcactttttgccccgtctttaagacactccatgcaaaaatcgtcactgttcaatataggtccccctccatatttcgaatgtaatttctgccaagctacagatgataaccgcttcattgatgtgactttagatgctggaacctttccatgttcacattgaattgcaccattgtcgatggaagaggggggagtaatattatctgcccactgacgaagccagtctgttgagatccaaaaatatgaatcatctcctgggcctgcaggtgcttctgtcagaacagattttacttcttgacgcctctctgttatatatgccaaatggctgtccttcttgctttggtattccacacacaattttgtatatgatgcatttagttcattaatttcatctagaagatggtgtggaagtaaatcattatttatctccacaattttattgctttcagtgggattgacatccttagtgatacatttgtacatcagcatataagcatcggtagatgaaaacatctcccccatggtagaactaggcgctgcctcatggtggccattattattattgtttgtgacagaaccttctgtggaggtattttgggacttctgatcatctttgtttgatgcctttcctggtttttcaccaaaaggatgcaaaccaagtttggatacagtctcatcatcaaactcccaccattgcccattgctttcatcttttatatgtgccacatagtgtccactgttagcaccagtacccttgtgaattaaaatagcagacaaggcataagtgcaactagatgaaggctctgataatcgttttcccaaatcaagttgtcctgggaaactgaatgttgaagatatttttttctaggtatattaccttcgggaggaatacataacgcttcagttgaaaattgacaactggaggaagtgatcgaagttttatacaacgagtggcatctacccttttttgacatgactcacaaaagtattgattctccccatccagtgcttcctcgctaaagtactcattcagactttcttccaaattatttaaacctttgatattcaattccagctcataaaagtcctccatttttgaagatgctgcagattcctttccacatgacgagcaccttgttacatgtgatacgctgccgcaaaacagattttgcacgattgttctggctccaggaaccttggaatgacttaacgattgctcgagcagagacagaaacaaagtgagaaattcatggctgtcctgctggacaccattgtctaattccagtgtcttaataaaaggcgctgaatcaatgaataacattttgcttgagtgtagctgtgcaaacaaccgtgctagctgatccagaacaggatgcttctccaaaacgtccagctccaaagagaaaatgcccgagcggaatgcaatgttcatgtaaaggcactgaagtatgctatttgcataacaggttgcacccaggttagtcaatccagcaggcgtatcagtggaatcgcggaggtccttggatggattggggccgagaccacgaaccatttcctgcattttctgccagaggccagtcttccgaaccccattggcagcagggatcaacccacagaaacaatttggggaatccttagtattgccatggcagccatggcaaggcggtttccacaccatgtaaagctggcagatatcgtctttcgagatatcaccggcggagtgtatcttcttgaaaacagccgcagacggattaatggattcatcagatcgtggcctcttgctcttgttgcgagtgttgggcctgctcatcaggggcggacctgatggttgctcgtcaccagcaaagagtcccacagagacctcgcttaggtcggcggcggcggctcgtcgccacgagacagagggtaggcgccggcggtgtccaaagtcgccacgagagcgcacgcctcacgctaggtgaacgggagaaaaaaaaatagtgcgaaatttgctgtgccagtgggcctccaacaaacct

SEQ ID NO: 24390 - DNA, 2704 bp, Zea mays
ggccgcttttttttttttttttgtcctttttttttttttttttggttaagctttgctgcttttgttaacttacttagatgcaaattctatacattgtattgctgtacaatcttctatcaccattcatttgcgtgttgtttgggcagatattgctacttgtagttttcctgttagcaaggggcaaacaaaaagagaacactctacaaaaatgtctcccggattatccgtgcaaatacccgtgacgacaaccggctcaagacatcaggtaggatcttcgacgagatgcctggcaacacaggtagaagctcttgcaccacagacaccacgttcacgtccccgcccactgttggagttgcagtaccggatgtcaggaacttcacaaccttctcgacgttgttcaggatgaccctgtcttcctctgtgatcgtcggaagcaatgccctggccctgacaggaaccatgctaaaaactggggccgcgtttcctatcccaaaagacgccgcgatctggatcaactgctcccttgaaatcgcatcgatggctttcacaatctcgtcaagaataaactcccgaaagaagttccccctctcagagagtagaaaagcaagagccgcacgggctttaactggctgctcaggctgcgctacggccattgcaaatacaggaaccagactggtgctaggttgaccacccaactcagccagctcagccatgtttcccttcaagttctccccaccaccgctcttcgctgcacggataaaattctcgaaagcttgcataacatcaatgaacctttccgcgtcgaaaacaccggttttgccatatatggtgtaacgcaaggcgctccttagccgaggtgattcgtccgttagtagcctctgtgcaatgtatgggtatgcttcatccacaatggcaaattcaggatctcccaccaaagctatgccttctaatactccgatggctctaataatcaaagcaaaatacggaggtatcctgaatggataatcaaaagttatctgtgctagatctgctgccaattcttggaagttaatattcttggcaccgcctccttctagtgcctgatcaaaaaccttggccagtacctcggccgcgaccacgctagataggatccaagttaaccccttcaggaataaaaccaagcttcacaaagtccttaacaattgcatcataatcacgatgaataaggtgagctattgcttcgatcattccatacttttgatcatctgtcagtttggttacacgcggaaattcaagaatagccagctttccatcaggtgttctaatcatattgccaggatgtggatcagcgtggaagaacccagtatcaagcaactgtttcagatagcaaatgactcctacactgaccaatgatccaacatcgtcctctgtgctctgtgacaactttctctccctctatccattgtgtggtaagaacttttctagacgtgtatttatggtaagtctttggtacaacaacctgtggaagatcttctttcatcacgtcagcaaagtaagtgccattttccccttcatttacataatcaagttcttcaaaaaatcgagcagcccactcatctaccaggccaacaacatcgatggacacctgtggaaatctcctgagtaccaaacccaagtttctaatgatgaataaatcgatggtaacagtctcaagtacaaatggcctctgaactttgacagctactagttctcccgtttctttcaagcggcccttataaacctgtcccagagatgctgcagcgattggggagcgggataactctgagtagcccgcttgccaaggctgaccaagctcttcttcaagaagagccattgctatatcatctgggaatgaaggaaccttatcacataatttctgcaactcggtcattgctgcaggggacagaatatctggacgtatacttagcgcctgcccaagcttgatgtaagcaggacccagagacgtcacgatttctctcagttcaattgcgcgagccacttcattctccttgagcttcttgttaataagatcggatacgagatgggagatgaaaccaccagcgacagacagcagctgcacaacccgggtggcgacggccctaggacgcttgccccagtaggctgatatgatttcagggctatacacaagaggcaggccctcattgttgtccgcggattctacctcgacgaggcggaggcggacgttgtcgtcggcgaactgctcgtcgcggaggttctggccgcggagaccgcgcatgagcgtggcaagctgctcgtcctgctccatctgcttacgcacgcgctggatctccttggacacctctccgaacctggtgtcagagaggtcattacggctcctggtcctgccgcgggaggaggaggaggtggaggtggacggcttgggctccgtggcgacggcgcggacgcgtgggaactgtcctcggcggtggagcgctgggaggtgcgctacgcggccgaagccgccgcagtgcagtagatgcggcgccgccgccgcagcctccatgccggctgtggtgtggactcggcccgcagcagcgtctctggtgggaggtgggaagcgaggccggcgtggcaagcgtggagcgggcgggcggcgggggttgcgatgtgagaaggcaactcactggccgcctggacagacgtcccggccgtggtcgttgtaccc

SEQ ID NO: 24391 - DNA, 1958 bp, Zea mays
ttttttttttttttttttcttttttagagcacaaatcgagttcagtcacaactagcatggaggtctcttggtgtgaagtttatcacatatgtgcactaggaatccaagctcggccttgaattcggtacatctgtgacacttacacagtaaccaccacagcacaggacgcatggatctcacaccttacatacgtgtgtatatatatatatatatagttacaacagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgtggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctcttctcgcttgaatctcgctaaatacttggccttctccgcctcctcccacgcagccgcacggatcgcggttatgttctgcgtcgactggtccatgggcaccggtttcagcgagagcgaggcgtccttctcctcctccttcttgctcgcccatgccgcgatgctggtcttgcctagctgcgtgccaaggagcatgatctccctcctggttttggtctgcagctcctgctcgctcagctccgagctgctgcattctcctccgtggctgatgaaggagccgactgcgctggggccaccgagcgtcctccgtggagtcgttggctgggagcagtttgggctcgtcgccctcaccggcgtcccggtccgggacggctcttggcttgcgatgggcgtcatctctgtgcccatgtccctcatcgacactgaccggaccgttgttggaggaggtatgcatgttgctgcgctctgaagcgtggtggatgcatcatggcggttgaaattaacagctgctgctgaagcagcagccactgtagtttctacagcgagtagtgtggtctttgttgggcagggctccgcctccggacaggggtcgggcggcgcccacctcgccgctttctgccacccaatctcacgcttctcctggctcggatccatcctcttggtatctatctcctcggtggcctctaccacgaccttggtcgccggcagcggcagcctcccgatgccggagccaggtttctctgtcttcttcggcgcaggagccgcgccacccctgccagggcagttcgccgtcgggctggcgatccacttctgtgcgtcgtcccactttgacggggcgggctttgagaatggagggacgaccgacgccgccgccgctgcccgccgctccttgtggaactcgaagttggatgccacgctctccgagtcgcacgagtcctcctcgggcggcaccctggtcctagaacccgtggcgacggggtgggcgtcccggggccggtgcccacccgctgtctccagcgaggacgagaactctgaggtggtgctcaccacgtccacgtccttgtattcttcgcacgtggcgccaccaccgtcgccggcgccggatctggcgtgggccttgggcagggcgccgtagtcgccgccgccgccgccgtcctcgtcctcctcggcggcgccgtcctgccccttgcggcgcttgtccacccccagcagcatcgcgcgcagccgcttgggcgagaacccgccgccctggacggggaacggcttctcaatgcgctcgtactccatggccggcgcgtcggtggcggagatctgcggcggcgcgcgttgcgttggtggcggcggcgccctcctggcgacagagagagagagagagagggccaacccccggcgagccacgaggtgcaggtgagttaa

SEQ ID NO: 24392 - DNA, 1921 bp, Zea mays
  misc_feature (1310)..(1310): n is a, c, g, or t
ggccgctttttttttttttttttttagagcacaaatcaaatccagtcacaactagcatggtgtgaagtttatcacatatgtggactaggaatccaagctcggccttgaattcggtacatctgtgacacttacacagtaaccaccacagcacaggacgcatggatctcacatcttacatacgcgtgtgtgtgtatatatatatatatagttacaacagcttacaagcgactcattctcaacgggcgactcatcttccatgggcacttcatgagcaccagttccagcagccaaacgacggcggcacccgccccgtcctcctgatgtgctctgcctgctcagcggtcctcgcggctgcacggttccgtttcagctccgccgcggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctcttctcgcttgaatctcgccaaatacttggccttctccgcctcctcccacgcagccgcgcggatcgcggttatgttctgcgtcgactggtccatgggcaccggtttcagcgagagcgacgcgtccttctcctcctccttcttgctcgcccatgccgcgatgctggtcttgcctagctgcgtgccaaggagcatgatctccctcctggttttggtctgcagctcctgctcgctcagctccgagctgctgcattctcctccgtggctgatgaaggagccgactgcgctggggccaccgagcgtcctccgtggagtcgttggctgggagcagtttgggctcgtcgccctcaccggcgtcccggtccgggacggctcttggcttgcgatgggcgtcatctctgtgcccatgtccctcatcgacactgaccggaccgttgttggaggaggtatgcatgttgctgcgctctgaagcgtggtggatgcatcatggcggttgaaattaacagctgctgaagcagcagccactgtagtttctacagcgagtagtgtggtctttgttgggcagggctccgcctccggacaggggtcgggcggggcccacctcgccgctttctgccacccaatctccccgcttctcctggctcggatccatcctctttggtatctatctcctctgtggcctctaccacgaccctgggtcgccggcagcggcagcctcccgatgccggagccaggtttctctgtcttcttcggcgcaggagccgcgccacccctngcccagggcagttcgccgtcgggctggcgatccacttctgtgcatcgtcccactttgacggggcgggctttgagaatggagggacgaccgacgccgccgccgacgccgctgcccgccgctccttgtggaactcgaagttggatgccacgctctccgagtcgcacgagtcctcctcgggcggcaccctggtcctagaacccgtggcgacggggtgggcgtcccggggccggtgcccacccgctgtctccagcgaggacgagaactctgaggtggtgctcaccacgtccacgtccttgtattcttcgcacgtggcgcctccaccgccaccaccgtcgccggcgccggatctggcgtgggccttcggcagggcgccgtagtcgccgccgccgtcctcgtcctcctcggcggcgccgtcctgccccttgcggcgcttgtccacccccagcagcatcgcgcgcagccgcttgggcgagaacccgccgccctggacggggaacggcttctcaatgcgctcgtactccatggccggcgcgtcggtggcggagatctgcggcggcgcgcgttgcgttggtggcggcggcgccctcctggcgacagagagagagagagag

SEQ ID NO: 24393 - DNA, 1724 bp, Zea mays
ttggcgatttaaaatcccagcattcaagcggcagaccaatgagctgaatgcaaaaacacataattgtccactgtaacaggcggcagaagtgcagaacgctcacggttctctttttcttggtctaaaatgttaagtttctggtacctgtataatacaagactaccaagttgcccagagggcttttctgaaaccatttccctaggattggttttaattgtttccttcttttctctatccacattacaaaactatgtcactgaaaaaaaataaatgatacgctgactgctcagaatgaaacaaaaggtggtgctacgatcttctgtctgacttatgatcgtttttcttttcttcggcctcttttctcttttgttgcgcaaaaccagcgtatccagcaccaacattagctgaagtcaagagtgccgcagtagttgctgataagttgtcgtgtccactaggaaccacatggttcttaacatcaccatcaaccttatcccattttgatttcttgtttggtctagtctctttctgtacaccttctgtaggtaccggtagtgtacagacaccagccaaacctgggatcttcggtattgatgcattgattgggggttgtactccagtaataaattcaacttttgggctccttttcttctcctgttccttcctctcaacttcacgcttcatttcagcttctatctcatcatagtagtcgcctttgtcgtacccataaggatcaaaaacatatttactgaaacaggtccctatctgatcaatttcttggtatcccacagcatgctgcaaaaagtcaggatttctgtagtccttcctgttgcgcacttcagcattaaagctctttccagcccttctgtatgcaaggaacctgttaattttttgctgtaatgctgcagagcattttgtagtcacgggtggaggaaggaaacgatttgatggatcatcactttcaccattagttgaaatatcagtagttccttccacctgggcacctttaatttctgttctagttacgtccactgccatgtctgtccctacttggttctgctcgggtgcatcaggatgctgagacaattctgctagagtatttggggtcataacatgaactgtgccggagtaagttcgttcttcaagattcccctctgcagcctgagcatctgagccaaatccgtatgtgttgctcgtgatctccccatcctcctgctcgggcgacatagccgtctcgtcgtgcgcatagtccacgattgcaagcgccccgcgccgcggagggcgcggcaggtctgccggcggcgcgaagaacggtccccgtagcggggagggggacgacactgcaaagggtgatgaagagcgccgcgagggaagtggcggaagcagcccccgcgccggggaagggtggggactcgctagggttttgagactggccaattcctcgggacgggaaggtgacggaggcgccacagaagggttggggtcctcggccccggcttgaggggacagcggcgaggaggaggtgacggcggcgggaagcgctgggaaaggagggctgggctcgtcggcatcctcctcttcctcgtcgtcgttgtacatcgagaagagggcggcgatgccctcggtatcggacgccatgccaatgatggaaactgagtacgaagggttggatttggggacgaggcgaggcccgaaacggcgaggaaggcggccgccgattttcccgg

SEQ ID NO: 24394 - DNA, 7264 bp, Zea mays
  misc_feature (3537)..(3537): n is a, c, g, or t
gcatgcctgcagccgagtattatagtatgtatcaaggcttgattttggcataagacactcacactgagacagtggagccagtccccgttccaaagagcccgtcaaggaggatgccgattccctgtcgttcgcaggagcatctctctttttttcagttttgaacgtctgacgacggaacgtgaaagagaagaacaatcatgggcgcaagaaagcgttcacctgccacccaatgcctctgctgaggatgtgagccggaggtggagtcgcactcgcaagccgagcagcggctttgtaggaggctgtggactgtccaagagaggcacattgcgttaaggtcatcagtttggtcccgctcctgaatgggattccaaaacaaaatatggatcctcacctctaccagcgagaccaaaacagcagacacaatcccaaatgactgtccggcgttgaaggtcggcgcaccccattgcagtgggtaggggatcttaatcctgtgcgaagtcaatggatcaattataccaaatggcaatccaatataaattccaccatacacttaacatgatgttgggcaagggtagtactaaccatggggcagaagagatgagattggctctgtcggtgcggcagttgttctgggtgacctcggcgctgttcttataggctccacctgaagtgaggatctgagcgtacgcccataccaacgcgacacagatgaaaagggagaacctttccagtatggggatttcttttatctgtatgttcttcagatactgcgaaacaaccgaaatgcacacagatcaggtacgcttaaactcgccgccaagatcatgaatttggtgcgtagagagaactgaataatctggagttttttttttttttttgccagtcagacctgagacagcacgacaaagaggatcagcattggcaggccaatctcaacgcatctcccaacctgatgcaattatcagacatcaatcggatgagcaagccattcctcgtcagcatacccacgttgggaacacgaaatggggatcgggacaaagcgagtggtaccacagggaaacctctttcgaagaggccaaatccgagcagcgcaaccactggagtcatccccactgggctgaagaatctgacatgcgttatggaaccaaccagtattcagtatagcctaggcactgtcaaaagtcaaaactgaaacggaactacttggtagtagattggtaaatttggtattgctcttggaaggaaagagcgaagtgtgaaggaaagcgacctggagaaaataccccacagctggctgtagcccagaatgatctgaatgctggaggacactatcagtgccccctgtatggccttcatggtctcgaggaacctctgctcaaccacagatggggaaaaaaaactttcagatcacacacacgccaccgcctccatcagaagcaacaggcagaacggacagtcacaggcaactggctgctgctctcctcatgaccgtcgggtatcccagaaagcgacgggtcctggatgatggccattatcgggatgacgaacgcgtaggagccgccgatgaccgtcggcagccgggtcccgaagagggactgcagcagcgtgtttatccccgtcacgaacagcagcgtctgcaccaccctgaccctgtccccctgcaaacagcgacaccagtccccaagcgaaaggggggaaaaaaggacccaaaacatcacatcagcaaacggaccgatgctgccggcacggagccggtgctgtggtcaagaagcggaaggcggcatggcacgccctgcccccatcgtcgccgcccatcatgggaaccaacaccgtcgggatcatcgccgccgtgcccagcgccagtatgtagtgctggaagcccagtatgatcgcctcgcctgaaatgaaaagcaaaaaaaaagacgaaaacacaaaacagattcagagaaccgaattccaacgcggatgtgaactcgtttcagctccaagcttgggtacgcaccccagggagggttggagtcgatgcagtactcgaacccctggagctgctccatgggcggatggcttatctcctccggcttcacctccgccatttccctaccccgacgagttttgccctcttggagcaagacaagagagaagccgcgggaaagaggacaggaagagagagctcgtgtctctccgcctcccaagaacacgacctcgccccttaaaatcaccagaccgagcggttcctgcgcgctttgctcgcttcgtctgctgctggccctctcttggaaaagcaggaagaagcagaacccaagcaaggtgaaacgtatccaccggcgacagctagccgccctttgcaggagagcgccgggacgaaatctgttttgggagaaaatggtttcgagggcgcggggacaggcggcccgagtgggaggcccggccccccccgccggcggctagcactagcaatggcgaggtactggtcgccggccggggcgggcgtcttttgtctcgtgaggctaagcccttttcctttgtttgccttttatcgttgctgggctgggttttaaccgcctttcaagtgttgctcttccttcctcccctgtctgctgtagggaactggccgttggattttttgctgtgaccaaattgccccctcatgtgtcctggcgtccaccacagcaccttgctttttcacttcacctcgtgctcgggccactgctgtgtgctctgctgcagtttcaacgtgctgttgactgatgtgtgtttagcctcttttgatcagcagaaggatagtggtaataattgtttttaacatttcagaaatatccaagttagcaaaaggtagtacgaataaatgttgattctatttacgcaaaccttaaacttctgctttttaggtaccattttcagccttgacgacagttaactccaaagcattcaactctataagaaaaaggtactctgtcgattctaaatgaaagttatgataactttttagatactctctatgtttctttttacttgtcactggatagatgaattttacactaacaaacgacaagtaaaaaagatcagaggtagtacataattttatatgcacatatatcttatattctagatatatatatatatatatatatatatatatatatatatatatatatatatatatatatataatactttatatgctttaaattataagatatttgaggtcttttctagatatattaaaatacatttagatgcatagctaaatctaaaaaaactaaaacgtcttagagcaacttcaagagtctctctatattctttctaattgatataaataaatattttttaaagagaatatttatctaaatggctatctaaatatagtcatcttctattacgaatttctcgctagccaaatatagaaaacgtgaattgctctctagggtacaaaacgatttagaaatgttgttggagattgaaaagatatagaaaatattttttatgcaatgactctttaaatgataatttggagagtaaaatatagaaagagttgcnatataaaaatagagtagaatttaaaatggagatgacaaaagatatgtattacttgcaatataaaaatagagtagaataaagtaagtactcgcgtacgtatcctatataaaaagtgtggttatagctttggatatgggaagctagaagtggtaaagacgtgatgtatagacaattagaaggagagatataaagatgtatttagagaaaaataagggcgtgttacaagttggaacggatgtagaaggctaggtatagcttctattatcggatatgaagtaaatccctatattacttaatgatacataagtaatgagtataaaattcgatggcacaaagacaatttttccatactatatagggaacgcataggatatgcacggcgtcactttgatgtggctggtccaagaccaggccagaggccagaggatggatacaggatactttgtccctgttctttcccctcgcctgaaatcacgcggtccacgtcggcgcatgtcccggctcggagttcgagtcggagaaagagagagagagagagagagaaaggggtctgggaagggtgggcaaccgccaaccgggcaaagcaaagttaccgttgggtgccgctcgcttcgtcagctcggcgtgtgtggtatggtgtgggctgggcggctgggcgggtggtcgtacggatgttttgatcgcattttgcatcgtgggacgagcgaagagcgcaacccacgcacgtagccccggcggttgtctgtctgtgtgcgtgcctgtgagagtctgggcctttggcggtctggccgtggcctgcaagcctgcaacacgacgccgtccgcttggggccgcgcgggacgggacagcggatctgagagatgcctagctcacgccctgagcgcacggagacccacgctgtagtgctctaccgcgctactacgcctctgtctgccgctgcccgcagaacacaacacctgcgcggccgtgccatggtcttcagcgacagaagcggcggggaaagctctcatcccgatggggaaatccaatcaggctcgtcactgttccgtttaccgccaaccgatgcctggtaatttattgcggtccgctgggtagcgaggccaacgggaaagtctcacctctttctgccggcaccagatctacggtggtgtgcgcggcactgtggtgaattcatggacgtgcgtccggccaattcggagtaatgagctgcgtcgagccagagacggtggtcacgttgccggtcggtggcgtactgcttcagtggatgcagattgctgccagtttgggttgcaaccgatctttcgagcttgccgtgcaccgtgaatgataaataatttgagctgggcctatgtcattatctttactattggggggcacacggtgactcatctgttgcctgtagcgctaccatatactctgcagaagcgacttatcttgtacatctacggatctaccgcactgtagcacgtagcctgtaggactgcagatcgcacgtcagtcctaaaacatcacgcggatatgatgagcgactgctgctggcgatgttctgcgtgataacaagattttacgtgaccatcagtgataataaaaggttaccaattggaaataccagcactctggcggcagagcaatgagctgaaggcaaagaaaaaacataatccaccgtccaagaaataatgcaattctaccagtgtcatgttctagtattcaagtttagctaattgtaaataaaaatattaataattattatttcaaatgaacattaatagaataattacgaaatgcatttttcatactgaaatgttttggagccataaatatagatatcatttaccaaaagcttagtctaactgctctatctggcgggcaacttacttgcattcaattttggtgcattctttttaggacaggagtaattgtccaccgtaacggggggcagaagtgcagaacgctcactgttctctttttcttggcctaaaacgttaagtttctgatacctgtataagacaacaagtcgctctgaggggcttttctggaaccatttccctcggactgattttaactgtttccttcttttccttacccacaatacaaaactatgttactgaaaaactaaatgatacgctgactgctcagaatgaaaaaaaaaagtggtgctacgatcttctgtctgacttatgatcgcttctcttttcttcagcttcttttctcttttgttgcgcaaaagcagcatatccagcaccaacattagctgaagtcaggagtgccacagaagcagttgctgataagttgtcgtgtccactaggaactacatgattcttaacatcatcatcaaccttatcccattttgatttcttgtttggcctagtctctttctgtacaccttctgtaggtaccggtagtgtacagacacccgccaaacctgggatcttcggtattgatgcactatgtggagtttgtactcctccagtaataaattcaacttttggattccttttcttctcctgttcctttctctcaagttcacgcttcatttcagcttctatctcatcatagtagtcacctttatcgtacccataaggatcaaaaacatctttactgaaacaggtccctatctgatcaatttcttggtatcgcacagcatgctgcaaaaagtcaggatttctatagtccttcctgttgcgcacttcagcattaaagctctttccggcccttttgtatgcaaggaatttgttaattttttgctttaatgctgcagagcattttgtagtcacgggtggaggaaggaaacgactcaatggatcatcattttcaccattagttgaaatatcagtagtttcctccacctgggcgtcttcaatttctgctctagttatatccactgccatgtctgtccctaattggttctgctcaggtgcatcagcatgctgagacaattctgctggagtatttggtgtcatgatatgaactgtgccagagagagtttgttcttcaagattcccctctgcagcatgagcatctgaaacgaatctgtatgtgtggctcatgatctccccatcctcctgctcgggcgacatagccatctcgtcgtgcgcatagtccacgattgcaagcgccccgcgccggggcgggcgcggcaggtcggctggcggcgcggaggatggtccccgtagcggagaggggggcgacgctgcgaagggcgacgaagagcgccgcgagggaagtggcggtagcagcgcccgcgccggggaagggtggggactcactagggttttgagactggccgactcctcgggacggggaggcgacggaggcgccagggaagggttagggtcctcgcccccggcttgaggggacagcggcgacgaggaggtgacggtggtgagcggcgctggggacggagggttgggctcgtcggcgtcctcatcttcctcgtcgtcgttgtacattgagaagagggcggcgatgccctcggtatcggacgccatgccagtgacggagattgaggagtttgggttggatttggggacgatgcaaggcgaggcccgacacggcgaggaggaagacggaggatttcgaggtcggggggctcggccgctcggggcagcagtttggcgagtctgcgaacgaattagcctgtacagtatccgattcgactagcagatgatgatggcacaggggcggggcagccgggcaacacccccggccggcctcgaggtacccaatg

SEQ ID NO: 24395 - DNA, 2238 bp, Zea mays
ttttttttttttttttgaaaagtgtacttattttggacggagcatgtaaaaaaatatataaaaaacggtaggcgaccacatttagtggattgggcagtaagtatacttactgaacctccccaaaataatctacaacacgaacaagtagagatgaacgaatggaacaataaataagctacactatgcctctgctcagcaatctgagtctgagtgacttgacttttaggccggagggaagaagcggttgaggttgaatggcaggcggtagaactcctcgttcctgctgtcgcccttgaacgtccggaaccgctgccaccacggcatcccccggtccatgccggcttgcttcacctccagcgtgttgtccaggaacacggccaccatcagccccacggtcggcggcgacgagaagatggtgttgatgtagtcgttgaaccatccagctttcgtgtgcgcaggaccacgatgagcagccatggtgtagcggaaaaagtattccgggacggacaggccaaggaagatggagacgccgacgataaagaggttgcgcatggagttcatgttagtgaactgtaggaaggacagccccaccgcagcaactagcccgaacaggacgcagtacacggccgcaaagatggtgaacgggatggaagcgaacaaggctccaaatttccccagcatggagaaaaagatcatgaagccagctgagatctgtatgacccgtcggctcccgatccttgtcgacccaagcaacccgacgttctccactgagacagtggagccagtccccgttccaaagagcccgtcaaggaggatgccgattccctgccacccaatgcctctgctgaggatgtgagccggaggtggagtcgcactcgcaagacgagcagcggctttgtaggaggctgtggactctaccagcgagaccaaaacagcagacacaatcccaaatgactggccggcgttgaaggtcggcgcaccccattgcagtgggtaggggatcttaatccatggggcagaagagatgagattggctctgtcggtgcggcagttgttctgggtgacctcggcgctgttcttataggctccacctgaagtgaggatctgagcgtacgcccataccaacgcgacacagatgaaaagggagaacctttccagtatggggatttcttttatctgtatgttcttcagatactgagacagcacgacaaagaggatcagcattggcaggccaatctcaacgcatctcccaaccacagggaaacctctttcgaagaggccaaatccgagcagcgcaaccactggagtcatccccactgggctgaagaatctggagaaaataccccacagctggctgtagcccagaatgatctgaatgctggaggacactatcagtgccccctgtatggccttcatggtctcgaggaacctctcatgaccgtcgggtatcccagaaagcgacgggtcctggatgatggccattatcgggatgacgaacgcgtaggagccgccgatgaccgtcggcagccgggtcccgaagagggactgcagcagcgtgtttatccccgtcacgaacagcagcgtctgcaccaccctgaccctgtccccatcgtcgccgcccatcatgggaaccaacactgtcgggatcatcaccgccgtgcccagcgccagtatgtagtgctggaagcccagtatgatcgcctcgccccagggagggttggagtcgatgcagtactcgaacccctggagctgctccatgggcggatggcttatctcctccggcttcacctccgccatttccctaccccgacgagttttgccctcttggagcaagacaagagagaagccgcgggaaagaggacaggaagagagagctcgtgtctctccgcctcccaagaacacgacctcgccccttaaaatcaccagaccgagcggttcctgcgcgctttgctcgcttcgtctgctgctggccctctcttggaaaagcaggaagaagcagaacccaagcaaggtgaaacgtatccaccggcgacagctagccgccctttgcagtttcgattaggatgttttaggtaatggtctcgtgcgagaaaaggtttcgagggcgcggggacaggcggcgcaagtgggaggaggggacaccagcgacggcggctagcactagcaatggcgaggtactggtcgccggccggggcgggcgtcttttgtctcgtgaggctaagcccttttcctttgaaa

SEQ ID NO: 24396 - DNA, 2206 bp, Zea mays
gcctcttggttttgctattgcgttttcacaaaagaaagttatttggtcctaaactggccttttgatgccgcaccaaatatggatctgctcccatggccggcccatagcatccgccaccgccttcccccgtttattccccaaccattcctctcctcgccggcgggcccccgaccccgcggccgggccaccccatatcaccaccactgatggcggcgcttccccttctccgccgcctcctggcccaccgccgccttctctccaccaccgccaccactcccgccgcctcatccagcaacccccctaccccagaggccgtgctctacgccatccacagcctctccaaggatccctcccaagcgctcgccgtcttccgccgctccgccgccgccggcaagcccgtaggctccgcggcatacaacctcatgctccgcaccctcgcctctcacccctcctccgcccagcgccatttctggcccttcctccgcgagatgcaggaggctggccactccgtcgaccagggcacctacctcgctgccctcgcctccttcaagaaggccagcctcaccgccgactacgcctctctcaccgcgcactacgacaagttccggaagggggacaagtccgccgccgccgccgccgcggaggccgtccgggaccacgacgccgcgggacttgatagcaggctcgctgacatcggtctccttccgctcacggaaaccgctgtcatcacggtgctccgggagctgagggagcatccgatcaaggctctcgccttcttcagatgggctgggcggcagcagggttacacgcacagctccgtgagctacaatgccatggcaagggtgctaggtagggaggagtcggtgcccgagttttgggagttgatccgggaaatgaagggtgccgggatgtacgtggatatcgacacttacctcaagctgtccaggaacttccagaagcgtcacatggtccgggaggctgtggagctgtatgagctaatgatggatggccctttcaagccgggccagcaggatggacccatcatcatcaggcgcatctcgctggggccgtcgccggaccttgagcttgtcaaccgggttgtcaacaagtttgaggccgtctggggtgtcaagaccaaggagttgcttgatggggtccatagggcgcttacaagtaatgggttgttcgataaggctgcagagattgtgcaaactatgagggaccaaggccaccagccggacaatattacatatagccagttggtgtatggtctttgcaaggccgacaagctggagaatgctcgcaaggtgctcgatgaaatggaggctgaagggtgtgtcccagatttgaagacttggaccctgttgatccaagggcactgtgtagctggggatgtggacagagctgtgcagtacttcaccgagatgattgagaagggcttggacgcggatggcgatttgctcgatgtgatattgaaaggtctgtgtagccatgaaaaggttgaagaggcttactctttgtttgttgagatggtggataaggctgagttgaggccttggcaaggcacttgccagcatttaattggtgacttgctgagggtaaacaaacttgaggaggccctggcccttctcaagacaatgaaaacctgcaagttcccaccttttgcggacccgttccctccttacattgccaagtatgggacagttgaagatgcaaggaactttttcaaggcattgacagtgaaaacttctccagcacctgctgcctacctgcatgttctcaagttgttctttgcggagggaagatattctgaagctcaagatttactgtacaaatgccctatttacatccgcaagcacccccacgtcgccaaactgtttgaatcaataaaaattgagagtgcctctgcctcttgattgggttcaaccaagcaatgattggtgaggctatggtgaacccttacctttgcttgctagctagctttctgtttttaagtagccttggtattgggtcttttaaagacatatggttcaactaagtcgaattttagtatatgccacttccagcccatgacctgctggcatattcccttataacttattagcttaagaggaaggtgccaactggcacgtccttgagactttttctttgttgttgtaatcattgcttctgcttgctagatcgttatacagttggattttcctcc

SEQ ID NO: 24397 - DNA, 1179 bp, Zea mays
tgcgttacctcggcgtaaatgatgatgacgtcgaggttgagatccattttttgaaatgaatatgtaaatgatataattgtgcaaaaaaaaactcaaaaaagctaaaatgcaaaaaaaaaaaaagttgggaacgggaacggaaggaaggccacgaccgaaaggaagaaattgctaatggtgttcagtggagtccaatgccatatctttaaagtctcgaccattatagtaccgtgtttgcaattggcgcctggcggtgccgtgcgtgcgaagcccattaaagccggtgccatgcttgcaaaaatctaattgaagagagtctaatgttgggggttgcatgaataaaaaaaactcgtttattccccagccatcctctcttcctcgccgcaaagcccctaaacctccacctccaacggcggcgcttccccctctccgccgtctcctggccctccgcggccaccgacgcctcctctccacacccgccgcctcatccaacaaccgcctttccccagaggccgtgctctacaacatccacagcctctccaaggacccctcccaagcgctcgccgtcttccgccgctccgtcgccgccggccagccagttggctccgcggcatacaacctcatgctccgcaccctcgcctcccacccctctgcgcagcgccatttctggcccttcctccgcgagatgcaggaggctggccactccgtcgaccagggcacctacctcgctgctctcgcctccttcaagaaggccagtctcaccgccgactatgcctccctcaccgcgcattacgacaagttccggaaaggtgccaagtccgccaccgcggcggcggaggcggtccgggaccacgacgccgcgggcctcgatagcaggctctccgccatcggtctccttccgcttacggagacctccgtcaccacggtgctccgagagctgagggagcatccgattaaggctctcgccttcttcagatgggctgggcggcagcaggggtacacgcacagctccgtggcctacaatgccatggcaagggtgctcggcagggaggagtcagtgccggagttttgggacttgatccgggaaacaaaggctgctgggatgcacgtcgatatcgacacttaccctcaagctgtccaggaacttccagaggcgccacatggtccgggaggctgtgg

SEQ ID NO: 24398 - DNA, 929 bp, Zea mays
  misc_feature (4)..(4): n is a, c, g, or t
tttnaagagttttttcatggattttaaagttccaaatatgcactagcaagaaagaaatctttcatccagtgattcttcagatttaagttgtttaaaatgtcactgctggtgcataaagattgtaactctgaccaagcactccagttccaaggataagtattgacagattctactaagattgttctagctagaccttcgcatcctttatcacgtagaacactgccatacaagtcacagtcccaatgaatcaatagagccagttcttcggtgtgttgagagctctttctccaaagcaactagttcctgcgcacccccggcgccctcccccaacgatccttcaagctctatcatctctgcctcttttcgcttctctccagccatgtagagcgcgtagcatcgcaggaacactgccttacgcccaacctggttctgcagcacgtgcgcggcgcggcggtactcccgacagtcgaaataggtcttggccagcaggtatttgtcgccgcccgaatcgaacgcgtcgtcgtcggggatgggcgtgctgacgtatgacacgccaccgagcggggtcccggcctccgagctactgccgccgccggggcggggtcggtggcggaagctggaacccccgctacggtgaaggtgcaatagccgccccgcggaggccgcggacgaggaggatggggagtccgtcgcggccgaagggaccggggccccatccagctctacgccgacgagcagctcggcggcccatttagcggcggagtagaggcagcgctcgccgagctgccgggaggaggcgcggagctcggcgcgatagctctccttggcggaagccatggctccggtcggggcttgcttcaagcagatcgacgcgagagcgcaaaaattatttgaattcttgcgatacgtggaaccgtggagtggaaggc

SEQ ID NO: 24399 - DNA, 521 bp, Zea mays
  misc_feature (320)..(320): n is a, c, g, or t
aaacaaaaatgggctaaaataaaaacatttcggtctcatctccgtccacatccgtcctccagcactccagctgcatcgacgaggaccgccgtagcgatttgcgaacggggacgggagaggaacccgaggaaggcgaaaatgatctaccgcaactggtcgctgctctcgtccacagtcgtcatttggggcggcgtcgcaccgccggcctcgccgtatcttcctcttgggcggcaaggagaaattcaatggttatctgtgccgcgaaggcgagaggcttaggcagcaggacagagccgcgatgggccgaagctaagcgttanttctttggtatctcaagggagcaatagcccttcgaaatttcacaagattcctgcgtccctaccagaacaagtccctatctagggactaggatggaatccatccttctgcaggctttcactttcctgataataacagtaacaataaattgacaatggtttgtgttcttctgcaacctttttggctccctgggtttcgcaagg

SEQ ID NO: 24400 - DNA, 5108 bp, Zea mays
  misc_feature (2242)..(2242): n is a, c, g, or t
  misc_feature (2354)..(2354): n is a, c, g, or t
cccccccccccccgcttgtttcgcctgctccggcggtagattgatggtatttagcgtggatctggttgatacatccgtgggggattggtctgccgcccgcgatcattacgaaccctagatttgggggcagatttttttggtgagtcgcagtttgttgtccacaggggcatatttatatggttacttatgtgattagcaagactgatttcaagcgggtgctatgtaattttcggtttgacatagccatgtgggtcgggtcaaaactgtaatagatttttttgttactggatagccaataggggatttgacaacctaataaggtaccacataattttaaggatttcattcagcttttgtttcttcttattaagagcaattggttaggacagaagccatttaatttggcatcaatgaagaatcatgtcttaggacagaaggcgtttaatctgccaccaatgaacaatctgtttgtagtttcaaagacattagctgatgcaattttatttgttactacttcccagtacccatgttttttttgctgaccccacagctgacaactacaatatctttcttatttagttcactgacaccaaaaggtagcagaaaaaactggaaagagttaatagatatgcatttcgaacagagtgcatatacacttcagataaggttaaattcgctagaacaaacaaactggaaaaagtactgaataaatcgagattaccattacatgcttgttcttctagaaattcaaattaaccctgcacatgcctgtgacattaccattacatgcttctgaactactgtccaggtacaaaaaatcatttaactcatgttttggaatcatgagaaataaaccagccattcctttcctttgcaaattattctgtaacttaagtagccatttcttttccttgcaaattacacaaaactcatgttggctaacttatcagattccgaagaatgttttcctagagttaggaaaagtatgttcatctgaatcagttttacttatggaaagtcaccccgcaagctaaagcaattgattaaatgaacccgagtggccgaatatagtacaatatatcatttctttcatttaaaatatttcttttgcttgcaaaggaaatggcatgccagagtttactgattaatcaatcttcagatcatcatctcattgtttcaccaaaaggttacagatatagctgacaggactgatggtgtcctctttgatagcggcgacgatggtgtgggtgagatagcacaggatgacgtgcaggatgcctctgtactatgatagtatgatggcaaacacagcaacttgcatggtgctgatgtggtggatgaggtagacaagatggtggagtacggtgcatgagcagatcgtgcggatgtagaaaggaggaaattggagctaggggcagtggtgggctgtggagcagaggcatggggtctggaacaccgaccacaggcaggcagcgctgggtgccatgagtgtcgtcggggtttggagcacaggcagatgtggagtggagtcatggataaatccgtggggtgtgtcctggagcctagcggagatgtcatttaggccgtcgagcggaatgtgagaagcggggataggaaccttgtgtaagttttaagtagtagagatagagatttggcaaagtgggtgctcattacataatattttaggctcccaaatctcaatagtctcttccgggttcggtttgccttaacagctgatccttatattctcgaatgtagtgatcaccaatttgcaaagaactatgatgcatttcgcaatcatggactgcatattatgcaggagccacacatcttattaaggaagagaaattagctcccagtacaaggcagccctggttggttctctgttacattcaaaacgacccaaagctgcctatacagagcaactcctctagtgctttagcgccagccatgcccaatagccaggcttcctctgaaatttctcttagtcaatgcaatgcatggggattggggttacctgttatgctggtacttatgcgttctttttgctaaaaaaaacttgtgtgactggtgttcagcggaatgttgttttgaatgtgagttcctgttctaacacatattgccttttgtcatgatttgtcctttttcttgggtgggtttgggcagtgtgtgccttgtactgttgatgattacactccgaccatgtccagtttttatttttggtgttgatcaatgctttacntactgaagtgtttcaaaaattagtgccaataatgattatagatatgtaatgcattacacttcatactgaagtgcaataatggccttgtttattacttcggtttctttctttnctatcttgttgtttgctatcttgatatgttttgttcttcttaaggaaccaagattttatcctgatgcgtcttttaacgcgcacgtcgggcggcaaggagaaattcaatggttatctgtgccgcgaaggcgagaggcttaggcagcaggacagagccgcgatgggccgaagctaagcgttagcttctttggtatctcaagggagcaatagcccttcgaaatttcacaagattcctgcgtccctaccagaacaagtccctatctagggactaggatggaatccatccttctgcaggctttcactttcctgataataacagtaacaataaattgacaatggtttgtgttcttctgcaacctttttggctccctggtttcgcaagggttccgtgctttgtttggcgtcatcacttgcatgtcttgtataaaaaggttgctgttgcatttggcgtacgggactaaaaaaaatatctgggtcctgtctttgacacgtggccgacgattttgccacatattgtacctacccatgatgttcagtgttgcttacgcgcgaaatgtgcagcagcaaggagtcagtgttgctacagtggcatttgagtgatgtgcagtcactaaccaaccaatcatccactgcacgcggctcttctcgccgtggtttaggccctgtttgtttatataataatccaacatggattatataatccagcttatggattatataagtacacctaatgacttgtttatggattatcataatccacctaataaaatgtattgtttgtttatctttcgacttatttaagctggattatataattaaatagggccttagactctgtttgtttctctctacgatggactatggatatgtttggttgcctggtccaactcacgaccaggcccatttcatacagtatgaatatgtttggttgcctggcccagtccgggagcctggctgaggcgagcccaaaacaattttgtggcctggctgaaaggaaacgcgagtttgttggttccctgaccggcctggcccgacttcagtcgcccagcgacgctagggtttcactctcctcagtcgcagcggttcccactctcgtctccagaagaagcgccgcgatgggttccccgccgctgacgccgtaccgccgatgggccactccactgcactccagcagaaggtgcggcgcccccttgctcgctctttctggctccgatctgatccggcttcttggttggggtttggctgatggggtggtactcgatctgacgggttttgatctgattttctccttgccttcttctgctgctcgatggcttgtcggcgatggtacatgccattcactccaacgaccccactgtgcagcttgaggccaccacacagttcaggaagctgcgctccataggtgaggttcggatcttatgtacagttaccttttccggatggacagtttggtggtgagatttgcgcaatttgttgagtagtattaggccatgcgtgagggcatggtcatttgtgggttttcaggtaactctcgtgtacatgttgacttgtggattgcgagctggcaaaattagttgttgcacctctaattttctgaatttaccgtatcctcaaagaaacaaaccctacccttcagcctctgcaacgtgcatacatgtatgccctgaagtttgaaaacaagctatgctccctaagcatttgatttcatgaacaactattctattttttcggtagtattctgcttgctgctctggccattaatgtatgtataatccatgtatatatatatatatatatatatatatatatatatatatatatatatatatatatataatatatatatatattgtacatataatatatgtacaattgttgcatccattattgttgctctggccattattgttgcatccaatgctggtgagtgcatgataattctttcttaactcacactgcaatttatgtgaaagttaagttgtaactgagtgaatttcgtcaaatttctctagagcgaagtcccccaattgaagaggtgatcagcacaggagtcgtgccccgattctacgggcatgtgatgattttatatttaactgttgcctttacttgcctatgatgatatgttttataatgatgatcaatcaagggagtatgacttgtagcagtcttttcagtgaatcaaggatgagtttctgtttaatgcgtacagtgagaatacattaacaattactagcagtcattcatagtcagtcaacataggccatctgctgctagtacctcttttcttctcatgagttgtagcaatttctgtttaattcatatgaatgtaattacaattatattttaagttgctactatagtttctgtttaattacaatcatagtttctgtttaatagtttctgtttaattaaaattcatatgattgtaattacaatcatagtttctgtttttgttatccatattttaagttgctactatagttcatatgattattgtaattcaaatgattgtaattatttcaatgagaaaaatcactagcaggaggatctgtttaattcagattattgtaaatcatatttatgggtcaaaatcatatttttagttcaaatttgttgtaatttgtttaatagcgcttaaaattttaaaatttggcgggagcttcattttacacaacaaaattggaggcaacctaattgggccaagctacaaaaatgagaaccaaacaatgtatcatataagcctggttcattttga

SEQ ID NO: 24401 - DNA, 1090 bp, Zea mays
tctcagggtaaaaaaagcatggggaaacgatactaaatcgtcgaggtctacgcggggtttttttaaacaaaaatgggctaaaataaaaacatttcggtctcatctccgtccacatccgtcctccagcactccagctgcatcgacgaggaccgccgtagcgatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccgcgatgggccgaagctaagcgttagcttctttggtatctcaagggagcaatagcccttcgaaatttcacaagattcctgcgtccctaccagaacaagtccctatctagggactaggatggaatccatccttctgcaggctttcactttcctgataataacagtaacaataaattgacaatggtttgtgttcttctgcaacctttttggctccctggtttcgcaagggttccgtgctttgtttggcgtcatcacttgcatgtcttgtataaaaaggttgctgttgcatttggcgtacgggactaaaaaaaatatctgggtcctgtctttgacacgtggccgacgattttgccacatattgtacctacccatgatgttcagtgttgcttacgcgcgataatgtgcagcagcaaggagtcagtgttgctacagtggcatttgagtgatgtgcagttactaaccaaccaatcatccactgcacgcggcccttctcgccgtggtttaggctctgtttgattatataatccagcttatggattatataagtacacctaatgacttgtttatagattatcataatctagttatctagattatataatccatctaataaaatgtattgtttgtttatctttcgacttatttaagatggattatataatttagagggcaaataaatatggccttaggctccctctaggatggattatatgatctagcttatgtatt

SEQ ID NO: 24402 - DNA, 2069 bp, Zea mays
ggagctgctgtgtgcaagaaaaatagggtttcagtggcggcagcctccactcacgccgtcgtcgcctccgagcccgactccccgatccagacaaccaccccgcccagatctggatccacctgtaccagatctcacagcctccgcttctgctttcctttatgtcgtcgaccgcaatgtcttgggacgggtacggcgggcagatctaccctggaggcggtgttccagcagcctgagacgacccccctgcaggcgccggcgggggagatggagctgccgagcaacgttggcgacggtgaactcatgcccatggaggagcacaaggagcgcgcgctgcggcacctactccaccgatccaagcgcccgctggaggagttcgcggccgccgtggcggacgtcgcggagcagctggtgagcgcgtatctggacctgggcgtcgagtggcgcggcgcagactggcgggagcggttcctggccagtcgtacgatagcgcgagctcgatggccaggcgtaggtacccaactgtcttcttccccttccttttagattccattgagattcgtcagaacttttatgcgagttccttttttagccgataattatgtcagtatcttgagataagatggatgaattggattcaacacagatatatttgttgtggatgtagccacctttcttgcttcgtgaattatttgttgtggatgtaattccaatggaaaatatatattattgaggttagcttcagctgcgttccagttatatcgcagttactcctgcttttgggattgagctggcgttttggttatttagagtgttaatttgactcttttagttgcattatagggagctaacatcatttaaaataatttaggatgatttcattagtgatatgattctgaaaaatggtaaaggatgcttttgtttcgtctagcataatttacctaataattttaggacactaaatttggttgagaattccaaaaatgagcttaaatcatgtgatcggtccgctagcatcacataattgctgccttcctgccgtgcccatgtatgtatcttggaacaagtttgtgtgaccaaataatttgcatcagcgacagcaacgtcacaccgggtggcaactggcagggcaatgcccgatcaggtctccgtcgtcgattcgtctgaacagctatcctcatcatattttaatgcctcgtgcataatacggagtacatatctgtatttacgtcagcgttattgcaacgccctctctccgtggtctcttcttctacatactataatagtagtacattagtactaacaatgtggttggccatggcatgcttgcttcgagatcaacatgaacaatggaagcacaagtacgggaatccatgtagaaggtgatgaaaatcctgtatctgtaatggtttttgttcagatatcttctgattttgatggtttgcagtggattgttttccagcgtgaagattttccggtgccaattgccacagaataatgccttctactcagctcaacctccaaagcatgatggctctgacaaaccactctgtccaggaggtagtgttgtcttctgttgagtggcagttgacagtatatatcctgcactagatgttgtataaatatgtgaaattgtaaatgtttgatactgacttctgcttctcctgatttcttgacattgtcatttattacattagtagtttctgtcagtgtgcaacattttctccatgtcaactactaccttgttttctcatttgggaacatttctgtttatttatgtttggagtgtctagggacctatagcagatgcaaattttattcaagagaagtttattcggaagtatgtaaacttagcataaatatacgacaattgctgtctttaaactttctggtgtgtcaaattactgtttcggtgtctataatcttgcaatctgtctactagttgttggtaaatgagctttacttgtcccttggctgtcaaacagttcatgttactaaattcttccaaattcataactatttgttgccagctcctgtatgccactggtgtggtacctcggccgcgaccacgc

SEQ ID NO: 24403 - DNA, 1583 bp, Zea mays
tggtggccgaacccggggaaccgaggacccgcatcagccccctccagcaggaccctccgccgctgcagcagattctgatgacgacgatgaagaggaagaagtggaagtgactctcggtgtccttagcaaaccgaaacacccaggcctccttctccgccacttgttccccagcaaggccggcggcatcccggcgtggctagaccccgtgaacttgccgtcggagaagtccagctgctgcggtttttgtggcgagcctttgcagttcgttcttcagatttatgcagcagttgaagacaatgtagcagccttccatcgaactctgttcatgttcatgtgcccatccatggcgtgcttgcttcgagatcaacatgaacaatggaagcacaagcatgggaatccatgtagaagcgtgaaggtcgtccggtgtcaattgccacggactaatgccttctactcagttcaacctccaaagcatgaccggtctgacaaaccactgtgtccaggagcccatgtatgccactggtgtggtacctggaaaggtgataaaatatgtagtagctgtaagaaagcaagatactgttctgagaaacatcaggcactgcattggcgtactggtcataaaaatgattgcctccagataataagttcttccgctgcttcaaattcagttttgccaactgttggaaaagttcctgctaacacttcttggccagaatttgagataaaaatagactatgaaggtagatttgattgcgatagtggtgatgagaataactcgaagttgttggtgatgcaaagacatgggaaacctgatgctatgatgcagtcatggatggatcaatttgaggctgattctgacaacaaatgctgggcatcttttcaagagcgggtctcaagagcaccaaatcaagtgttgaggtattgtcgagaaccaaatgctaaacctctctgggcgttatcttctgggtgtccatcaaatgctgatatcccatcatgtagctactgtaaaggtccattatgctatgaatttcaggtaatgccacaattgctatatttctttggtgtgggaaatcaaccagactcccttgactgggcaacaattgctgtctacacgtgtcaaggggcatgtgaccaaagtgttagctacaaagaggagtttgcttgggttcaattgtaccctacaacaactacgaggcaataataatgtttgcctattccttgctgtccaatgctgcaggtgtcaaaaagtttgcagaaagtcagaaacaattcagtaaatacccccaccagaagaattggaggttggaatgctcgaggcagtgagtagtgagagcttcttgattcccattattgcacttatgccgagtatagatattttaagtttcacttgttctacattttaggtgcctgatttttttgttcaggcaacaggcaattttgttattgtttgaatattgaaaaaacatgaattgtctcttgtgagttatctttttaattgtactagttggttgtataagattgttgcatgctcaaaacgcaggcacttcaaatatagtaaccctcaatcaaaaaaaaaaaaaaaa

SEQ ID NO: 24404 - DNA, 1857 bp, Zea mays
gttctattttgtagctcaaagctcaaaggtgaggctagggtttctttgcgccaaaccagcgaggcagcgactgttttgtcgccacaacactcccgccgaccccctcgccgccgccgggaatggagaccagcactaagaagcttagcagccttcgtatcacctccctggatgacgatgacgaagagaccgagatcccgcaccagccccctcaagcaggcctctcccccgctggagcggattatgaggacgacgacgatgaggaggaagaagccgaagtgactcttggtgtccttagcaaaccgaagcacccaggcttcctcctccgccacttgttccccagcaaggccggcggcatcccggcgtggctagacccggtgaacttgccgtcgggaaagtccagctactgtggtttctgtggcgagcctctgcagttcgtcctccagatttatgcaccaattgaagataatgtagcagccttccaccgaacgctgttcatgttcatgtgcccatccatggcatgcttgcttcgagatcaacatgaacaatggaagcacaagtacgggaatccatgtagaagcgtgaagattttccggtgccaattgccacggaataatgccttctactcagctcaacctccaaagcatgatggctctgacaaaccactctgtccaggagctcctgtatgccactggtgtggtacctggaaaggtgataaaatatgtagtagctgcaagaaagcaaggtactgttctgagaaacatcaggcactgcattggcgtactggtcataaaaatgattgcctccagataataagttctgctgcttcaaattcagttctgccagctgtaggaatagttcctgctagcatttcttggccagaatttgagataaaaatagactacgaaggtacttttgattctgatagtggtgatgaaaataactcaaagtcattggtgatgcaaagacatgggaaacctgatgctatgatgcagtcgtggatggaccatttcgaggctgatgctgacaacaaatgctgggcgtcttttcaagagcgggtctcaagagcaccaaatcaagtgttgaggtattgtcgagaaccaaatgctaaacctctctgggccttatctttcggatgcccgtcagatgctgatatcccatcatgtagctactgtagaggtccattatgctatgaatttcaggtaatgccacaattgctttatttctttggtgttggaaatcaaccagactcgcttgattgggcaacaattgttgtctacacatgtcaagggtcatgtgaccaaactgttagctacaaagaggaatttgcttgggttcagttgtaccctacaacaaccacgaggcagtaataatgtttacctattcctcggagtaactactgtccaattctgcaggaatcataggcaagtgcataccaccacctttgggcactagaattttgagatatgctgtggcttcaatgtttccactttccaagtctattgctcgtgcagggagttaagcatcttccgaccgtggcccaatgcttggtgctcgttacagtgcctttgatccatttaggcactacccttgggcccacgtagacgtgatggcaaatagttgcatacttccattttgtggtggccaccattttcggtttaattgtcatcatcacatcattaaaaagctttgttgttttttgttatctaaaaggatcattggtctcagaaggtgctcgcattcatgtaaacatttccttcatcggctaaagttttgatgttggttttgattttaaatggaacattattatgtcaatattccagtggtgttttcaccccacgagcgcgctcctgggacttt

SEQ ID NO: 24405 - DNA, 4343 bp, Zea mays
  misc_feature (2463)..(2463): n is a, c, g, or t
  misc_feature (3227)..(3227): n is a, c, g, or t
  misc_feature (4205)..(4205): n is a, c, g, or t
cgcggcagaacaaaaaagacaggctactattgctaacttaataagtagtagagatagtggagatggagaaagaaaatagaaacatgagaacttttaaaacatcaacagaaattactttccctaattagactaaatattagtttgttctagtatattttcctttaattttaataaaaaacaggaaatcgaaaattagaagaagaccgagtcccatcaaactatgtatagttttttgataaattaatgtattaccccaaatatcaatgtcaagattatttttttatcctcgtaaccagagatgtttcgtactcaacaagagtctcattcactttggtaaatttatcttaccttgaagaggatcaatatgtttgacttgaaaagtccgtttcgtcaatggccatcatatttcagattaaccgattttgaatcgatctttcacgaatctgctttgcatgtaaattacgtattccataataaaaacacagggccgcctcatgaggcccagaaggtatgacgatatagatcctcgaagcggcacgtactatctccgtagtgcggcgattgaggttttgggccgctttctcagggttttctatcgtctcgtctcccatcgtcgtcgtcgcccgccgctgctaggtttggggtttccggtggccaggacccaagccagctccgtcgggcgccgtggggaactgctgggaggggcggtcgaccggcggtgcctctgcttcgggttctccgtaccggcgtcggaggggatcggatggcataaggtaccgcgtgacctccctcctcgactcattatttcaccgatttattctgctgggacgtgcctatgcgcttgttccatgtttcgttgccaggattattcttctgggatgtgcctacgcgcttgcttgcgcttgttccatgtttgttgattggattaatgtttggcgtggcaagattgtttctttgttgtttggattgaggtatggtgcgctaggtttgttgcttgactgaagtttcctttgctaacaaataatgtggagtgattgcctgctgtttgaggggttgtctcaacgggagatctgttctctccgtgattgagggggttggaccttggctgtgtattttttctcagattcgttttgttctttgtaatgccatagttgtttgccagccaattggtgtgggttgtatcagtactagtaatttgcccgtgccctgcgcgggtcattggtttatttgtttacaccgtttaaaaaagtgttgctttagatatatgaaagcaacaataatctagtaataggacaattcaatctacaaatatagcagcataatcagcatagatgttatattacaatgacgctgcttgaagagagctgagcagatatatatacatgtattgaagcaacaaaatgctggtcttaatgaacacaaaataatgatactctgaaataaagtttacagtgagtttctgcagccacgcactgaacgcggatcagtcatatgtacaaatttctaaaggcaacaaaacactggtgttagaggcaaaaaaatgctgattaaaataatcaaaaaatgtgatgcttttcacgataacatttaatcttcgtgaagtccactgtccttttttctcgatatgtagtgctcatttttttcagtctatatgtgcctattaagctattttagcgcggtgatcatcatctagggtggaaaatagtgcctaccctgtacatgtatacatatatgtacatatgcatgcagatatttaataatataggctaccactttgtgtgtatacatatatatatatgatccatgttcactatatgtactgatacattgcatatacaaatatttattacatgtaaatatacatggacacgcaaatgtcttgtgatgcatgtgattataccaactaataaaaaaaatcgagaaaaggattgcactgtcgattcctcgtatcctggccattaagccatggtttggctaccacactccgtggtcagataccacggctccaaacagaaacaacagaggacagaggaggagaaaccaagtgcatgcgtagcttttgtcagcaaagaaaaaattcgagagtgctttgttgaggcgtgcctacctttaaaactcaatcaaatagaatataacctataggatatgtttaaataaaaaaccttattattagttagctaatttttagcttaaattggtttcagtgtatccgaatacaagggcgaatatatgagttgatttttagcgtaatctttcattatttattagacaatcacatttaatttgagctaaattagttccacctacgaatcagccgtgtgtaatatgtcgttcttcacttccacttccatcattatagtgactatccacttccattggtcccttgcttcttcataagttaagcaaaaacttcgagcagaaatccatccaaaatttgctcccgtacaccatgcaggatccccntttctcccgatgaccaatagccgcaaagattaggtgggggctgtgtgcctgtgtattagggaaggggcgatggagtgcctgtgtctcttgtttgacaggggatgacgaaatagattgggcgcagacgacggggacatactcacatacgtcgaagcagtctcctcgagcgacgaggtaacaacggtgagggccacgctggagatcaagcgactgatctgccacgctccagatttcgccgtgttgtccgggcttgtgtcggcctcctcgtgcggtcgtcgccgccgcgcagacccagtgctccgttgttcgcgtcgatagttgcaggtcgtcgccatatagttgttgatgcaggcttctcagtggcacatcggttgctctcggactctgattaggtgccccagaggatcctactgagctgcctcagctgcgtcggcgtttcctacgacgaagtgaggatagatgcgttgcgtgggcggcgaggccgctagctgaagtggggacaaatacgtcgctacctgaagacgccatggatgcgagctctgatgctgcaaagaaagaggacatacgagatagagcagtcttgtgctatccacgggagcttctcgatggctctgaaaccccgcgcctacaatggctgctacctgagatgctttcgtgggccttaggagcagcatcgggcggctagctgacgtggacgtatgtgtgaggcaacgacaagcgattggcgacggagacgtttgcgagcactcttcaccgccgtcgtngggcgatcgcctttttttccatggaaaacgtttcgtcgtctgtgaaaccatctggtagtaacccttttcattcccaaaggtcgcgtgagtcagaagtctggaagctacgcgcgtgagtacgtattggaccgacgttttgacgacgccgtccaaagaagatctgacggccgaagtttttggaggtggcgtggctgaaggaggtgcccgctttgcgcccgcgtttaatagatataagaattggtgggatttgccgattcggcgttggttgttcccagtgttggtggtttttactgcaaccgggtgattattacttgtactcttgattagcaagtcagcaagaggagctcaagccacgtgttctaacgtgggtagtcgtataactgtggttcctctgcccataagtgcagattgatgtacggtggcggggaagggatctgggattattttataaggacatttatttctgtaagggctgatttgatgactagggatcacgaggggttccatggaagaggaatccccttgcttttcaattttgaatagcaagggtatttctccccatggatccatccatggtcaccaaaccagccctaactgtataggcccagcccagaggatggctctatggcttctttgcccgctactctggtagcacgaaacttggcttcctgtaggttgctgcgttgcagccatgtaagttgggcttcctgtaggtagcacgaaacagaggccaaagtgtagttcttgatgcatttcagttattggtgtttgatcttttttagtggatggtttctatgaattggtagatggtaacaagtggtatgattttgtgttattagtcattcaaatattacctttaaaaattggtagctgagtggatcgtgtatttggcctatagccttgtcaagacgcccaaacgaagtttggtgtgaggtcatttggcctctgtaaactaatattgaaaactatatcatctcnatgaattaacatgtttatggaagattttattgtaggtcatccaacttatatggaatttgccatttcacaccgccaaaatccataattgttgggtttagggatgaaagtggtaatccgaactgctagaacaaatttaat

SEQ ID NO: 24406 - DNA, 1301 bp, Zea mays
tttggtcttcagtagagcagtgcgtgataacatggtaaaagtaaaaattgttgcttgtgaaatgaatccagaggcaccttattctttattgcttctgatatttatacatgtacaggaaaaaggagtagatgccggtacaggacccagacgcctcaatagagaagtggagacaaccctgtaggacccagacgcctcaatagagaagtggagacaaccctgtagaccaggagccgtctgttccttcctgagtggcccctggaacgtcggctgggagcagtagtaactgtttagatccggtaacaatagttagattgtcaaaactggactacgacaacaaccaaagaaacctgctggtgcaagagtaactaccggtggctggcgttaagtctggaacgctagagcggtatatttctaaagaccaagatgaattccggaacttctgaaatggagtctggaacgctagagcggtacaaaaataaaatcttcacgcagttacccccatgaggcctagcgcgctcactgggcagcatatctcctgattgtaaaacaacagacagggggcttgtcccgtatgcaagatgcaattcgcaaaacattttcaggcaaaaggctagcctttcccctagagcaaaatttctcagcggcacggcacgcttgatgaaagtacagacagcacactatgccagtggtatgcacaataagacatacctttttttttttttttttcgctccaagcataagaacacatatatagtatctgaaacccaatacagaacgtgaagaaactacccacatataatgatataacgccatgtcccagaaaaattccccaaccaattccataaaaccaacaagcaccccctcgaaggttccacaaaccaactcaatgaccttgcgcatcaagcagaaccaaactaattgctccataaccaatgcctgccaacattcattgtgcagcacctcactgctgcttgcactctgcaggtcgttcgccctgctgcccttcccctccagcagttcccttggtcttctttgtatcgtaatcatccatcatcaaatggcaaaacatactcagaactcagaagctggaaagggtgaagtgatattccccattaggccttgtttggttattccaattacacatggattggatgggattggaaaaaattaaaaagaagtttgacttgcttgggatttaaacacacccaatcccactcaatccacatggattaagagctaaccgaacaagcccatagagagacaaaaaaaggttcccatacctttgaatcgtaatcatcatc

SEQ ID NO: 24407 - DNA, 1096 bp, Zea mays
  misc_feature (15)..(61): n is a, c, g, or t
  misc_feature (1027)..(1035): n is a, c, g, or t
ttttttttttttttnnnnnnnnnnnnnnnnnnnnnnnnnnnnnnnnnnnnnnnnnnnnnnntgatatttatacatgtaccggaaaaaggagtagatgccggtacaggacccagacgcctcaatagagaagtggagacaaccctgtaggacccagacgcctcaatagagaagtgggacaaccctgtgaccattttccgtctgttccttcctgagtggcccctggaacgtcggctgggagcagtagtaacggtggctggcgttaaagttcacaaatctgctttctttatttctaaagaccaagatgaattccggaacttctgaaatggagtctggaacgctagagcggtacaaaaataaaatcttcacgcagttacccccatgaggcctagcgcgctcactgggcagcatatctcctgattgtaaaacaacagacaaaattcaagacccgtatgcaagatgcaattcgcaaaacattttcaggcaaaaggctagcctttcccctagagcaaaatttctcagcggcacggcacgcttgatgaaagtacagacagcacactatgccagtggtatgcacaataagacataccagagtggcaaccatcttcactccaagcataagaacacatatataatatctgaaacccaatacagaaagtgaagaaactacccacatataatgatataacgccatgtcccagaaaaattccccaaccaattccataaaaccaacaagcgccccctcgaaggttccacaaaccaactcaatgaccttgagcatcaagcagaaccaaactaattgctccacaaacaatgcctgccaacattcattgtgcagcacctcactgctgcttgcactctgcaggtcgttcgccctgctgcccttcccctccggcagttcccttggtcttctttgaatcgtaatcatcatcatcatcatcatcctcgtcatcttcgtcttcatcatcattgtcttcatcatcgtcatcctcaccatccataacttcaaactcctcatcttgagcagccnnnnnnnnngtgaaccacgagacagcatgtgggataatcttgtctctgatggtagatccaatatcataat

SEQ ID NO: 24408 - DNA, 830 bp, Zea mays
tagggccctttttttttttttttttttcaaaatctaaaattttaaatatctgaattactcgatccgaaatttccggtaaacagaatggccatccctacaaccatccctacacagaacaattgattttgctttccaaataccaaaagggctccgcaaccagagctttccaagcaccacgaccaaaagaccaaacgagcgttgtttcctcctgcattggccgacactactgctcttgtggcctccccccacaacatgacgcctgtttctgctctgaaggtgtgcagaacagttctttgattggataatcccaaaccaatcgtgcttaagggcaataaaattcgagaacgttgcagctgtttcagcagaacatgacctgaagtaattgcaatggggaattccatctacctacctccgagatctacgacaacagctccagccaatcacagtggcctagctgaaacacgagagtgagaagcgctcgcgcgcgtagcggcggcggcggcatccatcctggccaactcttcctccagggcgaagatctccgccttcaacgtggcgatctcctcctcgagctcggctttctccgcctcgcgcctgacgcgcgcctcctcctcctccgtcgtctggccagtgggtggtagtccgggtcttacgccgcaagatgacactccaacggccgccgcgacatcgcttcggccgccgccagccgtcgaggctttgcccttcgaggcgagggtggagctctggtctgacatgagttgggtcgagcgtggtaccactaccgcccatacatccagaaacggcccggcccggccggcctcgaggtaccc

SEQ ID NO: 24409 - DNA, 1504 bp, Zea mays
ttttttgctgtttttttttaaaaataatcacattgctgataagattatggttatggcttcaagataagtatctcgtcattgggcttcagacaacaagatctgtaggttcatagattttctcctcggtaaaagagaactaaatacaaatgtcaaaaacttcccatcacagatctggtaggaggaacaacgtggacagctctgaagtctgtacaagcagcaaaagacaggcacaaaaatgtgatggcatcgtatgctggaaaacagtcataattctctaggcaacgctgctgtcggacattttcctaaggtgttccacagtatgtaatctccagaagaagcctgcattgagtattcagctggagcttttgcagaaggatagatgtttacagattttggatcaattgcaagaccagacagcgtgcctccagtaaccttaaaagaaaccttagcataattatacgcttgccaagacaatggctcttctaaatcaactgcctgaagatccttattgattttttccattatgtagtcatccaagctagctccattcttaacgttatcttgttcactgtcactatcttcagtatatccagtgcttgaaatgaatcgagatgatgaatttattctctgtgtcgttctaggctgaaatttaacagtaccagggaaggtagcgtcaatgctcctaccactaagtccccgtccacttgagacaattctccattcaattgaatgctctgtcattgaaactgtcccaattgatggatttccgtcatatgatgcaactcttcttcgagggaatggcattgtaatcatgcaaaagtccataatgaagggagacttgtaaccctccatcaatgacagcttaaatagaaaagcaccttcattttcagaaaccatggacaactgatagaaccctttaacaggaggagcaatgttgcatggtgcttgataatgcatcaatacaaaatttcctaatggtggctgaaaaaccagggtttgcttattagcagtgggctctgaagcttgaacacagtgatggaatgatgaaacctcaatatgagcagtttttaaaccagtcaatggcaaagaaatatcaggtagtccttctagttcagccctacaggtcacctgtcctgaaacagaaaggaaatctggaacatcatcacggtcatacagtgcagcatttatagtctccaagctagaaaacagaatcctttgcctccctttgtacaggtagggcttccaggcaggttgtttctggtctgttggaagagggtcaccagaaaatccagtagttctaatcgaagtaacattggcataattgagatcttgaggtgtgcctgccaaaacaaactattagctaagttggttcattagagtataggtccatgaagaagctttacaagagaacatgaagtactatacgccatgataggaggctttgttaccactaaccaaaaggcattgcaccaatgatgaagttctgcaggtcgaccttgaggat

SEQ ID NO: 24410 - DNA, 1063 bp, Zea mays
aaagaaccaaagactcctgtccccatccgcttaattatcaggctaacaacaacaacatccgctggctggcactgctctgccgcttatagctcctccctgaaccccaggaggaagcacactagctaacccccatcgatccgtgcagagcgccagcgagaacaacagcaaaattaagatgcaaaagcttgagaactactaaagcaactagaacatcaactaaacctactgtaacaacgcagcaaacggacaagcagcaagagatcctgctggctagccaatgtgctgcgttctcacatgcctaatttctaagaagagaagctccgagtgagtgagtgtgagtgagttcgttcttggagcaaaaaccagtgacgtacacaaagcagcgagagatgtagagaaaccgaccgaccggccaaccaaccaaccaaccaaccagccagccagtcaaaaagagtgcttcgctcccaaccttgctcctccattttgctgcagccatccgttgtcgtaggaagcagcagcaaagtaactacctgggcggtgcatgttgaggagctagctgacggtgatatatgttgctgaattcatgcatggtcgtatgctgctgaaatgctcgtgatggtggttggtggcatgttgggcgcgcggagtaatctgcgctccactgctctgccgtcgtcagtggtgagaagccgaggacacggacggcggcggcggcttgtcgccattgccgccgttgtgctcctcgtcgccctgcatcctggtggggatgcggatcccggagaagccgacgccgggcgagaacccgatggccgacacagcggggctgagcccgccgtgctgcatcgggttgtcggcttcgacgctctccggccatcctcgctcggagggctggttactggactgaaggggtcccctctggaagaagaactggctctggccgccaaacgccgcctgcatgtgcgccgcctgctgcgacacgttgaacaggtagccaccagcgctcccgccgcctgggtcgggcacggtccacggcaccatgcgctggctctgcgcctggtcgtgc

SEQ ID NO: 24411 - DNA, 840 bp, Zea mays
  misc_feature (2)..(2): n is a, c, g, or t
  misc_feature (5)..(5): n is a, c, g, or t
  misc_feature (7)..(7): n is a, c, g, or t
  misc_feature (14)..(14): n is a, c, g, or t
  misc_feature (777)..(777): n is a, c, g, or t
gntcntngaacatngtggactcccccgggctgcaggagagagacagagagagagtcccccccccccccccccccctaatcaaaatgttgctgccctagaggaggagctgggaaagaagtttgatgaattaaacatagtttctatggagaatgctgaactaaaatcgcagctccagcatattgaagagattagttgcactatggaggagttagctgataaaagtgaagtaattagaagacttgtagaaaagttgattgaatcgagaactttaattgatgaaaggagtgtctgtcttcagagcttgcaaaatgatttctccaaactctcagatgaaaagacatcatgtgacactgagttgcttatcttgaaagagaagctggagatggctcaggcacttgcagaagaaagtgaagcaattgctacagaatctcggcagatagctgaggagcataaggcatatgccgaagggaaggatgaagaagtaaaggtattggagaggtcaattgaagaacttgagaatactgtatgtgttttagaaagcaaagtggaaattgtcaaggaagaagcagagcggcaaagaatgcagcgagaagaactagaagtggagctgcagaaagttaggcaacaaatgctagctgtaccaccctctgggaaagcaaggagatatatggaagatggaatgattgatttagctgactcatccaggcacccaatagatatgcacaatgagctcctcagtgctcaagagaccattaaaatactttacaatcgagtttnctggaaatgaatcaaagattgctcagtgccatgcccaatactcagagcttaccattcatgctg

SEQ ID NO: 24412 - DNA, 704 bp, Zea mays
  misc_feature (681)..(681): n is a, c, g, or t
ggccgcttttggccgcagaggccgctttttttttttttttttttttacaaaataaactcgatggtccatcattaattaattaaatatacataccatataagcaggaatacaattaagcatcatatccatgtgaaatggatcgtgcagggaccttacaactcatcagtaatcagcaaatgaagccagcaagaaaagcatatacaacacaacgtacatgccagcacgtgcgttttcttattgttaggggggaaaaaatcaagtaagccaataaatagaataaacgtccaccatcgaactgccgggagtaggttaatttagcacggcttagtgcagatgcagcggcggcggaaggtgctgcacctgccgccggagaagccctcaccgcggcacacgttggcgcagttgtccgacgccatgcatgccccaaggaatcgctcgctgtccttctcgcattccctcgccgcctgcgccacatcggtggtcacaatgagcaggagaagcaggatgatggccggctggaacatgcgtgacgactccattacctttgtcttggcaggattatatatatatatgcactcttatatatgaattcttaactgtttcaaatatggctcttcttaaattgtgtccgcccggccggcctcgaggaacccaatcgccctataggagtgtatacgctgnagtcgtattacgggcgacagctc

SEQ ID NO: 24413 - DNA, 1585 bp, Zea mays
cgggtatttgtgttttttttgtcgttaaataataccaagataccaattaatcaatatctttctctatactaatcaattcaaaggcaaaagcaaagggagtaacttgccacagaattatagtatttcaattcaatgaatccaggaagttgcattcagatctccgtgactactaatttgacagaggagttgcacagcacaggttacatatctaatcttaggagctggaggcaaccgctggcagcctgaaactacagtccggttcatgctctccgggtcagaaaccagcaaacacaggtctatctccgacactgcctgcgccaacatcacccagcatacaaatccctttctgatatcttgtgaagcacattcgtcgacatgtagggcgacacacatccgcggacctgcaaaagagcagtaggtatctcaatgagaccctgttgcaaaagatcaacgctttgcaggcgctggagaggaacaggagttattagatataacaggcctttttgaatatcgacgccccttatgatgccaagcccaacacagtaagggattgatctggttccctcagatgcattggaaactgccaaaccaactatggttgcattcagactatgccatatctcaccagcaggtaccttacaatgaagatgcacaattgcaacatctgaaaatggtacttgataaggtggaagtgaagctagggcataagcaagctccttattagttgaaagagagatgttgcttggaaaacattgtttcaaatactctacaagtcggcgttcacgcattccacatgaatctttctgaattaacaacgatctatttgaggcatcatgaaatgcagcatcgatgttaatcatcataggtcctgtttgcccaccatctaaccaaaaccctccatcagggagatttttgttcttgattgtgatgcgtatctgaacaactattgtggggcagatataccttagcatctctacgagcatatcaaagccagcaccttttacccatccaggtgtattgacaattagtggcagcatttcattctcatcgcatcgatattttccaacaaagtagtcatacgaatggaatagacaattcagatatgcttctggatctcttttcgatgaaatgtcaccaaagaagtagcacctttcagcttcccgtaggcttgggttcatcaaatctgcgatagcttcgtcgaggacatggaacgagaggcatcccggcggcccgaactccggctgccccacgtcggtgtccagataagcaaccttaccatgcctggggagcagcgcgttgaggaggacacgggagaaggtggacttgccgctgttcttgggcccgcacacgacgaccaccgggggcgtggggtgggaggagacggtcgatacagcggagtcccagtccggcgggactaccgcctcggtgcggggcgccggggaagacgaccgcggaggtgttcgcgtcggcgtcgcgcggccgcgggcgccggccatgtcaggaagacctcgtcgtggttcgcagagggcagagggcagagcaagagcggcgcgagcccaagttcatcactcctgcttcctccggc

SEQ ID NO: 24414 - DNA, 1310 bp, Zea mays
cattgggtacctcgaggccggccggggccggcaaccacacacacacacatcctccaccaccattcatcagaaagcgaagcacaagcctctgatgccaagccaaagcacacacacctcctccagcctttcttcctctacagccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggacagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcctactgatttgtaacgtagatgttagccctggatttgcaaaacggaacggaatctgtaaactgatactgcttgagtcgaatcgatcgaagtgattctgcaccagatctccctatttcatttatcagaatcgaaagccagctgacagagtcacagtaacagcccgttggacatagcagcaggtgccgaagccaagaacatctgaaactgaccgtcggataacctacgatgggagtagccttttactgcttctaagctttagcctggatacaagttgtcactacagtagtcagtagggcagtaacttggtgcatctccaagagttttcaaaacacactgtcaatctagaaatttttggtgatgtagcttctcccacaaaaaaaaaaaagcaaattcttcagtgatgtggtttctaccacttgtgctcttggattctcagttccttgactctacagtatttt

SEQ ID NO: 24415 - DNA, 815 bp, Zea mays
cattggctacctcctggccggctcactcccaccaccaccacctcctccaccgttgctaccccagcacgctctcgccgtcgccacgccctatatctcgcgcctttcacctcccactctttctccatccgcacgctcgcctccctgctagtgctacgcttcgtgccgccgccgcaacctattccttcccgttccagattgcagatcatttaacataaatggctgacgcagaggacattcagcccctagtctgtgacaatggaactggaatggtcaaggctggctttgctggagatgacgctccccgtgctgttttcccaagtatagttggtcgtccacgtcacactggtgtcatggttgggatgggacagaaggatgcttatgttggtgatgaagcccaatccaagaggggtattctgactttgaagtaccccatcgaacatggaattgtaagcaactgggatgacatggaaaagatctggcatcacaccttctacaatgagcttcgtgtcgcaccagaagagcacccagttcttcttacagaggcccctcttaacccgaaggctaacagggaaaagatgacgcaaatcatgtttgaaaccttcagtgttcctgctatgtatgttgctattcaagctgtcctttccctatatgctagtggccgtaccactggtatcgtcctggattctggagatggtgtcagtcacactgtcccaatctatgaaggctacgccctcccacatgccattcttcgtctcgatcttgctggcagggacctcactgattccctcatgaagatcctcaccgagaggggctac

SEQ ID NO: 24416 - DNA, 1462 bp, Zea mays
ccggccgggattatctcggggtacctcgaggccggccgggctccatccgcacgctcgcctccctgctagtgctacgcttcgtgccgccgccgcaacctattccttcccgttccagattgcagatcatttaacataaatggctgacgcagaggacattcagcccctagtctgtgacaatggaactggaatggtcaaggctggctttgctggagatgacgctccacgtgctgttttcccaagtatagttggtcgtccacgtcacactggtgtcatggttgggatgggacagaaggatgcttatgttggtgatgaagcccaatccaagaggggtattctgactttgaagtaccccatcgaacatggaattgtaagcaactgggatgacatggaaaagatctggcatcacaccttctacaatgagcttcgtgtcgcaccagaagagcacccagttcttcttacagaggcccctcttaacccgaaggctaacagggaaaagatgacacaaatcatgtttgaaaccttcagtgttcctgctatgtatgttgctattcaagctgtgctttccctatatgctagtggccgtaccactggtatcgtcctggattctggagatggtgtcagtcacactgtcccaatctatgaaggctacgccctcccacatgccattcttcgtctcgatcttgctggcagggacctcactgattccctcatgaagatcctcaccgagaggggctactctttcacaaccactgccgagcgggaaattgtccgtgacatcaaggaaaagcttgcatatgtcgcgctagactatgaacaagaactcgagaccgccaagagcagctcatcagttgagaagagctacgagctgcctgatgggcaagtgatcaccataggcgcagagcgcttcagatgcccggaggtgctcttccagccatccatgatcggtatggaagctccaggaatccacgagacgacctacaactccatcatgaagtgcgacgtggacatcagaaaggacctgtacggcaacattgtcctcagcggtggatccaccatgttcccaggcatcgctgaccgcatgagcaaggagatcaccgcgctcgcgccaagcagcatgaagatcaaggtcgtcgctccgccggagaggaagtacagtgtctggattggaggatcaatcctcgcatccctgagcacattccagcagatgtggatctcaagggctgagtatgaggagtctggtccagctattgtccacaggaagtgcttctagacgtcactcctcgtggaaatgcctttgtttcatgacatatctatgggtggtcgctctgctacagctcgcagttttttgtgtatgccacaagccgcatatatatatatatatatatccattctggtaacgttgtggagtcagccgagccctgtatgaagtatgtagtttggtttgatatatattgattggatc

SEQ ID NO: 24417 - DNA, 934 bp, Zea mays
aactttccagtgcggcaccggcctctccctcctttacatctcaatcccaccgtcaccggccaccacccccgccgctcccacgccctcgcaccgcacctatatctcgccctcctccttcccccctcttcccacccaccattcgcctgcgttctccgctgcctcccgccgccgcctccccccggtcttctcgcttcagatcagttaaagtaaatggctgacgcggaggacattcagccccttgtctgcgacaatggaactggaatggtcaaggctggctttgccggagacgatgctccacgtgccgttttccctagtattgttggccgcccacgccacactggtgttatggtagggatggggcagaaggatgcttatgttggtgatgaggcccaatccaagaggggtatcctgactttgaagtaccccattgagcacggaatcgtaagcaactgggatgacatggagaagatttggcatcacaccttctacaatgagctccgtgtagcacctgaagagcaccctgttcttcttacagaggctcctcttaaccctaaggccaacagggagaagatgacacagatcatgtttgagacattcagcgttcctgccatgtatgtcgctattcaggccgtcctttccctatatgctagtgggcgtaccactggtattgtcttggattccggagatggtgtcagtcacacagtcccaatctatgaagggttatgcccttccacacgctatcctacgtcttgatcttgccggtagggatctcaccgattccctcatgaagatcctcactgagaggggttactctttcacaaccactgccgagcgggaaattgtccgtgacatcaaggagaagcttgcatatgttgcccttgactacgaacagaagcttgagactgcgaagagcagctcatcagttgagaagagc

SEQ ID NO: 24418 - DNA, 1728 bp, Zea mays
attccgcgttggcagccgccctcctccccaaggaccccaactttccagtgcggcaccggcctcctttacacctcatggccacttggcgcccgccggggccagccactctcacggttgccaccctagcacgcgctcgccgtcgccacgctctatatctcgcgcctctcgccttccactctttctatacccgcccgctcgcctccctggtacgcttcgtgccgccgccgcaacctcctcctccccgtcacagattgcagatcatttaacataaatggctgactcagaggacattcagcccctagtctgtgacaatggaactggaatggtcaaggctggctttgctggagatgatgctccccgtgctgttttcccaagtatagttggtcgtccacgccacactggtgtcatggttgggatgggacagaaggatgcttatgttggtgatgaggcccaatccaagaggggtatcctgactttgaagtatcccatcgagcatggaatcgtaagcaactgggatgacatggaaaagatctggcatcacaccttctataatgagcttcgtgtagcaccagaagagcacccagttcttcttacagaggctcctcttaaccctaaggctaacagggaaaagatgacacaaatcatgtttgaaactttcagtgttcctgctatgtatgttgctattcaagctgtcctttccctttatgctagtggccgtaccactggtattgtcctggattctggagacggtgtcagccacactgtcccaatctatgaaggctatgccctcccgcatgccattcttcgtctcgatcttgctggtagggacctcactgattccctcatgaagatcctgactgagagggggtactctttcacaccactgccgagcgggaaattgtacgtgacatcaaggaaaagcttgcatatgtcgcgctagactatgaacaagaacttgagaccgccaagagcagctcatcagttgagaagagctacgagctgcctgatgggcaagtgatcaccataggcgcagagcgcttcagatgcccgggggtgctcttccagccatccttcattggtatggaagctccaggaatccacgagacgacctacaactccatcatgaagtgtgacgtcgatatcaggaaggacctgtatggcaacattgtcctcagtggtggatccaccatgttccctggcatcgccgaccgcatgagcaaggagatcactgcgctcgcgccaagcagcatgaagatcaaggtcgtcgctccaccagagaggaagtacagtgtctggatcggaggatcaatccttgcatccctgagcacatttcagcagatgtggatctcaagggctgagtatgaggagtctggtccagctattgtccacaggaagtgcttctagacatcacctagccttaattctcctctgggaataccttcgtttgatgacatatctatgggtggttgctctgctatagctcgcagtttttgtgtttgccaatatatccggtaacattgtggagccagccgtccactgtatgaaatatgtagtttggttatatatatatatatatattgattgtattatttactcgattctatgggttcttggatacctggaatgtgcatgatattttttaatttttgtaacaatgtgtactccgtaacaaagttcgcgtttgaaacatcgtttctgctgctttagtatagatttgttcattctctg

SEQ ID NO: 24419 - DNA, 1657 bp, Zea mays
cattgggcacctcgccgcccgccggcactctcacggttgccaccctagcacgcgctcgccgtcgccacgctctatatctcttggggccccccggggcccggcgggatacccgcccgctcgcctccctggtacgcttcgtgccgccgccgcaacctcctcctccccgtcacagattgcagatcatttaacataaatggctgactcagaggacattcagcccctagtctgtgacaatggaactggaatggtcaaggctggctttgctggagatgatgctccccgtgctgttttcccaagtatagttggtcgtccacgccacactggtgtcatggttgggatgggacagaaggatgcttatgttggtgatgaggcccaatccaagaggggtatcctgactttgaagtatcccatcgagcatggaatcgtaagcaactgggatgacatggaaaagatctggcatcacaccttctataatgagcttcgtgtagcaccagaagagcacccagttcttcttacagaggctcctcttaaccctaaggctaacagggaaaagatgacacaaatcatgtttgaaactttcagtgttcctgctatgtatgttgctattcaagctgtcctttccctttatgctagtggccgtaccactggtattgtcctggattctggagacggtgtcagccacactgtcccaatctatgaaggctatgccctcccgcatgccattcttcgtctcgatcttgctggtagggacctcactgattccctcatgaagatcctgactgagaggggttactctttcacaaccactgctgagcgggaaattgtccgtgacatcaaggaaaagcttgcatatgtcgcgctcgactacgaacaagaactcgagaccgccaagagcagctcatcagttgagaagagctatgaactgcctgatggacaagtgatcaccataggcgcagagcgcttcagatgcccggaggttctcttccagccatccttcattggtatggaagctccaggaatccacgagacgacctacaactccatcatgaagtgtgacgttgatatcaggaaggacctgtatggcaacattgtcctcagtggtggatccaccatgttccctggcatcgccgaccgcatgagcaaggagatcactgcgctcgcgccaagcagcatgaagatcaaggtcgtcgctccaccagagaggaagtacagtgtctggatcggaggatcaatccttgcatccctgagcacatttcagcagatgtggatctcaagggctgagtatgaggagtctggtccagctattgtccacaggaagtgcttctagacgtcacctagccttaattctcctctggaaataccttcgtttgatgacatatctatgggtggttgctctgctatagctcgcagtttttgtgtttgccaatatatccggtaacattgtggagtcagccgtccactgtatgaagtatgtagtttggttatatatatattgattgtattatttactcgattctatgggttcttggatacctggaatgtgcatgatatttttaaatttttgtaacaatgtgtactccgtaacaaagttcgcgtttgaaacatcgtttctgctgctttaatgtaggtttgttcattctccaaaaaaaaaaaacca

SEQ ID NO: 24420 - DNA, 861 bp, Zea mays
  misc_feature (32)..(32): n is a, c, g, or t
  misc_feature (97)..(97): n is a, c, g, or t
  misc_feature (244)..(244): n is a, c, g, or t
  misc_feature (339)..(339): n is a, c, g, or t
  misc_feature (343)..(343): n is a, c, g, or t
  misc_feature (391)..(391): n is a, c, g, or t
ttttttttttttttttcactaaggacacaacngaaactgaagataaacacactcaagttactagtttatggccttggcaaccgatcgatgagacagnggattcgcacgtgcgtggaagtgcaccgagccatcgagccatccatccacgtaaacctctactctatcctgtcacctaaatcattgctacaccaagagcacatagaacaccctaatttgagtaattgagtacctaggctgcatccanaccacagattacaacacagcaagctcggtcagggtccacggatcggaaccagatcagcagcacccaaatgaagctcatgtaacaagaaccgaatntganaggcatttcaagccctaatggagcctcctttcgcccatccgaaggganaaacccaccgatccgagtgcggcgaggacgacgccggcgaggaagaagacggggcggcggccgcagccgacaccacagccaccgcgctccccgccgcagccggcgcggaggaggaggacgaggacgcggcggcgacgaggagcgaccggatgtggatccacgacgaggacggcggggaggacgcggccgtcggcgaggaggacgacgacggggaggacgaggtgctggatcgccgcagcgccttcatgtccttgtcacccaactaccccgaaaccccccacacacccacccagcagctgcactccgctagcgccaccactccggggggccccgcctccttgccgccatccccccgccaccgcaggatctcgccgccggcgtacgccccccgcgcgcgctgctgggccacagtactgtccgatttggtttttctctttaagcttttagcaacgggacacaggggagaaagt

SEQ ID NO: 24421 - DNA, 5529 bp, Zea mays
  misc_feature (1362)..(1362): n is a, c, g, or t
  misc_feature (2139)..(2139): n is a, c, g, or t
  misc_feature (5502)..(5502): n is a, c, g, or t
aatgaaattaaatttagatgaaatggactgttgatactcgtatcaaaagagctttgtctctacgacactcagataaaactctcactgagattattcttgaaaggtcctgttgaaatgggaacaaaagcgcccaatttcattgcagtcagcacccacccatccccatgacatcaagggctagttggtgttgtagttttccgcgctagaacttcggtaaactatggctgcgacaagaagctggtcgagcaaaaatttgaatccaaacttgtcataaaatttgacaagaaaatgagtctagagtgttggatgaaaggatgctaagtgtatgtttggtttggcttttagctttggcttttgccccataaaagccaaaagccaaaccaaaaggctggatacaggaagcagtttttttgtaaaagccgactttttcgcagtgcaaaactgaaagcactcttatacctgcttttagtggctttatagaactgtgaaaacatatatcgaataacttttaacggcttttagtggtttcaccaaacgtgttttagctttttaacagctcacagtccacaacagctttttcgtagctcacaccttacaacaactttttttacagccacaactcaaccaaacagaacctaagaaagcacggcatgccgtatctgtagcggctaaccaaacgctgggaaaaaactatagcacaactaacgtgtgacatgtcacgttttaatcataaactaaacaggtcttaacgacggttaaagaggatatgtgattgtgactgagatttttatttttaaccttttacaaaaaatagttctagaaataatactgctagattttttttaaaaaacttaatcatttgaccacgttaaatttataactatttataagcacggataaactactcgtccatgtaaactgggctcccgcccggccgccccgcttggcccatgtatagtttcaatggccttgtactaattttgtctgctgcatactctacaagcgagccaagcccactttaggaacggaagcaggaccggaagccaggaaccgaggggaacgggggcagggaggacgaagcgaccagatgactccagacttgcgtcacggcgggatcgcttcgcatcgcatcttccgatctctctggctcttggcctccggccgtcctgcctgccgccgctctgcgtcacgacatgctcgctgctccaacttcatgctccggtgactcacgtttcaggcagcagcaccaccccaggcactcagcggccagcacggttgtcagttgtcaccctcctaccgcatggccgcagcgccaacgtcctcgaccagacctcggccccaggaacaaccacattgacgaantcgcgcggctcgccaatcttgctcgccttgtctcgaaatcgaacgtctgggagctgcctggcccagacaagtttggtggcgagagcaaaccaaatttggtctgggagctgagaagatgattgattttgaataatttgcctgacactagagctaaactagtgttgagtgtcccttgattgagttcctgaaacataagttatgtctccattaacccaggtaccactcgtcgacactctcggaaaaggcaaagaaaactttagaccttgttcgtttgtgtcggattgcatccggaatcgtttcagctaatcaaagcttatataaattagacaagcaaaccggttagaaattgttccgacccaccaattcaacacaaacgaacaaggccttacccgtccgagcagccgaatccttgcgaggcaggccatcaggccattcacgaagtgtaacataaatgatgatgatgataataataataataataataataataataataataataataataataaaaataataatttatacttcgagtaccaactgtaacaagtttaaatagcaaaatattaatttttagtgtgatatctgattatagttagattaaaacaaacatgatttaacgttatcatttatccattacattacattataaatatatgaaccaaacgacactctcatctatcaaagtggatgccggattcgtttaaacttcacgagagcggggctagcgttcttcgctaaagaatcacccggtgtcccggtggatgtgattttatntcgccgtcccgtgaccgtttatgcaggtcagaagaagaggctgaatgcttaccggtcttgacatgtcgtcaacggcctatttcttttttatataggtataaagacgccacgcacactcacatcactacagaccatatacatatgtgtctaatgtacacactaaattgattgagaggtctagacttctactacgtgggcacacgtaataccactggacgcacacacgtgtgtgtcgtatacctaaaaaatggtgcgtcactcaaggctcaaaccctggacgagagcgctttcggccaatagccttcgtcaacttcctatttcgacttcactggatcatgttcccggatcacaggtgagcgaatggtcaggtgtgggttcaatctcgacaacacgtgcctcactttgaggatttcccccgataaggtatacacacacatgcacgttcattagtattacgtgtgtcccacgcactagaggtctatgtctcaatctctttctaatgtgtgcattggacacagagagtgtatgtacgtgtggtgtgttcgtggcgcccttgtactctaataaaaaaacaatggctgctggttgcatctttgattgaggccaataatatttttagtttggcacaggttcatagagtttcaaagtgccatcacagcgaaattaaggaactggttgtctcaaaaaaagatactaataatcaaactcaacactcgttcagtttggtgtcggaattcggcaaactggtggtgagaattaaaaaaatcggccagagagaataaccaaccttctgacttatgatataatattaaaaagagaccaaaacattccccccactttttctactaattaactcccaagggcggatgcatataaaattaactcccaagtgacttcccaggaaactctgtttttgcctataagtctataacacgttaacccctcactactcggggcaccaagcaatatttcagcctttttattgcgagggcactctaagctacaacattctctatatctagaattgggttctgtggtgggaacgaatagcaggtaacagaataccaccatttgggctccttagggctcggtcgtttcaccattaatccatgtagattgggtggtattgagtcgatttaaatccatagcaaataaaaatctatcctaatccattccaatacactccaatccacatggaattggaataaacgaacaatgccttaggtggaaggagcctcagtttcttttttttctttccttttgttgaggcttagtacatctgttctaccatgagggccgagaacagatcagattttatcatgaaggttaacaaccaggtcatgtgcatcatctagcagcctccagacgtctagctgcccggccatgctattgcactctcgcagtatctcgtccatgctgctatacttctcaattatcagcttcctcctctgcaggacgcaggcggcgatggcgtagagcaacaggtcgtcagttggcggagcacgcagccttatccttccccaggtggacctcccgatcccggctcgtatggctgcctggtcagcccacataacctcccacaggcacacggtttgctcaaaggtgagctctcgcctgaacagaaccaccaccattctgtacacgaagaaacagtcctcggcctgcaacttctgcagatgcctatacaggtgcgaatctttgcgcttgataatctgagagacaatcttcagttgccttcgtattccaacctcgtcgagcctgaagttgtgccttgctttcctcatgaaacccacgaaacaccagaacgcttcatcgtcatcctccatcaccgcaatgataggtgacaacagatcgctcatgccttggcagtagccaatctctggatcgtagaccgcatatgcttcgagcaacccaactaatcgagctgcatgataaatcatactgggctccaagtgctcatagtctttcaacccaacagatgctgcagactgcaatgctctctccttgggaacttcagactggttgcgggagaacaaaatccattcactgtttgaccggatagcatccaaccttatgatgcgctgccatgtggcgaagtcctctgatgttctgctagacctaaaaaaatctgccttgaatgaattgctcatggtaaatttagtatctgggtcacagttctcgtcgccagacacagaaatccctccagggtcatcctcatcagatgattcagaatcagacgattctgactctgctttgcatggatatgcataagctaactcatctgcatcttcttccatgcattcaacaacatcacagagaatgttgtctggttggtcagcttcattctgttcaggcttcacctcctcgagtgaaacgggggcgcgtggggcgggggcggcctcgtgacctcgcgattctgatccttcagcaataccatctaaactagaacactcatcactattaagttcagttattgccttcaacccatttcccttgtagccattcagaatttgttggcactgcctcctcagcttttcatactgtttcctgtaccaaagtcataccaattaaaaattgctaccagatcacataagaaaagggcagacacagtgccagaggctccgacatggggtctggggaagggacaaaccaacgcaacccgtgacctggtgaatcaatgagacaacactcaccactgcaccaggcctgcccttcttaacagatcatataaaaaaaacagtacgtgaatggcaataggatgtcctagtttgatttcctttcaaacttacaatattaacctcttatgaatttactaaagagagaaagaaatcaattaatgctgttcaagtgctacatgatatttcttagtctcacactcttgcttcatggaaatatgggcatggtacattgagccaaatgaacacttgcagcataaatcaggtacccaaacagatctataaacatgtgccagttatcaccaaacaaaagactaaacggtgaatatattaccttttcttgatcttgatagagttcctttcctcttcagagctattcaaatcatagctgcagatacaacatgaaagatcaatccacatgaacaaaagttcacaaagcataacataataaccacataacaaaactttactttctcgtaaatggccaaatatgaacaggcttgacaccatacagtgctgataatactaaatgtattatgtgcttaagttagatcattcagcagcaggcataaactaaggctattttgcaaaatcacattcccacaagatagattactcatattcccctcacataaaaaaatgattcatattccaggtaaggcagccagagtacactaattgcttgttntgaatttcaatatcatctaattagggg

SEQ ID NO: 24422 - DNA, 1139 bp, Zea mays
  misc_feature (720)..(720): n is a, c, g, or t
  misc_feature (748)..(749): n is a, c, g, or t
  misc_feature (759)..(759): n is a, c, g, or t
  misc_feature (761)..(762): n is a, c, g, or t
  misc_feature (770)..(770): n is a, c, g, or t
  misc_feature (789)..(789): n is a, c, g, or t
  misc_feature (882)..(883): n is a, c, g, or t
  misc_feature (916)..(916): n is a, c, g, or t
  misc_feature (965)..(965): n is a, c, g, or t
ggtttgcccaacctcctgacttctgatataatattaagaagagaccaaaacattgaccatactatttctactaattaactccaagtgcggatgcatataaaattaactcccaagtgacttcccaggaaactctgtttttttgcctatagtctaacaagttaacctgtgcctcactacacgggaacaccaagcaatatttcagcctttttattgcgagggcactctaagctacaacattctctatatctagaattgggttctgtggtgggaacgaatagcaggtaacagaataccaccatttgggctccttagggctcggtcgtttcaccattaatccatgtagattgggtggtattgagtcgatttaaatccatagcaaataaaaatctatcctaatccattccaatacactccaatccacatggaattggaataaacgaacaatgccttaggtggaaggagcctcagtttcttttttttctttccttttgttgaggcttagtacatctgttctaccatgagggccgagaacagatcagattttatcatgaaggttaacaaccaggtcatgtgcatcatctagcagcctccagacgtctagctgcccggccatgctattgcactctcgcagtatctcgtccatgctgctatacttctcaattatcagcttcctcctctgcaggacgcaggcggcgatggcgtagagcaacaggtcgtcangtggcggagcacgcagccttatccttcnnccagtggacntnnccgatccngctcgtatgggctgctggntcagccacataaccccccacaggcacacggtttggctcaaggtgagctctcgcctggaacagacccacaccattctgtacacgaggaacagtnnctcggctgcaacttctgcagatggctatacagntgcgattctttgcgcttgatatctgaaaaaacatcttcaattgcctcgnattccacctcgccaagcctgaattggggcctggctttcctcctgaaaccacgaaacccaaagcgtttcatggaatcctcatccccgaatgtgaagtggaaaacgattcgctagtgcctggaagaacaaattcttggatcgtacccgctttggttcaagaacccattttatcggg

SEQ ID NO: 24423 - DNA, 2723 bp, Zea mays
ctatggaccaaagtttagttactaaaatttagtagggtgactaaagcaaccaaacaccctattgtcacttttagctttaaaaagagctaaactttagccaatttactttagctcttagatacaaacaggtctatggaccgacacattattacttttgacagccgacaacaagatatgttgtcttgctatcttgaaggaccatgactattttcaaccgcttactctaatctcttatttcaaattccactctataaacaaactctactcgatagacggtagtattttgcatggccataattacgatctactgttcatcgtgccatagtcaggttggccaacattcccagcgtgagaaacgagaacccgacaatagaacctacaataccctatggcaatgggctacggtcctacggatggcgccaccatactgccatgccgagccgtgccaggcaaggtcacatcagaatttcccttcatcgtaccatcagatttgatgtgttgctcgccttgtcaacatcgcgcaagttggtacccaaaaaagcagatcaaacagaagcccttttggtgttactggtaggctaggaaaatgcatctaggctctctgatcttcagctagggagtagggacagaatgtatctaggcacgtactgtctctgtttcaagatatttgacactttacctataaaatttagacagacatttatttaaattcatatctaaaatatcaattatttttgagagattcaaacagacgtaaagttggggcagtgtgggaagtgagagttttcctcgggttctgtttgtgaaggtgtttcagcttgcgtgttgacagctttatattttgatcgtaaacacacgtcttaattaatacaagccatctcatttaaaaaactactgtcttagtttcaaattataaatccgaaattatgtgtgagttgttctagcttttctagttacattttgtttttgtttttgtttttatgcacctagatataaactatattttagatacataaaggcaggcttacaatttagaatgtaagtatagcagaaacgacttacaatttgaaatggatgaagtaaaaatcaaattcagcccttgtccagtttggtgccggaattttagcaatgtttccctagtaatggcacatttaaattggcggcaggatctggtggtgacaatttaacaccagtcaaacgcacgagaaacaaatcttgcgttgagaaaccatactgccttgcacatttcaaactagttaacttgagcgcgtatgcataaaattgatggagtgccatcccaggaaactctgtttttgcctataacaagttaaacaacgaacagtttacagtgcctcactaacaccaaacaatctttcagcattttctttgcgaggacactcgagtcctcactctaagttaacaacattctctatacctagaagttggttccgtgctgggaatgaatagcagataatagaatactttcagtaggtggtaaaggaaccacaatatttttccttctgttgaggcttacacctgctccgccgttagagcaaagagcagcactcaccaccagatcagattttatcgtgaaggttaacaaccaggtcatgtgcatcatctagcagcctccagacgtcgagctgcccagccatgctgttgcactctcgcagtatctcgtccatgctgctatacttctcaattattagcttcctcctctgcaggacacaagcggcgatggcatagagtagcaagtcgtcagttgggggagcacgcagtcttatccttccccaggtggacctcccgatcccggctcgtatagctgcctggtcagcccacataacctcccacaagcacacagtctgctcaaaagtgagctctctcctgaagagaactaccaccattctgtacacaaagaaacagtcctcagcctgcaacttctgcagatgcctatacaggtgtgaatctttgcgcttgataatctgagagacgatcttcaactgccttcttattccgacctcatcgagcctgaagttgtgccttgctttcctcatgaaacccacgaaacaccaaaatgcctcgtcgtcctcctccattaccgcaatgataggtgacaacagatcactcataccttggcagtagccaatctctggatcatacaccgcatatgcttcaagcagcccaactaatcgagccgcgtgataaatcatactgggctctaagtgatcgtaatctttcaacccaacagatgctgcagactgcaatgctctctccttgggaacttcagcctggttgccggagaacataatccattcactgtttgatcggatggcatccaaccttataatgcgttgccatgaggcgaagtcctctggggttctgctagacctaaaaagatctgccttgaatgaagtgctcctgataaatttaggatctggatcacagttctcctcgccagacacggacatccttccagggtcatcctcatcggatgattcagaatcagatgattctgactctgctatgcatggatatgcataagctaactcatctgcatcttcttcaatacattcaacccccccgctcggggtgttctctggttggtcaacttcattctgttcaggcttcagctcctcgagtgaaacaggagcacgtatagcattggcatcttcaaaacaaggtgattctgatccatcagcagtacctcggccgcgaccacgcta

SEQ ID NO: 24424 - DNA, 1633 bp, Zea mays
tttttttttttttttttttttagattaaaataactagccttaataatcaatacttgcactagctctgcatcagggcagcaaaccctgcgcaattttagtggcaaaagaattgtacactaaatcacgtgatttgtatgaaaaagagatctggccccttccgaatttccaatccattacattaatcgtgattacaatcacaaatcgaccctccaatgaatccaatgcctccaaacaaatgactaaaagctgcccgtggatccaattctttcccaacaggaagcctttattagacacctgccgaaccaattctgacaaccttctcttcccactgcctccgacccatccagccctccaaattccaactgccttcacgttggtacttggtagccattcccctctcggccatcagactcccaagttgagcgtgtgcttgaggtccccgacgtgcagcgtgtggctgccgagcgccaccttcctgttgcccagctcgtccacgacgctgaggtccttgcacacgtccaccttgaacgccaccacgcccgcctgcccgggctccagcgacaccttctcgaagcccagcaggtgcttcgccggcgcgttgtgcaccgccggcggcgacgagaacaggaacaccgtgtgcccgccggacctctcgcccgcgttccgcacccggaggtgcacgtcgaacgccaggccctcgcagtgcgcgccctcggcctccacggacgggcactgctcggtcaggcacgcgtggccctccgcgagctgcagggccaactgcttgggcgccgacaccaggtggtgcgcgaagctggtgtagctcaggccgtcgccgaacgcgtacaccgtgtcgccggtgtagaaccggtacgtccggccggggtagccggtcgacgggtccggccgcatgcgcatgtcggtcatcgggaccttggtgaacgactcggggtaccacgtcaccggcaaccttccacttgggttgtggtatccgaagaggacgtcggcgatggcggcgccgccggcttcgccggggtagccgacccaaagaatggcggcgatcttgtcgctggacttggcgaaggagatgtcgaagggcccgcccgacatgacgacgaggatgcacgggccgctggacgcgttggcgaccgcggacacgagctgcggctgctggccgggcagcaggaggctggtccggtccaggctctcgcgctcgatggactggtcggcgccgacgaccagcacggtcacgtcagcgctggccgcggccttggtggccgcgtcgagctgcaggctgttgccgctgcaccccacgttggtgcaccccggctggtacacggtggccacgttcgcgcccaggccctgcagcggcgtcgtgtacttgcatggcgtgccttcgtagttgccgatcatggtgaagctggcattggcattggggccaatgacggccatggacttgatggagctggcggagagcgggagcttgccggtggtcttggccgacgcacgatgccctggcgagcggcctcgcgaagccagcttcctggttgaagggcgtgcacacgtcgctgggtccgaggttgccgaacggcagctcccgcgggtcgccgtagttagaaccccaggcagcatgagc

SEQ ID NO: 24425 - DNA, 2238 bp, Zea mays
ctttggtgttacattcctacaggtcaggctagatgtgctgcagcatgagtacagcaaggttgcatccgtcgcatgcgttcgctatgtctgttgtgcggagctttgtcagggagcacaagtattggaggttctggaattgccccctttgtgatcgcaagaagttcgtggacactggtttgctattgtcacacatgtgcaccaggcaaacaaagacagtcctgccgtggattgagatacaagaagcttgattactggttgtttcatttcgtttggctactactcaagtttctagcagaccaaggtgcaaaactttttcgtgtcatggtttgggattctggtggaattgatgtcatgtatcgtcttgagggaaagccgaattttaagaaggggggaatgtcagtagtacagcatctgaaccaggaaccatggtcaccatctcgtcaagggagctataccacggcgagtaagcagccgctgaagtgcaataccattgtgcaagggtccgacgcgtgtgtgtgcctctgttatgtggggtcggctatgccttgctgctgcgaagggcttatgtattgtggagtgttgcttgtgaagggcatcaaacaaacaggtaatacaatttcagtcgattcctctgtgtgctatcttcttccttccccatcctctctgcttctcccatccttactccttcctctccaaagttccacttccagatagtgtagcctgctaacaccaagcttttcgtaggacatcaaatcaatgttgtagagatgacaattaaagagtgtcggatgcttggctttgattccttaggaaaggtctaggcaatggctttgattctttgggaaaggtctaggcaatcccagcaggcagcagtgcgcatagacatgtatagtcccgacagctagcagtgcgctccaagtatattggaccaggcttaggccctaattttttcacgagatgttacatcctaaaagcattacatcttggattcttggctagccttttctcacgccagcattcaacattttactaaaagtggacatgaaattagcatggtcagcttctattgtctgtcgtctgcatgaaaatgccatatattcagcagaaagtctaatggacagaaaatcaaccgttacaaaatacagactttcccacatttgcacgggaatgtatgaaatcatgacatccatctaaatcacaccagctgcaggcgataatatttgtaacggttgcaattctctggtgggataagtactgtcttcatggaagaactgtcttcgaccaccatccactccatcaatatgcaattctctggtgggataagtataatagactgaaagtatagacagccatatacttctcatatgtgcaaagattgggactgataaatgattttacgatccaaaagatggacaaatgcacgaacatataaacagaacatatacaattcgaatatgggattgctctttaagtactagaaggactcccatactaatatagaagccactacatctaggtcttgctagacaatcgacatctggccttatctgcggcaatctgaaacctaaatgacgccaacagatccataccctctcccaagcagaggcggtcgcccggcgccacgaccgatccctgcctcctccgctgccgcggccgcctctgcctccgcggccttgcgcgcctccgcgacgcgctcctcgatctcgtcttcggtgtagccgtgctcctcgagcgcgttcctgagcacgagcagcttgagctcgacttggcgcttgcggtcgtgctcgaggatctccttgttgggcttgcgcatcccgccgccatccgcgccggcggcgtcggagcgcagcggcctatggggcccgcccggacccccgccggatgtggagcggggcttgacgaagaacttgttgctctgcgcgtacccgttggtgcccgacccccgcgcggtctgcagcccgatgccgttgtacatcgcggccggcgggcggggagaggccggatggatcggcggcggcggcgcaaactagggcaagggaagcctggctaggacgaaattgcaggtgagatgagaagcaagggaggagccggttggattatattctccgagagtccgagtccgtcccccccggccacgtgagagtattttctacggtaaaagcgccacgtcaccctttttaataggagcggttagatttctattggtcggccggcgtttattatcccgcaggtataaac

SEQ ID NO: 24426 - DNA, 1544 bp, Zea mays
agcttttcgtaggacatcaattcatcaaatcaatgttgtagagatgaccacggatgcttggctttgattccttagaaaagctctaaatcatggcatgcagactttctcacatttgcacaagaatgcatgaaatcatggcatgcagtaaactatccacatccaaagctagaactgaaagtaaagcttgagactgataaatgattttacgatctcaaaagatacacaaatgccgagcatataaacagaacctacaattcgaatatgggattcctctttaagacatctatgtattatcgtccgtgtgatttcactggagaagtctcccatactaatatacgtactagaagccactacatccaggtctggatagataatcgacatctggccttatctgcggcaatctgaaacctaaatgacgccaacagatccataccctctgccagacagaggcggtcgcccggcgccacgaccgctccctgcctcctccgcagccacggccgcggccgcctctgcctccgaggccttgcgcgcctccgcgacgcgctcctcgatctcgtcttcggtgtagccgtgctcctcgagcgcgtccctgagcacgagcagcttgagctcgacttggcgcttgcggtcgtgctcgaggatctccttgttgggcttgcgcgtcccgccgccatccgcgccggcggcgtcggagcgcagcggcctgtggggcccgcccggacccccgccggatgtggagcggggcttgacgaagaacttgttgctctgcgcgtacccgttggtgcccgacccccgcgcggtctggagcccgatgccgttgtacatcgcggccgtcgggcggggagaagccggttggatcggcggcggcgcaatcctagggcaagggaagcctggctaggacgagatgactggtgagatgagaatttagaagcaagggaggagccggttgggttatattctggtctgggcccgtgactccgagtccgtacctccggccacgtgagagtattttatttttctacggtaaaagcgccacgtcaccctttttaatagcagctgttagatttctattggtcggccggcgtttatttatcccgcagccataaacgctcaagtggaggcccacgtacgtcattcttctattggtcagctggcctttttttattactttctcaatatatttacgtcttttcacctactaaatatattgttaacatattttccaatgtccctttttttgcttatttctacaagcatacatatgttgtgagaattttcatgtatataattaccggctatttttctgatacacggttgctaccactacatgtaacgccacgatccaaatttttttacacaatttaattgagccttaactaattttaattaaaaataaatagaaataaagcttgttcgatctgatccttaaattttatagtgcaaaacatagaacccattaccaccctaagctgcatgcggttattacaacaggttgtacttacaaatcgttttgtttttatcagccagatttgagtcagaggcga

SEQ ID NO: 24427 - DNA, 2129 bp, Zea mays
ctcttgttgatttacttgttgaaccaatcaaccaaatccattacagcttcataaaccaccattttttttttttttttgcagaaaattaacctacattttcttcaaccctctgttttccacctatataaacagttagttacacccagcattgctcaagaccacggggattaatggcaacgccgactggccatatgaagatggcattagcctttgatgacccccgcgtttctgtacttgtacctgacggccaagaacaggaagaagaggtagttgatggtgctgagcacgcacatgacccagtagaacctctcgaggtggtagtggttcaggctggcaccctgcagccacggccggtggtcgccgcgccctgtcgcgctgttgacgatggacaccagcaccgagctgaggtaatatcccagcgccagcgacgcccacgacagcgacgtcgccagggatctcatccgcgccggcgcctcgctgaagaagaactcgagcagccccgccaacgtgaacaggtccgcggaacccaggaacaggtactggaacgcgatccagaagaaggtgatgggcagcggcttggtggagtccagcatcccgttgtgggacgccacgttcttgcgcttgacctcgacgacggcggccacggccatcgcgacgatggacagcaccagcccggtgccgatacgctggaggtgtgtgatgcccatctcggtccccgtgacgcggcgcgcgaacgggacgatgacgtgatcgtagacgggcgcgaggatgatgatgaacgtgacagggaagacggggagcgacgccggcggcacggtgaggctgcccacgcgcgtgtccatggtggccgcttgctcgaccgagaaggtggacagctgcgccaggcagcagttgagcatgatggtggacaagaagatgggcagcaccatgagcacgatcttgacgtcctccacctcctggaccgtgcacgccaggcggccgtgccgcggcggctggcactgcaccgcgcggttgaggaacgcgagttcgcgggacggctcggcgggcgacgacgccacgatcgcggcgccggagaccgtgatctcctccatgtccccgggcttgcagtactctttcatgtcggtgctccccgtggggctgggcgcgcggtcgatgacggcgccgttgctggagctcggcgcgcagccgcggcgcgcgagcgcggcggcgatgaggaccttggcgatggtggtgagcgggctccccgtgggcaccttgttccggtagcggctggagccggcgacgaagagcgggatggagagcaggatggcgatggtggagatgccgaacccccactgccagcccttgttgtcctcgacccagacggcgaaggtgacggcgacgagggcgccgcaggagaggcagaagacgaagtagttgaagaaggtggagcggcccttgcgcccccgcgccgcatgctcgtcgaactgctccgcgccgtgggaggggagggagcccttgatcccgcccacgcccagcgccgtgaggtacagccccgcgaacagcatcgccttcttggcgcccgacacgggctcgcacggagccgctggcttggcgcactgcggtggcatcagcgactgcgtccgcgcctggaccgtcaggatcaccagccccatgagctcgatgaaggcgctggcgatgtagatggtgtaggtggtgaagaaggcgtcggagaggaagccgccgaggagcgcgagcaggaaggccgtgcccatgaagttggtgaccgccgtggccgactgcgacggcgagtagtgcatgaaccccatcaggtaggtcaccaggttgctggcgttcgccaggaacgccaggttctccagcacctccaccacgagcacgaaggaggcggcggccatgccgccgtgccgggacctggtcgccggccggttcctccagtccacgtacccctcccacggctccgcacccggcgcgacgtcctccatgatggtgcccggccgcaagctgctgctcgccctctccgtacgtgctctgaaacgcgcacgggcagaggaagacgagggaggcagagcaggagatcccgtttgagttcactacttgtgcgactgcgtgcccgacgcgagagagagtct

SEQ ID NO: 24428 - DNA, 1587 bp, Zea mays
gcttgcatgcctgcagacagatgcaggctgctgctgctgctgccatggctccctggacggacggacggtgagtgaatctggggagagaagaggagattgtttgcctcgcggcgcctgggattattgggaaagaggaggtgtggaaccattggatgggatagcggccacgtggcacgcccactggtgactgttgtgtgggaggaatagaatgcaaacatggagtcatgaagatgcagacacagctttgtcagcaagcaaagatcttttgatcagccggccacccgtaggggccgcacatttttttttttttttttggtttaaggccaggggatgccatgccatccatataatatacacagtttcatttacacgagcatcctacatcctcctaataattagtaataaataaattaatccctttgagcaccaccaccacgattaattagaaagagaaagaaggacaggcaaggtgttgtttgtttgaagattgcttaattagctgcacagatttggagtacatgcgccgtctggtgtctgctgctctttccagatccgtccggtgatcctgagcttgagctccttccggtccccgccggagaagaagagcgccatgttcctctggatgatgaggccgtcgtggctgtccctcaccttgcggtggctgtcgcggacgctccttggggtgccctcccacaccatcttcctcccgttggcgccgacctcgaggctgtagctgtagttcttggcctcgttctcgtcccccatgaagcggaggaaggccatgtacacgggcgccatcccgagctggaacgcctcgaagtgcaggcagaagtagtggccgaagcagtggaacaccgtcagcatccaggtggcgttctccacctcccgcgggttggatttcacgtatctgtggttgaaggtgcagccgctgtgcatgtccaccttgtggtcgtccctcaggtgggagacgagggaagggatgtcgccggccgcgccgcactcggagccggcgtaggggcagttgtacggtctcaggccgcactgcgcctcgtgctttatcttgctgtagtaaggcatgatctcggggcaccccagcgagtagtacctgcaggggagctccagcgactcggcgactttctccagcgccaggcacctgatgtcgcccagctcttgcctgcaggtagggcaacggttgtgtactctggccttgcatgtggaacacagcgtgtgtccattggggcactggtggatcggcgggaacatggagttggtgcacacggggcactccagcagctcgtggacgccgccgttggtcacggccttgggccacggccgggcggcgccgccatccacgtcgcccgccggggcgtcgggcagcgagacgcagtccacgtccatggccgcccgccggcccgcccgcctccgctccctgggctccgggacacggaggggatgagcggacgcgtgggtcgtcccgtggttttttttttttttttttttttttttttttttttttttttttttttttttttttggtaattttttttttccggccggcctcgaagaacccaatcgccctaaggagtg

SEQ ID NO: 24429 - DNA, 1469 bp, Zea mays
tgcatgcctgcagacagatgcaggctgctgctgctgctgccatggctccctggacggacggacggtgagtgaatctggggatagaagaggagattgtttgcctcgcgacgcctgggattattgggaaagaggaggtgtggaaccattggatgggatagcggccacgtggcacgcccactggtgactgttgggtgggaggaatagaatgcaaacatgtcctctagaggcggacacggccctttttttttttttttgtcagcaagcaaagatcttttgatcagccggccacccgtaggtacagtacagtactgtgctgtgacatgatttaaggccagggatgccatgccatccatataatatacacagtttcatttacacgagcatcctacgtcctcctaataattagtaataaataatccctttgagcaccaccaccacgattaattagaaagagaaagaaggacaggcaaggtgtgtgtttgaagattgcttaattagctgcacagatttggagtacatgcgccgtctggtgtctgctgctctttccagatccgtccggtgatcctgagcttgagctccttccggtccccgccggagaagaagagcgccatgttcctctggatgatgaggccgtcgtggctgtccctcaccttgcggtggctgtcgcggacgctccttggggtgccctcccacaccatcttcctcccgttggcgccgacctcgaggctgtagctgtagttcttgccctcgttctcgtcccccatgaagcggacgaaggccatgtacacgggcgccatcccgagctggaacgcctcgaagtgcaggcagaagtagtggccgaagcagtggaacaccgtcagcatccaggtggcgttctccacctcccgcgggttggatttcacgtatctgtggttgaaggtgcagccgctgtgcatgtccaccttgtggtcgtccctcaggtgggagacagagggaagggatgtcgccggccgcgccgcactcggagccggcgtaggggcagttgtacggtctcaggccgcactgcgcctcgtgctttatcttgctgtagtaaggcatgatctccgggcaccccagcgagtagtacctgcaggggagctccagcgactcggcgactttctccagcgccaggcacctgatgtcgcccagctcttgcctgcaggtagggcaacggttgtgtactctggccttgcatgtggaacacagcgtgtgtccattggggcactggtggatcggcgggaacatggagttggtgcacacggggcactccagcagctcgtggacgccgccgttggtcacggccttgggccacggccgggcggcgccgccatccacgtcgcccgccggggcgtcgggccccgacccgcagtccacgtccatggccgcaaaccgagaaccgcccgcctccgctccctgggctccgggacacggaggggatcggactgggtgtt

SEQ ID NO: 24430 - DNA, 2003 bp, Zea mays
ttcctgtagtgtatgtgagtaggtgcaaccattgatccccgtccatataagtttaggtaggaactttttggtcttccacaaagtccacctaattgtttgaccttttgttaatgatgtcttccatccgcttctcaaccatttcatgatgatccattttatacagaacatatgtctgacaaaataggtgataaagagggggaaagctacttatagagaaccactttcaaaagaataacaaagcaaactatcagctaagttacaaaaacaggaacgaacacagaccactacataatagaagaaaaaaaaagaaaacccttgttacaaggcatgaacctagatccatatcaaaggtcttatttcttatcttccaaatttcaaatgaaagcactttaagaacatggtcttgttgtctaaatgttgaggctcccaaagatgaaatcttggctaaggttaaagatgttaatgatttctcaagttgaaatagaacttagtgagattgatcatagtgcttccatatacatgcaaccaaccatataggttttgagtcgccaatatttatgctcaatgatgacggcggtgttatgtgctagacatagagttcctttttaacataagatatatgtttatgggcgtgatgcttcgtacatgacagtcaccagaacataataatgtgaatatactgcatacatgaataaaataatgaaccttgagtacatgaacaagataatgaaccttgagctcattagaagataattcatacatgaacaaaataataaatattgagttattcataacatacttaatacatgaacaagataatgaaccttgagcatacatgaacaagatacatgacagtcatcagaatatacatgacagtcaccagaacatacatgacattcgtcataaataagaacgagataatgaacgttattaagaataggttgtcgatgcatggcgaacgatcgagcgatcttgtttagcactgcctagtgcagatgcagcggcggcggaaggtgctgcacctgccggccaagaagccctcaccgcggcacacattggcgcagttgtctgcgatcatgcatgccccaacaaatcgctcactgtacttctcgcattcccttgcctgtgccatatcggtggacacaatgagcaggagaagcaggatgacggccggctggaacctgcgtgacgactccattacctttatcttggcaggaatatatatatgcacgcttcagggattcacgaactatttattcccaattatttcaaatcactgttctttgagtcagcccggccgggagcgagcccaatcgcccataggcacgcttcagggattcacgaactatttattcccaattatttcaaatcactgttctttgagtgagagagaccatggaaccctgtttatttatacacaaggataccatcatgcaacggagctgctccacccgttattgtatggtatatgtgtatctacaaccgcaccagctatttatattagtggcggagctttagcttagatttagagtcaaagctaattaagaaaaacttgacatgcagggataagaccgtccgcataacattatattaagaaaacaatcttcccacacacgtggagaaaatccctgaacacctatcccgaccatacatagtctgaaattcatcccatgtgttactgatggtttctactcagcactttcaccaaaacctcattatctcacgtgggttagcttgagaaaatacaccaaacttgagggacaagatcctaatttagtaataatcatcttagaagacctatgttaaccataccatgcaattaaaagggggaatgtaaccaaactctaaggcataccacccttgagcatatgtaacacctaacaggaattgggcaagaaaactatcactacaagaaacaaggcaaagagtgtcggctaaaaacccacatcttactgaaataagccgacactcttagccgacactctaaaatggatgctcttatc

SEQ ID NO: 24431 - DNA, 1335 bp, Zea mays
ccacgcgtccgttcttttagctttggcagccaatcgcctcttgtcctgtcgtcgtctcttcctttcgcgtgagcagttcaggcgttcttgccctttcctcgctcaggtcaggtggggataggatcgtgacgtcgtcatcgccaccaccacccccagcatcccgagctgctgctggcggtggggcaaccgcgtgcgttgctagcttgctcgatctgcctctcctctggatcccctgtcctgtccctgttaatcgcgcgcgcttgcctatttacaaggcgaaacaagcgcgcagcagtggccatgtcgtccgacgcggtggccgccagcagcaggaagggccggctgaagcagcgctacgacaacgagttccgcctcgtcgcagggtgcgtgccgtaccgggtgaacaagaaagacgacgagggcggcaacccgtgcagcagcctcggcgacgacacggcggcggaggtggaggtgctcatgatctccacgcctaaccgggccgacatggtcttccccaagggcgggtgggaggacgacgaggacgtctaccaggcggcgtgccgcgagaccacggaggaggccggcgtcaagggcatcatcaacagagctgcgctggggcactgggtgttcaagagcaagagcagccagaacagcaccaccagcaccagtggagcctgcaagggctacatcttcggcatggaggtcacggaggagctcgagtcatggccggagcaggacacgcacgaccggcgatgggtctctccggccgaagcctaccagctctgccggtacgactggatgcgggaggcgctcaccgcgctgctggagaggctgtcggtgctgcagccggtggcagcggcggcggcggcggccacaccggaactggcggccgaccaatctggcatgtacatgatgctccaggcgtcctcggacggaggagcggtggcgctgtgctagctcattgatggtggacgacgctgctgttgctaactgtccaaactgcacgctccacgttcagttcaaagcaagtgcaacaaattcagaccctctatctaattgctcgtttagtcccttcggttttcagctagtcatgagtcttcactcttcagtgtgcctgcaattaatgcaacattggtgttggttggctagtttcagaggtcaggacaaagcgactgtcccctcggcccttgcatgatgatctatatatacgattactgagtgttcctgtgtcatctactgtggggttcatgtaatatgtgaaaaatgttatggcgtttgtgaatgctaataataatactcttacatcgaaaaaaaaaaaaaaaaaaaaaaaaggga

SEQ ID NO: 24432 - DNA, 961 bp, Zea mays
attgggtacctcgaggccggccggggagtgaacgaaacgggagacgataacgagacagcaagagccaagaggtgagagaaggagtgaaggaccgaggagggaaacagagaagatggcgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtttggttttgtgcttgttgcgaaggctacgtggcaaggatgacattgtcaatgctggtatagctggttgttgtactggcctcgctttgggctttccaggggcgccacaggcattgctccaaagctgtgccaccttcgcagcattctcatgcatcatggaggggctcaataagcagcaggctgcaatggctcgcacgcttggagggactgccgcgatggccgtgcatgagaaatgtggtgttctgcccccgttcacgcttccacctattcttgatgcatctgatgctttagcttcatgctgcttagcgttagtaaagcctaagcactagactacacaatagagggcgtgagcgatggcgaagaagggtaacttcaatcttcggctctttattgtgttgaccccaggttatatgaattatgtttttggacaagatgtgtaacgtgcctaaattccagggttttttttggcttcatcggaccaggtttccccttgatgggttaacgttgcagcatgcccttgcggattccgctgggtctagcatatttgtatgggataaaagatcataaatatttgcctgaatgttcggtttcctttt

SEQ ID NO: 24433 - DNA, 1589 bp, Zea mays
tgcttgggtagaaatccaccgattggaggatgaatcttaaatgttccattttggatgtgcatatgtgcaattaaaacttctgttcttgaaatgaatcagaagctatctatttcatgggttagacactgaggatgaaatgagaaagggtccatgaacttttctcatgagttcgtcgtaattatttttacagtcagggaaactaaatctttcatgcattattttgcgtggactagtgattagcacaagttatatcaggcaattcatttctgctaatgagttatgaatcgggctagtgggtttataaataggtccccttgaacattgactcaatttcacaaattgacatcagcacctttttagagaaggggtacccttcttttacaaagaaaacaaatgtttgataaatcgtaatttgctggggattgtgactagcgcttggctagtggtatgctagaaacatttttatgtgttgcttgttagtttccagtgcatgtttcattgctttctggcactagtcatggctattactgcattacattttagcgctcgtctgttagtatatggccaattgttatgagttcaggtggaaatgagtatttgtgcatctgcttccctgaactgctattttggagactggagtccgttattctaaagctcatcttcagttcttggggattttgtctgatactggcctcgctttgggctttccaggggcgccacaggcattgctccaaagctgtgccaccttcgcagcattctcatgcatcatggaggggctcaataagcagcaggctgcaatggctcgcacgcttggagggactgccgcgatggccgtgcatgagaaatgtggtgttctgcccccgttcacgcttccacctattcttgatgcatctgatgctttagcttcatgctgcttagcgttagtaaagcctaagcactagactacacaatagagggcgtgagcgatggcgaagaagggtaacttcaatcttcggctctttattgtgttgaccccaggttatatgaattatgtttttggacaagatgtgtaacgtgcctaaattccagggttttttttggcttcatcggaccaggtttcccttgatgggttaacgttgcagcatgcccttgcggattccgctgggtctagcatatttgtatgggataaaagatcataaatatttgcctgaatgttcggtttccttttaacatcttgcacaggtcttgtcactgacgtgacagttttttttcagaatataaactataaagtagtgacgcaagtaatgttgggtcacccaactactcgatagaaaaagtgtcctaagaggtcaacacaaatacaggttagaatgttctatcatatatatcgatttaacttctggtattacataaaagataggtaactgagatatgagcatggaggtaaagatacacaaatgagatattcactttttcatcgcccttagcttggattcctcgtggtgcaaatagtaagcctctagacgcaacagagattgaaggagccgtcctatcttacgtcctcctactcggtacaaattattgtccaatcaacatgaaactaacaaaac

SEQ ID NO: 24434 - DNA, 1943 bp, Zea mays
aacagatctcctccccccgagaccccccctctctttctaatccctctttcttcccctctctctctctctctctctctctctctctctctctctctctctctctctctctctctcccgcattacccactacctgcttctgctgcttgcttgtgcggtggacgctgcggtgcgggcggtgcggagcggagaggtgaaagaaggggatgaaggaggagatggtggtcggcctgtcggcgccggggccggtggggaggtggggcgccgcgccgccgcaggcgatgctggagaggatgaaggactacggccaggagggcgccttcgcgctctgggacgatctctcgcccgaggaccgagagctcctcgtccgggacatcgagagtctagacctttcaaggatcgatcggatcatccggcgctcccttggatcgcaaggcatcccgttgcctgccgtcgagcccgtgccggaatctagtgtatccaaggtggaggacaggtctcctgaggacaaggaaagatggtggaagaaggggctcaaagccatctctgaggggaagctggctgttgtccttttggctggtggtcagggtactcgtctgggaagctcagatcctaagggatgtttcaatattggacttccatctggaaagtcacttttccaactccaagctgaacggatcttgtgcgttcagaagctggctgctcaatccagtgaaagcccgagtaacactgtgctgatccactggtatataatgacaagccccttcacagatgcttccactcgcaaattcttcgaaacccgtagatactttggcctagaccctgaccaagtgacatttttccaacaaggcacacttccatgcgtctctgccgatggtagatttattatggagacaccatatagggtagcgaaggctcctgacggcaacggtggagtttatgctgcgctgaagtccaagaagctgatggaagacatggctgcgcggggagtgaaatacgtagactgctacggagtcgacaacgcgctggttcgagttgcggatcctacgttcttagggtacttcatcgacaagggtgtgtcttctgccgccaaggtggtgaggaaggcttacccgcaagagaatgtcggggtgtttgttcaacgaggccgcggtggacctctctccgtggttgagtacagcgaaatggacgcagctatgactactgagatcaatcagtcgacagggcgactccgttactgctggagcaacatctgcctgcacatgttcactctggacttcttgaaccaagtggcgaacagcctcgagaaggacagtgtataccatctagctgagaagaagatcccttccatccatgggttcacaacgggcctgaagctggaacagtttatattcgacgccttcacttactccccatccacagagcttttcgaggtcatgcgggaggaggaattcgcgccggtaaagaacgccaacggcgcgacatacgacacccccgatagcgcgaagctcatgctgctccgcctccacagcagatgggtggtcgccgccggtggcttcttgacgcactccgtgcccttgtatatgacaggcgtcgaagtttccccgctttcctcctacgccggagagaacctggaagcgatctgccgcgggcgaacgttccatgcacccagcgagatatcgttttaggatatcgttttgtgtaactgtggactgaacggaaagggttgcaagattgtgcatgtttacttcgaggcgtgagatgggtgtcgggttgatgtgttgcttgtattctctgagtgttgtgatgtagcatctccaactccaaattcatctcgagttttctcccccatctccttggactactgccatttttaatgacaatgggtcaggttcggatcaaaaaaaaaaaaaaaaaaacggccaaaaaaaaaaaaactctcgtgc

SEQ ID NO: 24435 - DNA, 1796 bp, Zea mays
cccacgcgtccgtctctctctctctctctctaatttcccactacctgctcctgcttgttgcttgtgcggtgtgcgctgcgcgcggcaggggggtgaaggggatgaaggaggagatgatggtcggcctgtcggcgccggggccggtggggaggtggggcgccgcgccgccgcaggcgatgctggagaggatgaaggactacggccaggagggcgccttcgcgctctgggacgatctctcgcccgaggaccgggagctcctcgtccgggacatcgagagtctagacctctcaaggatcgatcggatcatccggcgctcccttggatcacaaggcatcccattgcctgctgtcgagcccgtgccggaatctagtgtctccaaggtggaggacaggtctgcagaggacaaagaaagatggtggaagaaggggttgaaagccatctcggaggggaagctggccgttgtccttttggccggtggtcagggtactcgactgggaagctcagatcctaagggatgtttcaatatcggacttccatcaggaaagtcacttttccagctccaagctgaaaggattctgtgcgttcaaaagctggctgctcaatctagcgaaagcccgagtaacactgtgccgatccactggtacataatgacaagcccctttacagatgctgccaccgccaaattctttgaaacccgtagatattttggcttagaccctgaccaagtgacatttttccaacaaggcacacttccatgcgtttctgccgatggtagatttattatggagacagcatatagggtagcaaaggctcctgatggcaacggtggagtttatgctgcactgaagtccaagaagttgatggaagatatggccgcgcggggtgtgaaatacgtagattgctacggagttgacaacgcgctggttcgagttgcagatcctacgttcttagggtacttcattgacatgggggcatcttctgccgccaaagtggttaggaaggcttatccgcaagagaacgttggggtgttcgttcaacgaggccgtgggggaccgctctcggtggttgagtacagcgaaatggattcggctatggctaccgaaatgaatcagtcgacagggcgactccgttactgttggagcaacatctgcctgcacatgttcactctggacttcttgaaccaagtggcaaacagccttgagaaggacagtgtataccatctagctgagaagaagatcccttccatccatgggttcacgacgggcctgaagcttgaacagtttatattcgacgccttcacatactccccgtccacggcacttttcgaggtcatgcgggaggaggaattcgcgccggtaaagaacgccagcggcgcaacgtatgacacccctgatagcgcgaagctcatgctgctccgcctccacagcagatgggtagtcgctgctggcggcttcttgacgcactctgtgcccttgtatatgacaggcgtcgaagtttctccgctctcctcctacgccggagagaacctggaagccatctgccgtgggcgaacgttccatgcgccgagcgagatctcgttttaggaggtagacctgttcatgggactggagtagcagttgtgtcatctgtaaaacgagcgtaaaggatgggcaggctgttgtgtactgcgtgttgtagatgtaacatctcggacggacacaaaattcatctcgagttttctctccaaaaaaaaaaaaaaaaaaaaaaaaaaaaaaaaaaaaaaaaaaaaaaaaaaaaaaggaaaaaaaaaaaaaaaa

SEQ ID NO: 24436 - DNA, 606 bp, Zea mays
accgtcgtccgagttggcatctttggcctaaccttgtatcattgcccaatcacagatctgctccgccttctctttctaatccctctttcttcccctctctctctctctctttctctctttctctctctcccgcattacccaccacctgcttctgctgcttgcttgtgcggtggacgctgcggtgcggagcggagaggtgaagaaggggatgaaggaggagatggtggtcgggctgtcggcgccggggccggtggggaggtggggcgccgcgccgccgcaggcgatgctggagaggatgaaggactacggccaggagggcgccttcgcgctctgggacgatctctcgcccgaggaccgggagctcctcgtccgggacatcgagagtctagacctttcaaggatcgatcggatcatccggcgctcccttggatcgcaaggcatcccgttgcctgccgtcgagcccgtgccggaatctagtgtatccaaggtggaggacaggtctcctgaggacaaggaaagatggtggaagaaggggctcaaagccatctctgaggggaagctggctgttgtccttttggctggtggtcagggtactcgtctggggaa

SEQ ID NO: 24437 - DNA, 1262 bp, Zea mays
  misc_feature (1097)..(1097): n is a, c, g, or t
  misc_feature (1134)..(1135): n is a, c, g, or t
ggcttcgatccgagaacaatccgtcgtccgagttggcatctttggccagaccagtatcattgcccaatcacggatctctcggatctctccctcctctttctaatctctctctctctctctctcacacacacatttcccactacctgctcctgcttcttgcctgttcggtgtgcgctgcgcgaggtgaggagcggagcagggaggtgaaggggatgaaggaggagatgatggtcggcctgtcggcgccggagccggtggggaggtggggcgccgcgccgccgcaggcgatgctggagaggatgaaggactacggccaggagggcgccttcgcgctctgggacgatctctcgcccgaggaccaggagctcctcgtccgggacatcgagagcctagacctctcaaggatcgatcggatcatccggcgctcccttggatcacaaggcatcccattgcctgctgtcgagcccgtgccggaatctagtgtctccaaggtggagggcaggtctgcagaggacaaagaaagatggtggaagaaggggttgaaagccatctcggaggggaagctggccgttgtccttttggccggtggtcagggtactcgactgggaagctcagatcctaagggatgtttcaatatcggacttccatcaggaaagtcacttttccagctccaagctgaaaggattctgtgcgttcaaaagctggctgctcaatctagcgaaagcccgagtaacactgtgccgatccactggtacataatgacaagcccctttacagatgctgccaccgccaaattctttgaaacccgtagatattttggcttagaccctgaccaagtgacatttttcccacaaggcacacttccatgcgtttctgccgatggtagatttattatggagacaccatatagggtagcaaaggctcctgatggcaacggtggagtttatgctgcactgaagtccaagaagttgatgcaagatatggccgcccggggtgtgaaatacgtagattgctacggagttgacaacgcgctggttcgagttgcagatcctacgttcttagggtacttcattgacaagggcgcatcttctgccgcncaaggggttaggaaggcttatccgcagagaaatgtgnnggtgttcgttcaacgagggccgtggtggacggctctcgggtggttgagtacagcgaaatggatgcggctatggctaccgaaatgaatcagtcgaaggggcgactccggtactgttggagcaacatct

SEQ ID NO: 24438 - DNA, 1140 bp, Zea mays
ttttttttttttttttctttttttttgtcccaccaaatgccatgaaatgtataaatatagttcagaaactttgcggtacattattgttattgctggcagcgcctagctgaagacagactactgttcaaaacggattgctggatagacggatacagccagcaactatctagtccatccagattagatccttcgtacgggcgaacaccactcatatacttacatgaacagctaaccaaaaaaaagggaataaaaaacacccgctagtcaggtagaccacagctacagaagaaaaccagctgaattttacagtgtcctatctcggcctccaagccataccactcgcactgctatagtcgtagccctggacgccgctactgccaggcactacaccatactgtggttgatgatgtacaatgttcgtcatctgtgcggcagcggcagcaactccctgcgccggccaccaaggattgctaggctgctgccatgcctgcccaggctgctggatctggaggtaggcatggggcagcgatgcgacgggaacctgaggctgcactgcacttgtgatgtggtactgctgctggtaggcgtccatctgctggacgggaggtggaggcaacggctgttgctgtggggcgtgaggcagtggcggtggctgtttaatcgtctggctggggttccactctggtatgtcgtcgtcatcgtcatcccaggtacgtggggcttgaacagatgatcttttaccatacttctgaaccagttccctcatttgctctgctgggcgagcggagggtggtggtacatgtggccgacccatgtaggcacgcgcagttacattagcagcatggtgtgtcggattaacgaaattaaattcaggaagatcatcctcatccctagcaacaccgggtccaaagcccggaggggcatcgtcagctacatcttcctcctcctggtggcgctggttgggaaagcctggtggcgcaccataagagttgagaggtagggagggccttgcggctgctggatttgtaaccggtggcttccctaggatcgactgccttttggaaccatcatgtctgtggcgggaggtgggtaccctaggaatgtcgggcctccgccatacgacgactccgatgaaggatg

SEQ ID NO: 24439 - DNA, 2432 bp, Zea mays
  misc_feature (22)..(22): n is a, c, g, or t
tttttttttttttttttttctnatattcggaatttaaactggaatttgtctaattattcaacaatgaatgcagttggctgcttgtgttccggcggccaaacgccgtgacgtccgagaattaggatggtcggctacaggactcgtccaatggttggttaactgtaacggttagagtgcaagtagaccgagagaggttaatgaatctttaaactggttggtgcagaggctgaggctggagaatgacgaaacccttgacacatgttgttgccagacagacacattcctgcagtactgatggagtgtactgtgcatgtgcagggcagcagaaagatactggcgatgccattctgttcgggcatggttggtatcaatgctgtgcacaaagcctgcgcgcactgcccagagcatcagcagccatctcaggcccataacgcactgcaaatgcaaatgcaaacgcggcacgggtcagcactttggaaggagttcgttagggtggtagcagcgccgcggtctacatacccatcattatggctgacgacgattgtttgtcgtcagtggcggcagcagcagatgggcaccaccgggaccggagcgccagcctggacatcagccacttcatgacgttaaacacagatcatcatcacttgatacaagtaaagaagaataatgctcaagtagttggctgctgatttcatcaggttgaaaagtgttgggcagagctagaagcatcattactattacacatatctgacggcaagtagctgttactactttacattatcgtaaatgttctgtttgtggcaagcaaagatcgaacaaaaaactgtaggtgcatacagaagaaaaaaaatacagtacaagctaattgtcaaacaagaagccaacaacatcagcagaatttccaaggcccaataacaaggtgcatgaatttccaggtacgcaacgacagcattaagttcaatgggaagtaaagagatccaaggtacatcgtcatacaccacatacaaacttttcacttgcttgctcatcagaactaccagggcctaccgcttcacttctgaaaatatgtgattgcctgtccagcaaagttgaagggcagctggctttgcacaaagtaaggtggcaaaataagtctcagtctctcctggcgcatatttcaccaagaacaccggctacaatatctggattacaaaacgctagaacagtaaaaaggtatgcatcatatgcacaagacgactgccaaattactgtacagataacctgcaacttttccttgatgcaaggccaaactatgtaatcccaacaattttgtgtctacatagaagtcggctgcaagtcaggaaaatccaagtttcacggcagcctgaggtctccagatgggtcacagttgggcattctgcttctttaattcctcgagttcaatcaaggcagcgtcatgctcagtcagtgttcagggcagcggtatattcgagtagtctccatacgaatattgtcttcagccacacctgagttgatgattgtgagattttgtccttacccaatccggttgcgggacgagatcaggcattgtatttccttgtgggggaccctctgaagcaagagctactggcgcaggggcttctggtacaggaatctctggtgcgagagtcttcggattaggaacaacaggaataaatggctctggcgcccatggctcatcatcgataacaatgacctcctctgaatctttctcatcttctttcggctcgatatcttcaatatcctcatcagccgggtcctgattatctgccaaaatatcatcatcggacgcgtccgtcccttccatggagacgtcctcatccgagaggtcatacttaaagtggttttcgtcttgaatcatacttagttcagcaggcagctcagtttgaatctcctattgtagctcagccacccagttccagttagccgggccttcaggttgcgcatcaaatgtaagttcatcgtccgactcgagaagtcaatcgtcatatccctcgaagtcatcctcagatcgggcgtgcgagggtcttgcttctaggttgtgggagggtcctacctctaatgacgatggtggaaacactccggtgctggaaagaggaaacactccggtgctgatacagatgttccctcaagtgctcttctggacagtcaaacgggtgcatgccatcatagaagaaatatgcttgttctgtgaaaaatcacacaacaagcagatcacctttttgtctttggatgataaaccaatctaatttgaccattttatccagcaaccagtattaatctggaaccagtcttgacccagcttgaccaatggaagttcattggaaatgttgccacatttatcgcactgcaaaacatgtggcagactcctccatttacaagaacctatggaaggatgctttacaagcctccaa

SEQ ID NO: 24440 - DNA, 1043 bp, Zea mays
tttttttttaagaaatgacaatatccaacatgcatatagttcccaaatgaggcttagatgtttacaaagcgcagtactggaagttgaatgctgtgccacacaatattccatcattgtcaccatgtagattcagtaaccaagcagacattgttgtttttgccaaagctcggtctactcatcctggactaaaacaaaggccatcttagtaagaaaatacaaatgatgagaactgtttagatgcctcaagctgtccaggagaaactgtgtgatattcagccacagctcagggtcaagggcttccagaacatgcagcgcggccatctctgggcttgctaggtattccttcatgaggtgccctacgaggcgaacgacttctgctatgactggggcgtttaagtacaggagagccactgtgtctgttacgtttcctgtcataatcaggactgatactgtgagtcctatggcgacgatgatcaccatctctgtacccggcctgttcatatcgctccctacttctgctctggcttcgccttctatagtctctatcccgataatcctctcgatacctctgtcttggactgcggcttctgcaacgaccccttggctttggattttcttctgtaattctacccctatgaatcttttcagcattgggtccgtatttggcaaactgcaccatgagcgcacgcccatcaaacctcatcccatcaagcccgtcaatggcatcccgcgcctcatcctcgtaattgtacctcacgaacgcgaaccctcgcggatccccagtcctgtggtcgcgcgggatgtagatgtctaagaccttgccgtagcgatcgaagagcgggaagagatcgtcagccgtagtgcggaaggagacgttgaggacgaggagggagaaagattcgcggttctccggctgcccggagcgcccgaagcgcgacatcgccattgatggcggcggcgtgtttttatttatttatttgattgcggcgtgggggtttggttaggttttggcaaagtccgcgaggaccagggggaaaaaagag

SEQ ID NO: 24441 - DNA, 1945 bp, Zea mays
acaccactgccctcttccactctcatcgcgccggtaaagcccccacgcgcggcgcgcctcccgtccctcctcccctcccgtcctcctcccctctccgcgtcccggctccatgggcggcctgtcggtgatcgcgccccccgcgcgtgacacggcgtcgccgcagcaccgccgcgcgcgccgggcgttcctcgtctccaactacctcatcctgggttgcgcgtccgggtgcggcttcctcacgctgtcgctccgcctggtcccctccgtggacggcttcctcctcatcctgctccacgcgctcaccgtggccgccgccgtggccgggtgcgccgtcatcgcggcgcccgacccgccgcgcggccgctgctacaccgcccacatgtccgccaccgccgtcgtgtccatcctgcagggcgccgccgccgtgctcgccttctcccgcacctcggagttcctcgccggcgggctccggtcgtacgtccgcgaggaggacggcgccgtcatcctccgcatggtcggcgggctcggcgtcggcatcttctgcctcgagtgggtcgcgctcgcgctggccttcgtgctcaggtactacgcctacgtcgacagggagtgcggcggcaacccgctgcgccgcagcgccaaggtcggcggcgaggacggcgccggcacctggccctggcccttccaggtctgaggactggtcacattggccttcgctgcgggaaggtggaactgagaatcgtgtgctcttggaagggaaatcaagcgtcgagtgttgttctactggtagaactgtgtgggtgagaatgggagtggatgctgtgattcgtttattggtttattatgtggctcatatttgtaaggctgttatatctatataattatttatgtgtcttgcgatcgagcaaaaaaaaaaaaaaaaatgtccagcgagtactccagccgcacgttgagcctggatttctgtcgagagaagagatttgagttgcgcatttgatccgatcttgttttgccgttcgtggtgcgtcctgtaagggtttgttctgttaatcccgttacctatggattggatgggattggaaaaatttaagaaggagtttgacttagttgggatttaaacccacccaatctcactcaatccacatggattgagagctaaccgaacaagccctaatggggtaaaagaccagaaattggaccctatctgcatcttcaattgtatttgggtggagtcgtggatggagaggggagctggcatctaggaaagcgacttcaactgttatacatgggcctttttttcattgagcttccaaacattcgaatttgtagtcgtaagttggagcctggagccctcttttctcaaaatcattttttcccccaatagagaacactctggttttctgcagtgacacttggacaccgatgagataactctccatctgcttctgggacgtcggaaggacgcaaaatttcactcttcactccaagtccaagccttagtttccacttgaatccatgaaagcaacagagagcgcgccgaaacatctgcattattgccggcccagagtcttgtagtaccgagaactccagtgatctccacgcgcttcctcgaggaaaaccgaacccccaattatggcaagctttgacgatttacggcgggttacgtgcggggcatgacgcgcacgccaagttgctgctccggggctcggaggtggaccgagccacacgcacccgagcgagaccgccacctgtttgggatcacggaacgcggtcgccttcagacctggaagatgggtggaagctaaccggatcgatcacacgtacgtacgcatgcatcctcggcagggctagctccgggcggcaggaaccctcaggccggtgttgttgttattggcacaagcagaaagctgtgcctgtgcctgcctggttaggcaaaggcttttcaggg

SEQ ID NO: 24442 - DNA, 1299 bp, Zea mays
  misc_feature (72)..(72): n is a, c, g, or t
  misc_feature (337)..(337): n is a, c, g, or t
ctcgcctcactgcacaccactgccctcctccaatctcgtcgcgccggtaaaagcccccacgcgcgcctcccngtccggctcctcccctctccgcgtcccggctccatgggcggcctgtcggtgatcgcgccccccgcgcgggacacggcgtcgccgcagcaccgccgcgcgcgccgggcgttcctcgtctccaactacctcatcctgggttgcgcgtccgggtgcggcttcctcacgctgtcgctccgcctggtcccctccgtggacggcttcctcctcatcctgctccacgcgctcaccgtggccgccgccgtggccgggtgcgccgtcatcgcgngcgcccggacccgccgcgcggccgctgctacaccgcccacatgtccgccaccgccgtcgtgtccatcctgcagggcgccgccgccgtgctcgccttctcccgcacctcggagttcctcgccggcgggctccggtcgtacgtccgcgaggaggacggcgccgtcatcctccgcatggtcggcgggctcggcgtcgccatcttctgcctcgagtgggtcgcgctcgcgctggccttcgtgctcaggtactacgcctacgtcgacagggagtgcggcggcaacccgcagcgccgcagcgccaaggtcggcggcgaggacggcgccggcacctggcccttccaggtctgaggactggtcacattggccttggctgcgggaaggtggaactgagaaccgtgtgctcttggaagggaaatcaagcgtcgagtgttgttctactggtagaactgtgtgggtgagaatgggagtggatgctgtgattcgtttattggtttattatgtggctcatatttgtaaggctgttatatctatataattatttatgtgtcttgcgatcgagaaaaaaaaaaaaaaaaaagcggccgcgcggcgggtcgggcgccgcgatgacggcgcacccggccacggcggcggccacggtgagcgcgtggagcaggatgaggaggaagccgtccacggaggggaccaggcggagcgacagcgtgaggaagccgcacccggacgcgcaacccaggatgaggtagttggagacgaggaacgcccggcgcgcgcggcggtgctgcggcgacgccgtgtcccgcgcggggggcgcgatcaccgacaggccgcccatggagccgggacgcggagaggggaggagggacgggagttaccggcgcgacgagagtagaagagggcagtggtgtgcagaagagggcagtggtgtgcagaagagggcagtggtgtgcagaagagggcagggtgt

SEQ ID NO: 24443 - DNA, 1125 bp, Zea mays
gttttgggtctgccctttttttactctatcttgtcattatattaataaaaagttcacagctactacacccaagatagacgatgtaacaatgcattgatcatccagtaaatggcatcaagaagaatgcttccctgcataagtatagatttactctgtagttcagagcttgcaccgtgcggatgctagagatggcactgtgcctaaagatactggtaaaaagaatacccatcaaaatattggcctagtcagtgagcctcaaatagaaggccaggccaataacctgctgaaaaaggtcgatggtagtaattagcttcacattcgtctgcacaaacaatgatttgccatcgtatagagcatctaagctatatcctaacatgtaacttcagcaacgttttgattcttggaactcggtattattccatcttcctcggttacagaggcgagtgcagctccatcaagaacatcagatataagattgccatcaacattttctatgagttgattctttgaggttgcacagactgcttcagcttgatcagcaaagagatattttgattcagaagagccgcagatgtctctgtaggtatcatactttgcagctcgtgtttggcctccttccaatatagttgacagggggtgtagaattgagatagcactatctgccctctccaaaacagccttcaaatccaagaaatcgtttacagactcttgtttcttgaactgcacaagggcagcagtggaatcaatggagaagacggttgtaactgaacctgaaccaaatactttgcagatgcaatccttaatttccttcggtctaaccttagacaggaatccccagatgacaacaatcccggccggcctcggcggccccgttccttctcgtgtaacctggatctggtgtctccatgccagtgctcaaatcaagcactgttccactgttccagctaggggacaaaaaattgatgtgtttctgcagcttagtgttcgttgctaggttatccagaggtgagaactgctcaaattgtatgccaagataagcacacaactgcgcaaaaatgcatccagtcatgtatgcatcgtacccagcttcatgcttggcaccagaaatgaagcgagaagacatcg

SEQ ID NO: 24444 - DNA, 2027 bp, Zea mays
tgcagggcttgattcaagaatgtgcaaagcaggtcagggcggcgagcgttaagttggatgctcatgttgtcgatcaagtggaagaggagaatgatgatacagagaaaaagtttggtatagtgatcagctttctggtagaagcccgatgaggattgtctatttctggatcttggccgtgtagctttgttctgcttctcttgtgctgttttgcttatgttcagctcctgtgtgagcgttaagtagttgcttggtcatattttcgctttgctttgggtggtagcccgtgaacttgcctgttacttttgatggcactcctgaatcaggatgttatgtctttcaagggaatccatctcttgatctgttaggtgaccttctagtaccatttgtcgtcctctcattcgtagttaatggtccttagtcggactctcctagtattctgaactctggtgtatttctgttatgaaaatatattaggggacggggctccataatattttttaagatcttagaacctagacgacacccaagatatgttctgtggaaccaacccaagatatgttttgaggaaccatagaagacttgaaaatacattgtggggggttgaggaactaaaatatgccccgttacaagtttagggactgcccatattttactctattttgtcattatattaataaaaagttcacagccactacacccaagatagacgatgtaacaatgcattaatcatcctagtaaatggcatcaagaagaatgcttccctgcataagtatagatttactctgtagttcagagcttgcaccgtgcggatgctagagatggcactgtgcctaaagatactggttttttttttttttttcaaaatattggcctagtcagtgagcctcaaatagaaggccaggccaataacctgctgaaaaaagtcgatggtagtaattagcttcacattcgtctgcccaaacaatgctttgccatcgtattcgtatagagcatctaagctatatcctaacatgtaacttcagcaacgttttgattcttggaactcggtattattccatcttcctcggttacagaggcgagtgcaactccatcaagaacatcagatataagattgccatcaacattttctatgagttgattctttgaagttgcacagactgattcagcttgatcagcaaagagatattttgattcagaagagctgcagatgtctctgtaggtatcatacttcgcagctcgtgtttggcctccttccagtatagttgacagggggtgtagaattgagatagcactatctgccctctccaaaacagccttcaaatccaagaaatcgtttacagactcttgtttcttgaactgcacaagggcagcagtggaatcaatggagaagacggttgtaactgaacctgaaccaaatactttgcagatgcaatccttaatttccttcggtctaaccttagacaggaatccccagatgacaacaatgttatcatacacagcagcagggtaccttctcgtataacctggatctggtgtctccatgccagtgctcaaatcaagcactgttccactgttccagctaggggacaaaaaattgacgtgtttctgcagcttagtgttcgttgctaggttatcaagaggtgagaactgctcaaattgtatgccaagataagcacacaactgcgcaaaaatgcatccagtcatgtatgcatcgtacccagcttcatgcttggcaccagaaatgaagcgagaagacatacatcgtttcatctccttcaacttcaattgtcacaggagaatgactggatggcttctcaacagatgaataagatgcagggcacaacaataagaaagctgaagatagtgatttgcttttgtgcttcatcagtttctgaactgcttgattgacagacataagatgcctggtatctgcaatgtgtgggaaaattttgtggaaacttaacgcaaattccttgatagatgatggaagaggacgtacaaacttgctgtacacttgtgcaatttta

SEQ ID NO: 24445 - DNA, 1273 bp, Zea mays
  misc_feature (4)..(6): n is a, c, g, or t
cggnnnttttttttttttttttcgagcttggggacagtaatttgatcttgtttggttaaagcatcacaatttctagacatatttgtatgttgattgagcgttcagtcgctctatctttgctccaaaatcctgaaatgcctttcaggcaactaatatcagcaccactatgaattgggggtgtcacttttcaatcacctaattcggtccttgaaaagaaatctcacatcgccagtagctgactgtctcttagcagtgatttgaatcacagcaccatcagcaagcatgcgctgaaccactcttgcgatattttttgaatcgtctatcccgagatggtggtttccaacaattggcagttgaagttctctcatcattgtcatcattccagttgcccttctgttatagaagttgaggtagatatccttcaagttaatccattccataaaataggtaggtaaatttatttttgaaaccttgcactgctcagggacctttgtcttcaaatcccagtttccacaagtaacaaatgctccacggttgagtgatccaccttgctcctttttccacaggttgtgatttccaagccagtcctcaaactcttgcagcacttgcttgaaaggggtagcagtgtcatgccaaacacggtcaaccccaaattttccatatttcccttctatgtattctgttgttctttgctcactcattgcagttggacgcacaaacctatgaaatgaatcaacaaattctctgttttgagcatcaatcatcatgactgggaactcaaggatttcaaccctaccctccaaatcaagaatcaataaatattccagtttctgaggcttggatttatctgtggctgatgcattcactggaaggtccatcttcaaattgtgactgaacttctccagatgcattgcatcattcatcattgtgcatttgccctgggtgtagtacaaacacgtgggcttccaaggatacctggagctcggcctgggcgcctccatgaccagcccctccctcgcagcgtgggcagattgtgaagtaagagagaaggcggcagcaacgggggagcttcttcggcgggaattgcggatgggaaagtccgaggagaaagggcggaagaaggattggagcaggggcggtataaggttcgctaaggaagacggtgaaaccctagccagagccatcccaatttccacagaacaaatgttgcttcagttccggttcgacagccgaactggcgacgttttctcccctctccatacgcggtacccaa

SEQ ID NO: 24446 - DNA, 1254 bp, Zea mays
ttttttttttttttttcagcaaactgaagtttgtttcgtcgtgttgcaagttttaatcaaatacggcgcggctggaaattacaacagcaccagctaacctgtcctggtcatctcacttttctcaagtgctatcagtattacttagaataggacaataacatttgagaaatttatatcatccactcagctgctcaactttgttggaatgtaaacaaaacacaactaatgtgaataaaacataacttcatcgccacagatgacttcagtttccgctgatttccttctccttagccttgcacatatcatctgacgactttatgaactttttggtcaattcttcaatctccttctcaatcctctttacgtcatccttgggcatactagatgcagacttctttattgtatcaagtgccttttggcgtgctcttctaatactttgtttaaaatcctccgctgatttagtaacaaccttgcacagtgcctgtatgttctcctttgtcaacggagggatagctgcaataatcctattcccatcaggtgttggattaatgcccaatggtgatgagataatagcatgctcgatcgacttcatggaagtaggatcataaggcatcactgatagggtatgtgcgtccaggacagaaacaacggcaatgcgattcaatgcaactttaacatctgcattctccaccatgatatggtcaagcatgccaggtgtagctcttccagtccgtagtttgctcagctctcgtgacagtgcgatcactgcagcgtccatttgtgcggtggcagctgatttgacagttggcccaatgtcaggaacagcttgaacagtgtcacctcgatcatccttcgatttcttccccttcgcgaagcctcttcggttctcgaagaagaagagctgcgccggagccaattccccggcgcccgcaagggacgccccggctgggaggcggtgcacagtggtggaagcggaggaggcggccgcggcgcggaaggagcgggcggcgagggccacgcctcggcgaaggaggagcgccataagagaagtggttgggagttgcgctgaggctggtctacagaaggctcaggtggtcaggtttcctatcagctacgccggctagcggcaacgacggcggcggcggcggcgagaagaaacagcacaaagaggggggttttgcaaacttgtcctgtccgtgggtctttacccgtttgcgaccgaaacgagaatggacactttgtgatcgcgatctc

SEQ ID NO: 24447 - DNA, 1713 bp, Zea mays
tcaagaaaaatagtttttttttaaaaaaatagaaatctcttttttttttttttttcccaaactatatgttcaccatttattcttgtgcataagatataagaatatacaactcaaaaaccacttattataggtgtaaacgataaccaatgtaatcaccatccgaacagggcctaactgatgcttaacgtttcctgtgcagcctgctccaacagtggcttttgtggtgaggaagcgagataagctttggcttgcttgccgaaagccgtcttgagacttcccactaaccactgcagattgcctacctgaaaaggacatgtgcccaactatctgtcataggatagagctcctcagacaacgagagaaattcccccccccacagcagctaaacgcagcaggaaactaacaaacctcgcggacgaagaaggatctcgtctcacatagtactgttcgagacatgtatttggttcttctgcagcttaaatttacagaggatcgagatcaaactttaaaggaaggagaaataaaaaaaagagctaacgacaactcagtttgagcagcctaataagcaagatggaagtaggctgatgagtaggctcctccctcttattgtcttcacacaggggagctgctctgctctcatcatatcaccagagcaacgccagcttctccatcgaggccacgcatcgacgacgacatgtagacgctacagctacaaacatggccgcgcttttgacgctcacacaaacttactagtagcagagcaggctagtcgaggcaggtgccgcagatgccgtacccgccgctgcactcgggcccggtgccgtcgcagatccccgacgcgccgacgaacaccgggctgccgcggctgccccggcgcttcctcccccgcctcccgtcctccccgccgtcgccgacccaggtgaagatgatccacgacatgacggacagccacaggatgaccgcgaagtagagcgcctcgccgccgaggccgccctccgccacgctcaggaaacgatccgcccccatatccgctccctttcaccttcggctgtgactctggctggccggccgaccttctacgagctagtgccgtgtccctgtccggttgtggtggtggaagcggtgggtgtgaagcacttgaagcactgcgcctgttgcctttatagcggtctccctttatagtcgtctgccgggcgttggatcatccatccacaattccacatccgcgcgcgccgccacggcgggaaaacggtgccgtcacggggcggaaccgtggctgttgtctttgcttagcgtgcgctgcaggagctggggtcgttcggttcggctcgccacctgcgctgttgtcctgtgggcgggcgggcgggcgggcttggacgcggtccgtccccggcggcgcggcgtggcctatcctattggaaaattttgtacgcgagcctctaggagtgctcggagagagtgcatgtgcgctgttcccactcggtactcacgtacgcacgcataccggcgtgtgtgttttggccgtggtacgcacaggttggccgagtcaagtcgcgggcgttttggctcctgcaactgcaatcgaacgcgcgatgtggacgcggggcgggcaattaaaacgtactataggtagcgggtggttgagcgactggattaagcaatcgcggttgcttagcggcgtggagctcagcttcctctgtttcgggaaaccga

SEQ ID NO: 24448 - DNA, 1128 bp, Zea mays
taggggccttttggccgctttttttctgccgcccctctttttttttttttttcgtctcacatagtactgttcgagacatgtatttggttcttctgcagcttaaatttacagaggatcgagatcaaactttaaaggaaggagaaataaaaaaaagagctaacgacaactcagtttgagcagcctaataagcaagatggaagtaggctgatgagtaggctcctccctcttattgtcttcacacaggggagctgctctgctctcatcatatcaccagagcaacgccagcttctccatcgaggccacgcatcgacgacgacgacgacgacgacgacatgtagacgctacagctacaaacatggccgcgcttttgacgctcacacaaacttactagtagcagagcaggctagtcgaggcaggtgccgcagatgccgtacccgccgctgcactcgggcccggtgccgtcgcagatccccgacgcgccgacgaacaccgggctgccgcggctgccccggcgcttcctcccccgcctcccgtcctccccgccgtcgccgacccaggtgaagatgatccacgacatgacggacagccacaggatgaccgcgaagtagagcgcctcgccgccgaggccgccctccgccacgctcaggaaacgatccgcccccatatccgctccctttcaccttctgctgtgactctggcttgccgaccctcctcgagctagtgccgtccgtgtccctgtccggtggtggtggtggtggtggtggaagcggtgggtgtgaagcactgccccggccggcctcgaggccggtctccctttatagtcgtcggccgggcgtcggatcatccatccacatccgcgcgcgccgccacggcgggaaaacggtgccgtcacggggcggaaccgtggctgttgtctttgcttagcgtgcgctgcaggaggcaggagcaagcggggtcgttcgggtcgccacctgcgctgttgtcctgtgggcgggcgggcgggcgggtgggcttggacgcggtccgtccccggcggcgcggcgtggcctatcctattggaaaattttgtacgcgagcctaggagtgctcggagagagtgcatgtgcgctgttcccttcccactcgtac

SEQ ID NO: 24449 - DNA, 755 bp, Zea mays
gacgaagaaggatctcgtctcacatagtactgttcgagacatgtatttggttcttctgcagcttaaatttacagaggatcgagatcaaactttaaaggaaggagatatatatataaaaaaaaagagctaacgacaactcagtttgagcagcctaataagcaagatggtagtaggctgatgagtaggctcctccctcttattgtcttcacacaggggagctgctctgctcatcatatcaccagcagagcaacgccagctgctccatcgaggccacgcatcgacgacgacgacgacgacatgtagacgctacagctacaaacatggccgcgcttttgacgctcacacaaacttactagtagcagagcaggctagtcgaggcaggtgccgcagatgccgtacccgccgctgcactcgggcccggtgccgtcgcagatccccgacgcgccgacgaacaccgggctgccgcggctgccccggcgcttcctcccccgcctcccgtcctccccgccgtcgccgacccaggtgaagatgatccacgacatgacggacagccataggatcaccgcgaagtagagcgcctcgccgccgaggccgccctccgccacgctcaggaaccggtccgcccccatctcgctccctttccccttcggctgtgactctggctggccgaccttctacgagctagtgccccgtgtccctgtccctgtccggtggtggtggtggaagcggtgggtgtgaagcactgcttttttttt

SEQ ID NO: 24450 - DNA, 813 bp, Zea mays
ttttttttttttttttggataaaaaggaggaaatgctggatctaaccaataagcagtccccggtagggaaacctgggtctgtcggttattatccaaggagccgagttgagctcaatgagccgcgatgtgaaatcgaagtaacataactgaccaaacgtctgcattgattagaaaaaaaaaaaaaaactagtgttggactgcatcgttgtggggcatctttcttgcacttgttgcttgtaactctatgaaccacatgaagtacttaatacctgcaaggcttgaagcgctccaaacactgtttgagcctggatctgtgcatacagtgggtctcctgtcgttggaacagtcaggttatacgactcatctgccccaaagctaagctcgtcttcaggtgtacgcacaaccacattaacgcaggtgagaaccgaggagcctgggtcgattccgtcgatgacgtggttcagcgtgatcaggtcaagcatccgctggaacgcgtccttgaggatcgatttctcgtcggagtacgtgctccccaccatcgacatggtgatgtccttcttgacgtagagcttctgcgtcccgtgcgacaccgactgcggcatcggccacaggtcgatgctgtcggcggcggcgcagggcccgatcgccaggaacgcgaggagcagactcagagccagagccgccgccggcgccatatctctgcaggaactgcagatacccttttgttttgttctctcgatcgatcgatcgatcttgcttcctacacctgtttggaagggaagcaatggagagagtatttgggtcctatcttag

SEQ ID NO: 24451 - DNA, 824 bp, Zea mays
tttttttttttttttttgcatcaatcactcctttgattgtcttaacagggaggtagtgtctcgcggtatctgcaggcaagcataaattaacgttgttttgatcgctcattggacgtccacactgttgacatctgatatggataaaaaggttgaaatgctggttctaaccaataagcagtccccggtagggaaacctgggtctgtcggttattatccaaggagccgagttgagctcaatgagccgcgatgtgaaatcgaagtaacataactgaccaaacgtctgcaaggcttgaagtgctccaaacactgtttgagcctggatctgtgcatacagtgggtctcctgtcgttggaacagtcaggttatacgactcatctgccccgaagctaagctcgtcttcaggtgtacgcacaaccacattaacgcaggtgagaaccgaagagcctgggtcgattccgtcgacgacgtggttcagcgtgatcaggtcaagcatccgctggaacgcgtccttgaggatcgatttctcgtcggagtacgtgctccccaccatcgacatggtgatgtccttcttgacgtagagcttctgcgtcccgtgcgacaccgactgcggcatcggccacaggtcgatgctgtcggcggcggcgcagggcccgatcgccaggaacgcgaggagcagactcagagccagagccgccgccggcgccatatctatatatgcaggaactgcagatacccttttgttttgttctctcgatcgatcgatcttgcttcctacacctgtttggaagggaagcaatggagagagtatttgggtcctatcttag

SEQ ID NO: 24452 - DNA, 1314 bp, Zea mays
ccaatctcttctaatccatgtataataggaataaccgaaaaagtcataactgtgtgccccgttggaagctattacagttcatcaccataccatgtagattgcataggcatccaaattattgtggaaggaaattggattggagaggagcaaaaaaaaacatgaaacattctacgcaaccctaaacctactatctgacgtgcactctgctgaatgtataacaggggtaagagtgaatcctatgttttttttttggtcaaggaatcgtcactttccgtttagttatggacatttattgccttacacaggggccaggttctgatggtgatgcacgaccatagcctgctaatggcgcagcagctactcctctttggttcagcaaacacctgaagcgcgccaatcttgacgtgacgaatcttgtgtcatttgcgagcttctcaatcggagtccacagcctctctgcagctgctgcggcacgtggccaaatcgtttgctgaatgtctgaggcatcaatttcctcaccccacatgcaaacctcaccaccaatgaccaattgctgctgctttgtatcattgataccttttaggggctcgttcatgtaaaatccttcccatgaggcatccaagtgatccaggtaccacttatcctggttgcttactatacacctatgccctgcagcaaccactttgggcgctacatcttctccaagccagttatgcaccacggttttagggtccaatttgtctccaaaactgttaaatgtctcttcccagtttatgacatcgtagccatgtgatatcgcgatcttttgagatctcaatacaaaatctctgtatgcgtctgatacgttcatatggttattattcaaccatccttcaatatggggtgttctggtccagcagcttgtgttgacttcatcacctcctaagtggacaaatttgaacttaaaaatcttgctaaaatctgaaagaatgccatcgatgacttcaaacgtgaagtttttactgacatcaagtggttctctgcagctttctgatggccataatgctgggtagccgataccccatgagcgggcatggccaggaacatcaatctcagccaacacatttacacctcgcttctcggcataccgtacaatgtcaatagcatcagacatcgtatatctctctgaataagagtatgaaccgttccacagtttggggtatgagggtatctcaatgggaaacgactgctcgtccacgatatgccaatggagaacattcaatttgctgtaagccattgcatcaatcactcctttgatcggacgcgtggtcgacc

SEQ ID NO: 24453 - DNA, 1014 bp, Zea mays
  misc_feature (33)..(33): n is a, c, g, or t
  misc_feature (52)..(52): n is a, c, g, or t
  misc_feature (62)..(63): n is a, c, g, or t
  misc_feature (69)..(70): n is a, c, g, or t
taggggcctttttttttttttttttcggataanaaggttgaaatgctggtcntaaccatagnncagtcnncggtagggaaactggggtctgtcggtattatccaaggagcgagtttgagctcaatgagccgcgatgtgaaattgaagtaacataactgaccaaacgtctgcattgattaggaaaaaaaaactagtgttggactgcatcgttgtggggcatctttcttgcacttgttgcttgtaactctatgaaccacatgaagtacttattacctgcaaggcttgaagtgctccaaacactgtttgagcctggatctgtgcatacagtgggtctcctgtcgttggaacagtcaggttatacgactcatctgccccgaagctaagctcgtcttcaggtgtacgcacaaccacattaacgcaggtgagaaccgaagagcctgggtcgattccgtcgacgacgtggttcagcgtgatcaggtcaagcatccgctggaacgcgtccttgaggatcgatttctcgtcggagtacgtgctccccaccatcgacatggtgatgtccttcttgacgtagagcttctgcgtcccgtgcgacaccgactgcggcatcggccacaggtcgatgctgtcggcggcggcgcagggcccgatcgccaggaacgcgaggagcagactcagagccagagccgccgccggcgccatatctatatatgcaggaactgcagatacccttttgttttgttctctcgatcgatcgatcttgcttcctacacctgtttggaagggaagcaatggagagagtatttgggtcctatcttagggcccggccggccgccggggacccatatgaggaggagcagaagcatgacgctgcgaagcgggggtcaaggagtgggtagacggaaggaagaaaaggcatgcacagcacaggcagggcctggtggtccgctgcgcttcggtgacccaaatcaggtacggatgggcaggcagacagtcaggactcctcgtgccgaattc

SEQ ID NO: 24454 - DNA, 3112 bp, Zea mays
aagagtgtgatataagttatatattcggaaaaatagcatgtaaatctattaaatcaatttccagaaacttatcgatttgagatagacttatatgataactttagaaagttgtggaatgtcacattctaaaaaaatagtctattccattagtaagattctaattccttaaaatgaaaggaaacaaacgggacctaacagtaattaaaaaggggtataaacagatgaagttggcaacaaagacaaactacaaaggatatacaacgagtagagctccattatttgggttccaccttagaccttgttcggtcgtgtatagatgtagatcaaagagaattaaggaaattaaatcttcttgtattcgattttaattagaagaggatttaatcttctccaatcgaccaatcccaccaatccctttggtccagacgcaaccgaagattggacttttagttacgcgtctctggcgcttgtatctctttcctactttataatttatatacaagctggcaggttccgaatcttttttaaaaaaaagaatgaagcaaaaaacttacgagggaaaggagattaaagtgatagaaattgattcaaaatttaaatacatctgtgcagggagcaattctttcccttctgaattctggcaagtcgataaataacacaattacacaaagataactaataatttatcacctacttaaacactaattaaatttcatcagctaaataatagtagaacttactgctaagtctatacactctgctacagtaacacgcctcgagtacctctgttgtcgcaaccggaagtctcctacgcacccagggaagaaattaatggatttagaatattacaaaattcactgatcaggagtctcctaattattaggtcaccaaaccagtcctttcttcagcttcatgtatcaaaactctcatcacatatgctctgacaacaaaatgagctgcaaaataacagaaatggttaatactgatatgttattacctgataggtgttaactatcaagtgcgtacatagcagtaatgtaaagaaaatggaaaaatggcatacctgttcggcaacctggactagaagactgtcgccttgtggagaatctatcagatgattcagttccacatgatctggatgaagcttttgcttgttagttggactacacaggtcactgctctcttcaggaacagcacgttgaggggtgctgttaatagacatacccttgcgctttctgcgattgaatgtgtatttgatgtgtctggcaccttcagcttgcatggaagctccagaagatgcctttgtatgatcttttttgttcagggagctgccaactgaaacatcttgtttctctaaagcttgcacgggaactccagaagacgccttcaaattttctttgtctacggagctaagagtcgaagcatcagtcttaggtgaagccaaactgcagcttccatcctcattaacttctttcaagcttgcagtattattatttggtgttatcagctcctgctggtccaccgccaagttacctgcatcatgttaagaacgttttgattcaaaccacataaaaaattgaccaattttacatgaaaggatagaacatgcacataaaaaagctttctgaacataccataatctgtagtttcacttttgatagactgatgcatccctgcagagctgatttcaggatcaaattgaccattaccagcatcagtctgatgcatcatgtttccagtagcacatttcaagaaacggtcactgtttctggtgggtgtatcagagcgattcttagtcatcccagaaaccaattgattaccagacatgcttttctcactggtcataagctgggtgttatctggctcaggaacacttttggtatcggaaaaatcatcttccaaaaccctgacggtctttgttctttttcttcttttcatttgcatgttgttgactgcaagtacatcaatcagttctgggaaagcattacaccgacttaactcagcatccctcctgctcattttgaagtcttccttcaggtcagttaaagcctccccatcatgttcagctgacatctttgaaggtgaaagatcctgttcaagtgcctgaagtagcagcaagcagccatttccatcagattcagatctatcagataacttatattccgctcccccatgctcactagaattatcatgcttataactaggcctgcttcttctgcctctcttacgcttgaacttacccaaaaaatttgtttgaagtatttgttccatgatggaccttgggttttttgcagcattgttcattctggcctttgagcagctatttaatgcagtgacctgcttctgattttgcttccagaatgcatctgtactttgagtctgctgtttaagtgcatggattcgctgtgtacacccattatgatagaactttggtttcttgttccttaccattaatgatggaagatcaggactgcgacgatccatgtcctccaagttttccactgcttcattctccttctcggtgattggaacaaggcaagtgtcatcacttttgtcagcaaactttttattcttcaacagtatatttcctccttgttgatgtatcttagaaagagggctaccgtttttattagaataaacgttgttagatgtgggaaggctatttattctttcatcagctaaagttttctttgtcagctctaattcagtaattgccctctgcagctcaaccttaagcgaggccatagcattttgtgaaccatgcaattgctcttctagttccttgatcttcttaacatgcaccaaagattccagttctttctcttttatcctggcttccatgatggccttgacccgcaggagcgtagcgacgccgtcctccttcgcggcctcgagcccggcagctagcgccgccgctcgccgcgccgccgccagcacccgcgccgccgactcctgcgccatgttgagcatgatcccggcgtacgcctttttcatcgcctccgcctgtgaatccgccattttggagcgggaaagagctgggggcggaggggagaaggggagttgaaggttgctggtgctaggggggtgtggcggttgcaatatgacggcgtgc

SEQ ID NO: 24455 - DNA, 3887 bp, Zea mays
ttttgcagcaccaaaatcagagtgtgttcgtgtgaatactttgtgttcgtggaaagctgtagggaagctatacaagcggtaggatttttacatcacagacggttcggttagaaaaccgcctgtgatgtcccaggcggttcagtacgcctgtgatgtaatagtatcacaagcggtttttgtttaggaccgcctgtggtgctctatccttttcacaaacggaccctaagaaaaaaccgcctgtgattgtaaaaatatgaaaatacaatttaaatatgaaaataattttaatttttaacagaaatatgcaaatacaatttaaatgaattaatatttaatttttaacaataatatgcaaatacaatttaaatgaattataatagcacacatagataactagagagattttaaattaattggcaaccacaattcatagtcgatcatacatgataacaaatacaatttgattcatacaatttttcatgaactaccatttttccgcatgtatggctttaagttcttatcaattttcttttccacacgcttgattctctctggaccgttaaagacgaacatctcttcatacttattgtattcctcattttggtctcccacattctcaactccaacaattttttgctttccagaaataactacatgcatcttctcatctgctggatcgagtacatagaacacttgtgcaacacattcggcgagaacccacgggtcatctttatatcctactttctttaagtctaccagtgtgagtccgtagttatccactatcacccccacgggatgttgtacccattggcacttaaataagggtattttcatgcttgggccataatcaagttcccatatttcctctatgaatccaaaatatgtggtcttctgtccatgtaggtcaaaagcatcgatacgaacaccgctattttgtgcaacacttttcatgtcttttgatttagtgtagaatgtgtacccattgatgtcatatgcttgccatgatgtcacaaaacacgatggcccagaagccaaattcttcattgttttctcttccaaagagtctccgaatgggatgtttttgtccattaaccattcgctgaaacgatgtttgtgctccctcatgatccagtcctctgtgcggttctgattttctttacgaagctcatccaggtgttcctctatgtaaggctcggctatcgtgagatgttgtagtacactaccatgagcacaatgtactagcttgtaatcctcaacgcgaaaagttttcttgcccattctccctctcccacatagtttaccctcatgtttaggtacaggcacacctatcattgttccgtcactgatgtaatctatacagctctcaatcacttcttctgtagtgtatccctccatgattgaaccctctgggtgagcgcgatttcgcacataaccttttaatactcccaggtatcgctccaactgaaacatatgatgtaaatatagtggccctaatatttttatctgatccacgagatgtatgattaggtgtacttgcatatcaaaaaatgatggaggaaaacacatttcaagcttgcacatagtctcgatgatgtatgcctttagatagtccaagtcttctaaagctattactttttgtgaaaccgcattgaaaaagtaacacaagcgtgtgatgacaactttgacatgctctgtttcgagggctcttaccgcaattgggaggaacaccgtcatcatcacatggcagtcatgagagttgtagccaaatagagacaagtccttcatcctgactagtctgctgatattggatgagaaacctgtgggcactttgaccccacgcaaacatttgcaaatctttgttctctcctcaactgacaagttgtagctagctggggggaggtaaggcttccctttgccactatccactggatgaagttccggtctgatttgaagatctactagatcattgcgtgatttaagtccgtcttttgtcttactcggcatgcccagcaaggttccaatgatgctgtcaaaaacattttttgttacatgcatcaaatcaatgctgtggcaaatttccatatccttccagtatgggaggtacttgaaaaaaattgattgcttcttgaaagttgtgtaagttgaagggtcagttctctttctcttttctcctttgttttttccctttccgaatacaacatgaatgttctttacaatttcaaaaacaagtttcccactataaggctttggtgcaccttcactttccagttgattgttaaattcctctttcatctttcggtacttatgctgcttcatcaagaaccgtctgtgtcccatgaacaccaacttcttggatgatttaaggtacatggaagcagttccatcgacgcacactacacaaccattctttcctttagtcttttgccctgatagtgtggcgccaccgggagaatcatggatggtaacaaatataattgctcttaagttgaaatactcatggcaatactcatcccatattctaactccttcattccagagctttgtcatatcttccataagaggttctaggaacacatcaatatcaacaccagctgatttcggaccttgaataagaatagtcaacataatgtactttcttttgtgacacagccatgatggaaggttgtacatcgttaaagtcacgggccaggtgctatgtacacttcttttttcaccaaatggattcattccgtctgtacccaaagcaaatcttacatttctggtttctttggcaaactcaggatacataagatcgaaatttttccattgtgatgcatcagcagggtgtcgaatctgtttgttattctgcttgcgattttcagcatgccaacgcataagctcagcctccctaggatttgagaacaaacgttttaagcgatcaattactggaagataccacatcaccaaagctgggttctttgacttctttttcccatccatgtcatcaaaagtgtcatcgtcactttcaggtccaatagtggatttcttgtttttatttttcttcgggaatttttttacacagtcttgattgtagctcttcttgtatcgactgacattgcaaactgggcatcttgatgcgttctcaaaatcgccacgatacagaatacaatggttcggacatgcatgaattttttgcacacccagagctatgggagatataagcttcttcgctttataagtgcttgttggtagtttgttgggttttggtagtaattgggacagaaaattcaaaagatctgtgaagctagtatcagaccatccggcgctagccttcaacttcagaagttctagaactgtacgcagtgtagtaaactctttgtcacaaccctttgattcatcatataaaggttcttttgaggcactttccagtccctccattttagatagccctttctgcgatcccacagaactcaacatttctggttccatatggcgcaacatctcttcgcaatcaaattcttcaaaatcttgattagcatccacattatccactttaccatcaactttaagatctaaaattccgacaactctctcgtcattaccaggcacttcacacggatccaactcaccatgttctgaccatatcgtgtaattgtttttaaaccctctttttagcagatgtgattggattactcctgtatctctccaagctatcttattatcacaatcgatgcacggacataatatctccttactctttcgcaaattcacgtgcttgttggccgcttcaataaagcttctcaaatttcgaatgtacgatggatgtggtcttagcacattgtacatccaacctcggtgcagcccacctaagagaaagagaagagcatagatgtagcccgggcggggga

SEQ ID NO: 24456 - DNA, 656 bp, Zea mays
gcccgcggcccgcccggccggggcacaccactgtactcgcctgtagctcgccggagatccatgcctttgtgagctcgagtggagagaaaaaaaaaaggagcagcgaagagcgaacgaccgagatgctggagaagctgtgggacgacgtggtggccgggcctcgcccggagacgggcctcgagaagctccgcaaggccaccaccgcccgcccgctcgtcgtcgtcgacaaagaaataactacatgcatcttctcatctgctggattgagtacatagaacacttgtgcaacacattcggcgagaacacgggtcatctttatattctactttctttaagtataccagtgtgagtaccagtgtggtccgtagttattcattatcacccccacgggatgttgtacccattgacacttaaataaagggtattttcatgcttgggccataatcaagttctcatattttttctatgaatccaaaatatgtggtcttctgtccctgtatgtcaaaagcatcgatacgaacaccgctattttgtgcaacacttttcatgtcttttgatttagtgtagattgtgtacccattgatgtcatatgcttgccatgatgtcacaaaacatgatggcccagaagccaaattcttcgttgttttctcttccat

SEQ ID NO: 24457 - DNA, 960 bp, Zea mays
gccatatcatccagactattaaataaatccaaatgaatctccgtcgaaacctttcacagactataccaggacgcaagatccaacggactgaaataaattaataactaatcagaagctcaggctacactagatgcagacacaagctgagttgattatagaaacgaaacccgacatgaataaatgtttccagcaaatttaactggaaacacacctatacaaaggctgcttctgtatgtacaaatcatctaaaaaaaacgttaggctacataaagtagctcaacggtgtcttgtgcctcgacccgccttctccgtagaggtcgttccattggacgagctcattcatattttttgaatccgatgatatactcgcacaaacctgctcatgtgcgtgcttgaaatcactaaactttagggagcgaacgtcgccgctacagcactgaggtggggctggcctattttctgcttcagctaaggttctctccttcttctctctttcaagaatttcccttatgggacgatgtgctgcagttatacacaggttcttcagatcactgcctgaatacccatctgtcaggtttgctagcgcctccagatctacatcatctgccaaatcttcttttgctagtatcacgctaagaatcttctttctgttgggtgcatctggcaagttaaccatcaacctcctggggagccctcctgacaacagccaccgtcaatccggacatcagtagtacccatggccttctgagcgaacttcctgatctccttgatggcatttggtgccttcttcttgaaggtgcatccgtggaggcgtttgtggaggttgatggtgtactcgcgtgtcaccacctcatccttgcgagtgccggcgcctcgcttcttctccgccatctccgctccgccgccggctccgcgtccgcccttgtttgctcgggctcgagggaggttgcggcgtgagat

SEQ ID NO: 24458 - DNA, 2557 bp, Zea mays
ttttttttttttttttaccatatcatccagactattaaataaatccaaatgaatctccgtcgaaacctttcacagactataccaggacgcaagatccaacggactgaaataaattaataactaatcagaagctcaggctacactagatgcagacacaagctgagttgattatagaaacgaaacccgacatgaataaatgtttccagcaaatttaactggaaacacacctatacaaaggctgcttctgtatgtacaaatcatctaaaaaaacgttaggctacataaagtagctcaacggtgtcttgtgcctcgacccgccttctccgtagaggtcgttccattggacgagctcattcatattttttgaatccgatgatatactcgcacaaacctgctcatgtgcgtgcttgaaatcactaaactttagggagcgaacgtcgccgctacagcactgaggtggggctggcctattttctgcttcagctaaggttctctccttcttctctctttcaagaatttcccttatgggacgatgtgctgcagttatacacaggttcttcagatcactgcctgaatacccatctgtcaggtttgctagcgcctccagatctacatcatctgccaaatcttcttttgctagtatcacgctaagaatcttctttctgttgggtgcatctggcaagttaaccatcaacctcctggggagcctcctgacaacagcctcgtcaagatcaaatggcctattagtggcagcaagtaccagaacacgttctttgtcttttgtcctaagaccatcccagttcaccataaactcatttttcatcttgcgcatggcctcatgttcccctggattctcacgtctacccagcatgccatcaacctcatccacgaaaataacactaggagaaattttgcttgcaagtgaaaaaacagctttcacatatttttctccctctccaaaccactttgaagcaatgcttgacattgatatgttgataaaattagcaccagcctctgttgcaacagctttggcaagcatggtcttaccggtgccaggtggaccaaaaagcaatatccctttacatggcttcataagttgtcctttggagaacaactcaggcctttgcaaaggaagcataactaactcctgcaaagtttccttgacattttctaatgctccaatatcctcaaaggtaacaccaatctcatctggagggatgacatctggaagaagacgtttttcaaattcattctctgtgacaacatccttgagtgacttctttgtgctcttcttcttagggccactttggatactttccaacaaatcaattccatacttaaggcttacaccggaaaggacaactctcgcatcctttccaggagtttgaatagggtgatccttgagttgataactcaaagcataaccaactattttatcgacacattcgcttgtcagattacgatctttgacacaaaccactgattctaaatcagtacattccataccatggcgggttagaaaagattgtattttcaaaaaattagcctttgccttaagaatttcaatgtcacgacccaatagctgtttccactgggagagttccgtttcatcctcaggtgattcaattgtcactttatttgggaaaagtttagttatatgctttgacatcttgagtgcttctttatttttttcacccacccgaccaaagctatcctgaaatgcaaggtcaagtattgctgcttggctgtatgagaacttgagccaaggagacccattgtttgacttatctttccgagcatctgtctgaatctgggacccaacaataaaaactccagctgggaaactttcaagcttattctttagaccatggtaggtgtaattatttccacatattttctcaacatccttcagaaataggattacaggcacctgttgactttcttcagaggcaaactcaaacacaacatcaaatgaatgtttggctctatcttcccatcctggaccatcgaggcatagagaatcaactgaacagaataggccatgatcaagctcacaactgcctccaagatcaatgcccccggggatctgtttatcaaatctgactccaacttttgaggatccattttccgcaaaagtaagcctcacttcaccctgtgaaccataatcaggagctctctgtccctcaaacataaaccctgatgattgaataggaccaatgtacctcaccctatcaccttttttgtatggttttgattcctttgactttgaaggctgcccaccagacagcagtgaataatctatgacaagcagcttagcaccaaaggatttggtaagtgccttaaccagtaattcttggtagatctcggaccctggtgggccagataatagtacccttttacaaagagaagatatatcctttgtccacttagtggattccttgcagcatagatttacatacgatgatgacaaaagaacatttttggtattttcactaagataatatggaaaattatcaaatgattctgatatatcacttgcacttatagctgctttctt

SEQ ID NO: 24459 - DNA, 1594 bp, Zea mays
aggaaaaaaagcatcataatcaatcgaatcgttccagttcttcctgaagagcagcactaccaaatgaacaacgattttgttttttttttttgtttgagtgaagctgtttccttgaacaaactttcataagaaacattctatgatctatgatatatccacctccgaactcaaattactccaccgcaccggttcgggccatttcaatgtcagtgaacaatgatggacatcaaagcactccccccagaccaggctattcattgtctttttacatgttatctgatcagctcacgtgcaataacatcagtctgatggccttgcaaattgcaacctcagcaatgtaagtggcatcttgtcgtatttagcaggcatatcccctccttacatgccacaaaacttggaaacgatggggccagtacaaggtcgatgttgatcatctgtatttacctagctccattttcttcttgagtgccttctgtccgtggtatataaacgagtcgatgatacccgagacagtgaacacacctcccactatagcacaaaggtttgtcaggtagtggagtagggatctattttcttctgtgaatatcacctttataggtgagaaatcatagaagaaaaaaactccaggttggggtttcggacgaacatttccatccctaaaatgttccgttaccgagaactggttcgaatgaatattgtgtcctcttatatcagtgtatattgtagggacaacttttatgaaatactggtatgtcccatctgaagctggctgtgtccactgagcaccatcaagtggattgacaacaccaggaaattctgtcccaaaggacagtttgtttattttgtgggtaatattgaaaccaccttcaagtaatgacagctcaggcacatctatgttcgattcataaaaacctttgcctggggcaaagtgaaaatttccagcaactttactgacatctaaaaaaccatggacattgcagccttcatcttgctgagttttaactctctcaacaaaatcctctcttgcgcactggtcaattaggtcaggatttgtcagagcccatcctttcttcttatatgcctcccggacttctccgcaagaattacaacattgttcatccgactcctcagcaccataacacgtaccacaatattgttcacctttgtcgagccttcctccatgtttttgcaatggtctctcgatctttgctccaccaatgcttccttttcttgcttcaataacattaccatgtgcatctaatcgtatcttttcgatgtcatgcctaatgtcctggtgctgttctccactaatatccattgtatcaacgctgaggagggtgcaaggaatgctcagtaaagtaatatcaattctcactagtagcctttctcctcttgatgtgtccacaactaacttagtctctgttggtgaataaaaatatgacctggtctcgcagatgaacagaatcagcatgatggcgccgctgtcgacgttctgtatctctgcggagagcgtccgcttgtagaagtcctcgttcaccttggggtacgcgtccagccgctttagcctccgcagttacgaagaaacatctcaaag

SEQ ID NO: 24460 - DNA, 1067 bp, Zea mays
cataatataggttaccaaacagctaggcttatattaatctaatgaaatcaatcataataagctatcttctaatttgtagtatacctttgcattggcccacccctaatgaattgtaggtagaactaaaaaatcactattacagttaatatatatttactggatagctctgctgaaaataaaacgagaaaagggaatcctccaaggtcattaggaaaaaagcaacataatcaatcgaatcgttccagttcttcctgaagagcagcactaccaaatgaacaaagtatgggtgacaccatgagtgaagctgtttccttgaagaaactttcataagaaacattctatgatctatgatatatccacctccgaactcaaattactccaccgcaccggttcgggccatttcaatgtcagtgaacaatgatggacatcaaagcactccccccagaccaggctattcattggctttttacatgttatctgatcagctcacgtgcaataacatcagtctgatggccttgcaaattgcaacctcagcaatgtaagtggcatcttgtcgtatttagcaggcatatcccctccttacatgccacaaaacttggaaacgatggggccagtacaaggtcgatgttgatcatctgtatttacctagctccattttcttcttgagtgccttctgtccgtggtatataaacgagtcgatgatacccgagacagtgaacacacctcccactatagcacaaaggtttgtcaggtagtggagtagggatctactttcttctgtgaatatcacctttataggtgagaaatcatagaagaaaaaaactccaggttggggtttcggacgaacatttccatccctaaaatgttccgttaccgagaactggttcgaatgaatattgtgtcctcttatatcagtgtatattgtagggacaacctggacagaaaactcggtaagttctttatgcagcgttaaaccatagaactgaaacattcatgtacgaagaaagactgcacttttacgaaatactggtatctcccacctgaagctggctgtgtccactgagcac

SEQ ID NO: 24461 - DNA, 1753 bp, Zea mays
ggccgcttttttttttttttttttgagtgaagctgtttccttgaacaaactttcatgagaaacattctgtgatctgacctatccaccttcaaacatgtcattcaacaacagtcaacaatgataggcatcaaagcacacacccacacacaccgccacccacccctcagaccaggctattccttgtcattttacaagttatctgatcagctaatgtgcaataacatcagtttgatggccttgcagtctccgacttaagtggtactcgtcatgtttagcaggcatataagctccttacatgcctcaaaatttggaaacgacggggccagtacaaggtccaagttgatcatctgtatttgcctaactccattttcttcttgagcgccttctgtccatggtatatgaacgagtcaatgataccagaaacggtgaacacacctcccactatagcacaaaggtttgtcaggtagtggagtagggatctattttcttctgtgaatatcacctttataggtgagaaatcatagaagaaaaatactccaggttgggatttcggacgaacatttccatctctaaaatgttccgttaccgagaactggtttgaatgaataccgcgtcctctaatatcagtgtatattgtagggacaacttttatgaaatactggtatgtcccatctgaagctggctgtgtccactgagcaccatcaagtggattaacaacaccagggaattctgtcccaaaggacagtttgtttattttgtggctaatgttgaaaccaccttcaagtaatgacagctcaggcacatctatgtttgattcataaaatcctttgcctggggcgaagtgaaaatttccagcaactttactgacatctaaaaagccatggacattgcagccttcatcttgctgagttttaactctctcaacaaaatcctctcttgcgcactggtcaattaggtcaggatttgttagagcccaccctttcttcttatatgcttccctgacttcttcgcaagaattacagcattgctcatccgactcttcagcaccataacacgtgccacaatattgttcacctttgtcaagccttcctccatgtttttgcaacggcctctcgacctttgctccgccaatgccttcttttcttgcttcaataacattaccatgtgaatttaatcttcttttctcgatgtcatgcctaatgtcatgatgctgctctccactaatatccgttgtatcaacgctgaggagtgtgcaaggaatgctcggaaaagtaatatcaaaatttactcgtagcctttcccctcttgatgtgtccacgactaacttagtctctgttgacgaataaaaatatgacctggtctcggagatgaagaggagcagcataacgacggcggcgacgagcgtgacgatgcctccggagagcgtccgcttgtagaaatcttcgttcaccttggggtacgcgtccagccgcttgagcctgtgcaggaacgcgtccatctctcctcgtactactcggccgccggcgcccgacggcagtacccacgctggcgattggcgaaccctagcccgcccctctgatccgagctcccgagagcactagcacgcggaaaccgcggcgatgcggcgcgacgtgaggtggggtggcgtataggctttgaccgccgcgattccgcgagacgccggcgggatcggggtccggtcagggtatgcaggcagggaggcggagagtgattagacgaggacgccgtcgtc

SEQ ID NO: 24462 - DNA, 856 bp, Zea mays
tagcgtggtcgcggccgaggtacctcatgtttgctccatgcattttcttctgctttactgtatctgcagtgaagaaaatttgcgggcagcactcaacaaaatgggcgttggtgggcatgcattggaagaggtaatggataaagtgaagaacaggcattaccaggtagcttgcacattaacctttgaggccacacacggtgtctcctgtgattctggaatcaaccatccaaatcaatatttcagcgaaagccagaaagttctgcgagccaaaaaccaaacaatggagagccaatcgcaatcagcaacctaaattgtgtcagcagctggagaaactatacatttccaaaaaacttaccagcaggtaagcactgaagcaaaattcatccttgatgccaattatgttatcgtcactggctgtacctttggcgcttacctggaatattgttgctccctggtgtttccaaatcccagctgctggcttggcctaaaacgaaaacctccaggctccagctgctagctgtcataccctacaagtgatggcaccgcactctacactagaattgttacctagtgctgcgaacagcagcaggtcaaggcgtctgtagactctgtacatgtaattctcgaaagaaccaagacttctgcatttaatgtaggatcagctgtgctgtgctcttagacctcatccaccagtttatctataaatttatccaaaatactgtctttcattgttctatattgtaaaccgcgttgttcgcgtagtagggtttgaaatggggatgataatggataaactgttggagatagtattatgttattgttaaactctttgagtagaagagaattctttggtttt

SEQ ID NO: 24463 - DNA, 1838 bp, Zea mays
atccttcaaacgtcattttttcttcatatatttctgcaacatgttacatgtacagtctggtagaaggcactgctcccccacagtccctctctacacgttgcattggtgaaaacaacagcagcagcagcaaagggctcaaagcccaaccacgtacagctatacataaagaatgggtgtcgaacccggtttgagtctctagctaagacctcacacgcggacatacccctcttctttccctgcaaaatgtggaaaaattgcaggatcttccgttgggactatcttgaggtgaggtggttgtcgtccatgtaactggactcctaacagccagcagcccttaggaaattgtcgtacgggctcgccgccggtagcttcagagactgctgttggaagtcctggcctggctgtgcgttgtcgccgttgggcccgttcatgtactgtgggtatccctgaacgctctcatcagagaatgggtttgtgctctgcgccccggcctgaggcaactgcaggtcttggaaaaggtccagctccgtcgtctggttgggctggctgcctggcacccctgcagcttgcacgctttgctggaagctcatgaaggcagacattttctgctgtttcccgatcgtcagggcttcgcagtggctagtcatatccttgaatccaatgtctgccgacactactccagcctgaggtgctggttctgcaccaaccgtttcaaggagctgatcgatactcagaagatctgatgcaggtacagaagatgtgcgagcttctgcgccttccgaagcttccccaaaagcatcatggtcattccccaggtcaatcagcaaaccctgctcttcatggtgaccagtctcatgaaaccctgaaggattatcaacatgcatttcaaagaactgagtgcttgtaggacacatgtcatcgggagtgaaatcacttagcagttggcttctcacattatgcaactccgcatccatcatatttgcaatgttgttcatgattgtggagactatgcattctcgagattgactttctgacagttctatttctgagagggacttcagtgcattagcgttgtcctctggtgatccatatatttttgaaggatcatttgaacaatccttgacagctgtaagtttgctctcatccaccaaacgaaggaatggatcggccgcgcgatcattgatcatttgtttacagattggaatgagtggcaacacattgtaagctcttgacgagaaaataatcatggctgtcgacagagtaaacaatgaccggcgccgagacggttgtaatgaatctgcttcagtgagcgcatagctcctcaaagaaaatgcaacctgaaaactctgggtaagagcctcaaaagttgatgccttggatccagagaacagcagaagcaaactgtaagtatgagcaatggcttcatagttcacaggagtattttcaggggatgttgattgagcccaaatggatgacagcaaaagtgtgatctgacgtgcgctcagcttcaccaacacagattccgtttcctcatctgacttgtttgaggaactttggtcttcctttacagacatagaaggtgctctcaaagacattgaaggacctctcagagatattgagggcgctctgatcgctactgaaggagctctcatggccattgaaggacctcttttcatggaaaaattcggagctttcatgctacggcggctttgagacacctgaaggttttgactctttgattgtccggtcccttcaccaacgctatgcatactattgtccttcctttctccttgtgaattttctgagttcttgtcctttttcatcttgtcaaagatagc

SEQ ID NO: 24464 - DNA, 3799 bp, Zea mays
ttatatttaaaactgaccgtctttttcccccactcgtgcaacatccttctatgacagtgggaccatggatccaggtctgccatatacacctgactttttaggcacgtagatgtagcattcagtatatagttttttttttttgcattatacacatgaatctagcgtgtgtgcaattgtaaaagacaacaaaagttgtatgcctggccatgatttgggggaggcggtatgtgtcctgttggtagcatgatatttgaactcatgatcagccaacatgtacttgttggaacagagagaccaatggctgatctgctccaactcaggcctacttttatctaaggtgccgtacacccgtgggaatcatggataaactaagcggaaatgatggggctctgttggtaaccctggtcgtaatctcttggttccaggattatgacgctaattgttaactatgtgtggttcagacggactggtcgcttctgctaaggccgccgtcctgccgtctgagcagacgatcattgaaaatggatgccacgtgattggcacaaaggttctgctgtcctcttcctcaaggtaattcattcttgccactgtttcgttccgcgctaaatttgatcgagtaccatatgtatggaaaaaaaaaattctaaaagaactggcacctcgttaaagaaagaatcgctgcttcttctaaaactcatgactgtaccatatatatactgttccacagaacaaaggtctgccataatgtacgatgtatagtggcagcaaagtagatgtatacatacatacatacatgtgccggtccggtctcggccaagaggggcgagctcatttgttccgatcttgatccggtccagttctgacgaaagaaaaggaaggatgagagaagaaattaggcgcggcccttggctttcgttttgccatgacaggagcacgctctttgattcttgagtagcaagcacatggaaagaagagtgaatcccttgggagtagggagtgaccaccaccatccagattccggggcggcgctctctctcacactcagtcaggactcaaaaggcacgcggaacaacaagagtcctccaaaatccgtgtggcgactgtgtgagtgtgactggcagccgtagctgcattccattccattgcattccattccaagtagcttagcctcctcctggaaacagtataacagagttgtttatacattgagctataacaaagttgcttttttacgttgagctgctaagaacagagcagcgctagtacaagtagaaggaaagcatctcgagttctccaatccaactcacacactctgctcgccgtacagggatagcgatgcaagatccagcaggctggccggagagggagagaccagtctctcctcgagcccaagtacgaaagcgtatcaaaagaagaaaggaacaaggtgggggaaaaaaactaggggggccgtatcatatatctggtgccgaaaaacgcccttggaacggagaaaagcaaggtcgcggtgaagtgtgagcagcctctcctctagtggttctgctgggacgacaccaccagcactgcagtaccactactagttagtaagtacgctgctgcacacaacaatattcttttttctctccataatactacaaatactgcagtatcaatgtggctgtccctcctcttttccgctgatggagttgagatgttctgcactacttttccaccccgaatccggatggcacccgtaccgtagtgcttgtatgccttctttccctttcttctacttgtacctacatgctactacaggtgtactacgtattttgctccccccacttggttttgcaagcaagaccagcgtaaaagcagaggagactgtcagattcctctttcgctttattctcccgcccagcctcacacacacgtagttagtgttgggctactcacacatgacacaacttcgcctccctccaaatacccagagttttgaagcagggaggaaggaagacagagcagaagcagagcgctctccgtctccggtccagtatctccgctcgccctcctccctcctcctcctccttcgcttcaggttcaggagccagttagaacattggtgttagcgcgcgctctttcctccaagcagaatcaagattttgttcccatcctcaagtacttactcctcctctcccccactctccagccgtcctctctccttctccatcaaatcacaggctttgtttatagggaaaaaaaaacaaacaaacaaacagttgtctctgcgcccgcccgcccgccttggcttcttctacctacatcagctgtccatttcgcagcacgcagcagcagtctctacgctacggctgcatgagtgttagctagcagcaaggatgagagatggcagcaacaccaccaagaagagcaaggtatcttccgactcctccctcccctccaccttcactcagctctgctgcatttctaaaagttaaattactagtacgtccctctccatgctcctccatttttgcgccgttccttgatgtttttgcctgctgcggtgccggtgcggcttgtagctgtcgtggtccaagagcttggtgaggaagtggttcaacatcaggagcaaggcccacgacttccacgccgacgatgtggccgcgattggtaggacaggtacgcgtttctgtgagctagctctcgccctgtgcgcgtttgtatcgtacgtattcgtaggcctggttgcccccccccccccaatccaaactcacagcacgctagctcttcagaacttgcggacgaaagactgaccgtgcaccgctagcagatcgatcgaccatggcgtcgtcctctcttctcctcctcgccgccgtcgccctcttcgccgcctccgcagacgcggccaccttcaacgtcatcaaccgctgcaagaacacgctgtggccggccgccctccccggcggcggcgcgcgcctggaccctggcaagacgtggaccgtgcaggtgccggcgggcacggcgcacgcgcgggtgtgggcgcgcacggggtgcagcttcgacggcagcggccgcgggacgtgccagacgggggactgcggcggcgcgctggcgtgcaccgtgtccgggagaacccccgcgacgctggccgagtacacgctcaacaggaacggcccggactacatcgacatctccctcgtggatggcttcaacgtgcccatgtccttccagtgccgcggcaggggccccagctgcaaggccgacatcaacgcccagtgccccgccgcgctcaaggtgcccggcggctgcgccagcgcctgcgagaagctcggcggcgacacctactgctgccggggccagtacaaggacaagtgcccgcccacggactactccaggttcttcaagaggctgtgcccggacgcctacagctacgccaaggacgaccagaccagcaccttcacctgcccacagggctccaactacgatatcgtgctctgcccgtgagccacatgttcgagagatcaacgaccatgcatttgcagctcgcaacaagtgcacactagtacaactatacacaagaaataagagtcgcgatatttattattatcgcgcgtggagtagttggtaaataaatcgcttattgcgagtattttggcccatgaataaggccttacttactggccatcatttccgacatatatacgtttgttcatgaataaagaaactttgcaaaacagcacaatatataatttagcacaatatataattttggagcaaaaaaaaaaaaaaaatcataaaagaagagcggaagaaatttgatgat

SEQ ID NO: 24465 - DNA, 1690 bp, Zea mays
cccgtttccttcatctgtaacatataagacataatgttttagaggttttttttcagtgagtttttacctctgcaatattcgtctaatatagctatcgttttatcttagccatctatcatcccgtttttgtttttttttttttttttttttcgcgtactattgtcaatccttaacacgatgtatgtgtttattctcaagattagcaagaacaacaacaaacacagcttcactagaaaaatgtctaacatggtacagaaacagatgccggctatagttgaaatcagaatacatggttcatggcaacggaacaggcgtcctccagctgtggaactcaatcagatctctattcacaattgttctgttgtgcagccagaacgtttccggcgattgatggaaccgccgcactttcttctgcagctccgtcaggataccgctcatggcagagcacggctcagtatcagctgcatacacccacaagcatctcatctcacgcccatgaccaatcatttcctcgatcctttcatctgatattgattcaaggtactcaaggagttcaggtccaatcctggacgacggccactttatcgagatttcactgtagtcgatcacattctggaaaggaagctcaacttcatctgacaaaatcactggcacacattccacaaagaaggactcgtagaaccgaagtgtccaagatgactctccacgtggagccaagcagaactttgcatttctcaggtgcttgaagtactcgatccttcccaatttgttggggccagataacttgagttctggagattccagcttgtcaggatactgctttgcaagctccaccagttgaaggcgtcctgctttcccctgggcacgtccaaggaagttggctaagtacttcctttttgttagcgggattggttggacagcaggagcatcagacttcaccatagaatcatccacgttcccaggtataataatatctttccatgtattaaatgcactcgtaccacgtttgtcagtccggtcaccctctggagtaaggataatagatcgattcagaaatattgcccatgaacgaaacagatgagcgcctgcaccacttgggaagacaaaaatgtggtcgcgcccacctgatctacggaaatatggcatctgactcagaaccttgacataggtctgattgatttctttgtcacttagtgcccctgtcatgcgaacacacttgacatagctcggaacaaagaagagatttgcgtgatccttgttaaatgttctgaaccttgactttagaagaaattggtggaccttgacctgggtgccccattggcccttgaggcatgtggcggcgttgatggtgccgtcgcgtccccggagcagggcgcggaggccctggatctcgtcctcagcgtagacgtagatgcggaggtcagcggaagagaagggccggccggggtttatgggggcggaggaatatgtgtcgaggaggaagcggtcgaagaggcgggtgaggaggaaggtggcagagacgaggaccagagcgcccacctggtgagcgcggctgcaggcttggtggtgccgcatgctcgcatagctcgccggagccaaagatgggataaaaagtgaggggatctggttccgaatttccgatcgttcatgagcccggcgcgccgacgatcagcagcagccagcaggttag

SEQ ID NO: 24466 - DNA, 3873 bp, Zea mays
  misc_feature (1137)..(1137): n is a, c, g, or t
tgttggtgtcattttaggtcagatactaacaaaccctagagtgaagcgacatgtaaaacctagaggttagctttgcgagatgtcggatggtccacaatatgtcatcagactgtctgtattaaggcaccgaacgatccgtgggttttcactgaacctagagcagataactacactcttctgtgcaggtacactaatcgtccgtgtgtaggcgacgaaccgttcgtgatggcatagtggggtttgtctagaagcttgctatcgcctctcaagacgggccccgtcggagagaagagataataaggttgcatcgagatcggtagaccacccaaagcgtgtctagacgatgtagagccgaaaagaggtggagattgagattgagaaactataactagagctacgctacatcttgacctaaggcatgaagataaataatataaatagattggttcgattggattgtgtgttcttaatcggtcgtacgtcttcatatatacaggggtgatctggagcagttcttaggcagatcccaacagttttctcgtgggttattagaataaccacgtaagtgataagggctctagtctaaattaatctaatcgcgtaccatcccagatacacttgcggatctcccggtacataaagccggaccgtccgagcgtgttaaatttggtgttcaacactctgcaattgtgtttgtgaagaacaagatgggaaataggatggggaccgatacttattattatttagttactatttcttatttcttttttgtctcaccgatgataatatcattagacgttatcaagcgagacgaaagattgtaaattaaaagtcaaattataattttcttcacccgctcgtcgccggcacaatcctgatcagcgaggtacgtgtcgccgaccagaacggaccttaagcgccccctacgacgctcagctgtcttgcagaagcaacctcgaatcacatcctttttttatcgtggaatccctttttatcagctaatcctttcattgattcttaatacttttctgaaaaaagaaacattcgctttcaacttttgtttgtcagaatacgcgaggggtcatggcctagcgagaaagagagaaggaataatcatagcatggttgcgtggctgtnggggccttgtcggccgtacaatgttcgtgccaactgccaacgtaaaccttacgcgtcccgtgctcagggaaacactcattctcggtctcggataagctaagcgaaagcgaagctcagactctggagttgcgtcgtttgtctgttgtgccaagcagagagccttagctttgtcgcttggtttgggacgctccatcgccaggttcagcttcttcagcagcgtacgatataaaatgaccaattgtgtgtcggcaaacgccggatttgtccggtacctcgtctcagcaccggagcgtattgacattgtctctgtagaaactagaaagagagatgaatggaatggtgcctatgcgctccaccttttcaacgatgatgatggttcacagtcagatgataaaaatcagcacactttgcctgcccaaacttggatctcgcagatggaagacttgagatccatcttccctcggaggggcatcagggcatgttaacttgttgacatcattgcacgctcaagagcatgaaagaaagactaagaagcatctcagcatgtatgcatgctgattagctaagaatacgcttggagaagtccatgacaggggtgaatacatgagagcaaaagaaaactgtaattaccatacagcttagcagctacaatctaatgtcaatgttctcttctctggtctgcacttcaggaaaactaagggtacagcatcatgtacatgtacaacaaagggcgtccttttttgcggaaagcagaccaggtaattcattatgcatacatacatatatatatgtaagagttgacgtgtacttccggtcttctgaaaacgttactgtcagtgccaagcagaagcagatatcaacttcctgttcttccagccgagcagcatcgcgccatccttctcttccagggtgtacttgtccgagtagcaggcaaggagcttcctgatcaccgagttcacgtacgagctcagcgggtatggtctgaacccggccatggtcagcctcgaccgccatttgcccaggagctcgtgacgctccacccggtccttcccctcgcaggcgatgatgttcacgatgtccttggcaagacagtgctgctccacgttgatccgctccttgttgtcccgtggcaggttcgtgtcgattgactcgaacatggccgaatagtagtccaaggtctcggtgaaccgcatcaagaacggggtcgtgttggtgtgcgactcctgctccacaagcgtggtcaccttcggagacaggcctttcaccatccggagtagcccgtcccgtgggttgttcacgtccacgctctcatccggggtgtggtgcagctgcagagtgaagttgacagcaagtgcttcgcctgacctaatgtccagcatttcttttgtaacttgagttgcataaataccgggcagaggggtaaactccaaaggtatcctgaattcctcagacatgcttttcaacatcttccctacaaggtccagaccttcaccacgggcatactctgacactgggtcatctattccagtgatccgcacgtgtggtggacccccgggccttgcagctagcgcttgtatcagtgttatccactgtgtcccttgggcaatctggaaatcaataatatggatcctgtcctcatttcttaatgcctctgcaattgccccattggcagccatatagccaaacttcaagtacggacagatgttatacaaaatcttcatgtaagacaagagttcattactctctggctcacggcacttcagggcacgatatatgtttgtacctgagtttgcatgtctagcaaccaaaccctcaaggaggtaagcacctaaccgctggattggctccccagtaattgatacaactccacgagcttgctgaacaaggttaaggaactcctctatcctctcctcacttaatgcttcagcacacttggttaatagctgcttcaccatgctctgcggatcctcccttaactcccttagccgtttctctgggcggaactcatagcttgctgtggggtatccagatgcaagttgtgtccgtacaactcctggtgatggctgcctagattcatgactccatgtccttgaccgctgcctcatcagctgagcaggtttatgttcctcaaattcatgcttggtgctagtggctgcatcatcagcatcaggtgccatcagaacagtctctatttctcgtaaagcgtgttgcatattatgccttgatgttgtgtacaatggatcaggtctcacttgggtgttctcccgaaggatagctgcctgtttgtatgagctgtctacttccagtggtgatattggttgtgctgaaatggtttctgtggagctctggttatctggagtattgctgagtgcagacaaattatcacactcaagctgggatgaaagaggagtgtatgatgagctgctgaactcagacttcagtggactagctggccaaggagtgtttgctaagttgttctctgtaggaaattcgtagtagacgttagcaccagttaatctgtactttaacaactggtgcaagtccataataaatgaataggcattagttgatcatgacctcctctgatccagcgaggagcaaggaacaagcacagccgatccaactccaccaccaccacggacgtcccaccggccaccacctctctctctctctctctcgcttgtgtctacccccccctcctggtcctggcccccgatagtagtcgtattaggatgg

SEQ ID NO: 24467 - DNA, 910 bp, Zea mays
aggttaaggaactcctctatccttctcctcgcttaatgcttcagcacacttggttaatagctgcttcaccatgctctgcggatcctcccttaactcccttagccgtttctctgggcggaactcatagcttgctgtggggtatccagatgcaagttgtgtccgtacaactcctggtgatggctgcctagattcatgactccatgtccttgaccgctgcctcatcagctgagcaggtttatgttcctcaaattcatgcttggtgctagtggctgcatcatcagcatcaggtgccatcagaacagtctctatttctcgtaaagcgtgttgcatattatgccttgatgttgtgtacaatggatcaggtctcacttgggtgttctcccgaaggatagctgcctgtttgtatgagctgtctacttccagtggtgatattggttgtgctgaaatggtttctgtggagctctggttatctggagtattgctgagtgcagacaaattatcacactcaagctgggatgaaagaggagtgtatgatgagctgctgaactcagacttcagtggactagctggccaaggagtgtttgctaagttgttctctgtaggaaattcgtagtagacgttagcaccagttaatctgtactttaacaactggtgcaagtccataataaatgaataggcattagttgatcatgacctcctctgatccagcgaggagcaaggaacaagcacagccgatccaactccaccaccaccacggacgtcccaccggccaccacctctctctctctctctagcgtttgtgtcctaatccttctcttgcttgtgcccctctttgctgcgaataataattatatttctgccgccgccttcacgcatatatccggcccggccggcctcgaggtacccaatg

SEQ ID NO: 24468 - DNA, 1122 bp, Zea mays
gccgccctttttttttttttttttttgagcagaaactgtctacgtaatattgaccaacaagactggcaacagacatgtagcacaacccaacaactgagcatcgatatcacaaatttgttccctaacaatttgtttgcggaacaaatgatcatcaatatattaccaaacaaactgcagatcaggtgatgcgagattaaccacaggtccacagccagtgacagcataattcttcctacagagggttcacaaaacactacttcattcccttgcccttccttttaccctttgcagcaccccgcttcttgtcaccccttttcgctctagccttgctcttgaacgttctcttcggtggcttcctcttcacacctaaactgctgttcttcttggcaaaagagctaggattcttgctggtgaggctcgtcgccacggggccgacagttttcgggacaatgtcatcttcttcaggagtaatttcactggtggtgactacagttctggtcccatcatcttcgtaggttttgatttcagacaaaggtttgtcattttccatatcctcaccatcatcgccgatatcttcgttttctaatccagcaccatcatttttatccgatgtcagtactctaccatacagagcaatctccttctcttctttcctcctcttgcggtcttgtattttcttcttcctctccttctcctgcaaaatcttctgcgcctcctttcttctctttttcttccgcttgtggaacccagtcacgaaatccctgagcgctttcttgtcgagggtaacagacagcgccttgttcttcagggaccgcttattgatatgctttggcaccataaccgtcggcatctgccccaccacgacgtcctcctccgactccgaagccgacatctcctccccgtaatcctcctcttctaccgcctcctcctcccatgccatgcctacggagatcaagcgctctctctccctctctctctgaaggcaggacgcgccgccgctatgcaggttgaacaggaaggacaactaggtctaggtttgggaggtcacgtggagccgtggaggctgcgcggctggtggctcccgtgtttgaatatatagacttttgcattggataatgtatc

SEQ ID NO: 24469 - DNA, 2619 bp, Zea mays
  misc_feature (2020)..(2020): n is a, c, g, or t
  misc_feature (2591)..(2591): n is a, c, g, or t
caccaaagtcatgatatgattagttagcttgcagatccaagatagcattccacatgcatacaattgcttgtctgctaacaaactccaactacttcactagttgaaacctaaactcaaccggtccatgaaccatgtctcatcagcacatggttccaccacgattgccttcatggatcaatagtccgcgtatcgactgaattggaataaataaatgagagatcagatggacctgaatgccgaatgaagcatctacagcattttatcgtcttttataaccttaaaagtttatctcaagtgcccaatgtctgtctcgacacaattcagatgcaacctgctaggtgataacttcaatatttcatccttcagtcaccagaaaaacttacgtcacacagcgatggagaacagttatgaaggtttctagtgccaaaccttgcagcatgcatctttctgttgtgcttgagagggcttctccttgatacagatggcatccttgaatgcatcaaccagttggccaaccaagcttgcaggatcaccgatgagaacatctacaaaggcgctcacgattcgcctgtcctgtgctgttgccttaaggctgaaccaagtgaggaactttacacggaagtcattgtccatgtgcccttcatgctccagccacctgaccaccctcacgcagtactcgtactgctgctccacatagttcttggaggccgaatctggggtgccaataagcaagtcaggtttacttggagcttcggaaggagaagagttggagcttgcaaatggtaaaacttcagaagttggcggcaactggctttcatcgttgtcgcttgcaccatctagccttgcaaccttagcccgcttggaataccgatcacatgataaattgttctcacttgaatttgtagaacccttaggtgaatcatattgaatggttctctggtgattctgcacattcaaatcctttttgtgatgctgcattgaatcgtctttgaggcacatgctctcagagttctgagttgagcactggctgctgccatggtccaggctgcgtgtgctgcattttgtctcccactcagtaaacccatgtgtgctgctaaaaggcaaaaccttgaagaagtattcagttgaagggctcagaccagaaaccaggctcctagtgtttggcctcagtatgtggcatgtgggctctgatgaatagttgcaaaccctggcacttcggtgccaaacttttggaaccatcaatctgctccttaccgatgtcatgctgatagttcaacacaataaccacagaaaatggagtgatctcatgaaaaaggatttggggctgaggacctgaaaagataaatgtcatctcttcagacacaatgtaacctgtatgttttgtaaggaagtcttttctatactgatgtattttcactttctgggtaatgaatataactatttcatattcttcaaggaagatttctaagcacgcaaaaaatgcagtttaaacatgtcaactataagacaaaattacctaggagttttggactattattggactcgaactccaagatgttatccactttagagtctacaatttctaatgtacttgaacaaagcttctgaacttcagcaccacaagtaagccggttcacgatgccacgccccgtgatcacagagacctgatccaatgcactaccaacttctatttcaagtgttttcacagctgagctgattatgctcgctatttccttgtaacgttcagacccttgtattattttatggctcaatgacaaccgctcacaaagcacatcaactcttcttgcctccctagcaattgcaagttgtttctgcaaacacctgcagtagctaacaggtaaatatatatatgtgaagtttcaatacgcacaagaagcatatctgaccataatatttatagcatttaaaaaatctcaagttccttttccctgtactaaaatttgttggtgcttggtaaaggaacaaaaaagcatactttttttgttatgataacaactancaaaagacaaaagtatcgctccgataatacagatcgtggtactagttctagatggtcagacctaaataagaattatgctaacaaacagaggtgataattttcccagtggcatgttaattaatgaactaaaacagtcagaaggatacctcattagccagttgattttcccacaactaacacagtagaaactacagtctaacttgttgcacccattcttgacaatgccagcccttttattctttagagcacagtttaggtgacaagagacaccacatgaacaaccactgtatggattatcagagctgcaaaccaaccacaaactagggtctttgttatcatcgtatttattgcaaatgcagcaagagcaacgtttgcaatatttatctcctgcatttggtgtggcttggcatgcaacattgctgcacaccactgaactaccggcacaagcctctctgcttattgatgagtcagagtttgcagttttgagtggtcgtgattgttcatcagattccttcatttgtatttcatctttgttatcctgccctaataacataacactcggattatcatnctgagttgtccatctttccatattccgc

SEQ ID NO: 24470 - DNA, 3101 bp, Zea mays
  misc_feature (2796)..(3046): n is a, c, g, or t
  misc_feature (3048)..(3070): n is a, c, g, or t
  misc_feature (3072)..(3091): n is a, c, g, or t
  misc_feature (3093)..(3101): n is a, c, g, or t
taaattggggaaacgcccgggtttttcccatcccggccgtgttaaaacggcggcccgggaattttgttaccccccccccttttgggggaatatgggttccccggccccccctcgaggtttttttttttttttttttcttttttttttttttaaataattttttctactaataataataaacatctcttaagtcatgatatgaattcacaatagttagcttgcagatccaccatagcattccacatatgaatacagttgcttgtctgctaacaagcttcaactacttactagtcgaaacctaaactcagaaccgattcatgattaccagcacatggttccaccatgattgtcttcatggattaatagtctgcctaccgactgaatttgaatgaacaaatgagagatctgatggacctgaatgccaaatgaagcatctacagcatcttataacctttaagagagtgcacaatatccatctcaacagaatccgcacgcaatctgctaggtgatataacttcagtagttcatcattcagtcgccagaaaattaccagaaaaatgatgtcacacagcgacacagagcagttatgaaggtttctagtgccaaatcttgcagcgtgcatccttctgttgtgtttgaaagggcttctccttggtgtagatgatatccttgaatgcatcaaccagttgggcaaccaagcttgcaggatcaccgataagaacatctactaaggcgccaacgattcgcctgtcctgcgctgttgccttcagactgaaccaagtgaggaacttcacacggaagtcattgtccatgtgcccttcatgctccaaccatctgaccaccttcacacagtactcgtactgctgctccacatagttcttggatgccgaatctggggtgccaataagcaagtcaggtttacttggagcttcggaaggagagtagttggagcttgcaaacggtaaaacttcagaagttggcggcaactggctttcgtcgttgtcacttgcaccatctagccttgcaaccttagcccgcttggaataccggtcacacaataaattgttctcacttgaatttgtagaccccttaggtgaatcatattgaatggttctctgatgattctgcacattcaaatcctttttctgatgcttcattggatcctctttgaggcacatgctctcagagttctgagttgagcactggctgctgccatggtccaggctgcgtgtactgcattttgcctcccactcagtaaacccctgtacgctgctaaaaggcaaaaccttgaagaagtattcagttgaagggctcagaccagaaaccaggctcctagtatttggcctcagtatgtggcatgtgggctccgatgaatagttgcaaaccttggcacttcggtgccaaactttggaaccatcaacctgctccttaccgatgctatcctgatagttcaacacaattaccacagaaaatggagtgatctcatcaaaaaggatttggggctggggacctaagagttttggactattatttgactcgaactccaagatgctatccactgtagagtctacaatttctaatgcacttgaacaaagcttctgaacttcagcaccacaagtaagccggttaacaatgccacgcccggtgatcgcagaaacctgatctaatgcaccaccaacttctttttcaagtgttttcgcagctgagctgattatgctcgttatttccttataacgttcagatccttttaccattttatggctcaatgacagcctctcacaaagcacatcaactcttcttgcctccctagcaattgcaagttgtttctgcaaactcctcattagccagttgattttcccacagctaacacagtagaaactacagtctaacttgttgcagccattattgacaatgccagcctttttattctttagagcacagtttaggtgacaagagacaccacatgaacaaccactgtatggattatcagagctgcaaaccaaccacaagctagggtctttgttatcatcatatttattgcaaatgcagcaagagcaacgtttgcaataattatctcctgcattccgtgtggcttggcatgcaacattgctgcacaccactgaacaacaggcatgagcctctctacgtattgatgagtcagagtttgcagttttgagtggtcgtgattgttcttgttcctcagattccttcatttgtgtttcatctttgttatcctgctctaataacataacatttgcattatcatccttgagttgcccattctttccactctttcgtgaaactaatttcaagagataagcgatcatcttagcttttgggacattggtatacttcctctctttgcccagctcaacacagataagctcaagaagttcccttcgagtccagcacttaagaatctccacggcaccttgcggccatcttgcaacttcgtatactagttgtctcttgtccatcaagctcatttcattttgtttttctggatccatcacaattccagtcaagcagaagccgcacggttgaacaatgctgccactcgtcacttcagctagagttggtttaccggatctcctccgcgtgacgccattccgggggcgcacaatggcagtggggcgggcgggaaatggaggcggcggtgcaggtgggagaaggaagggcaggcggcggtgatggtcccctcgggagtctggagatggtgccgtggcccgtggtggtggtgcactggtgtgcgaggcttttgagaccgagacggggacgaggggacgggcggacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnncnnnnnnnnnnnnnnnnnnnncnnnnnnnnn

SEQ ID NO: 24471 - DNA, 637 bp, Zea mays
ccggccgggaaaaaaaaaaatcgctggcgaccggacctgagcgctctcgttctctctactcctccgttctctctcacgcgagcagtgcatccttgagccaccgccgccgtgaggagctccgcccgtccgccgtcatccgtcaaatcaggtggccatttggtacaggcgtcggactcccaggaggatgaccggtggcaagaggttcggcggcgggcgggtgccgacggggaccccgtccctcgcgtggtcgtccgtcgtcatcgtcgcctccctcctcgttggcgcctccatcgtccacaacatctacaagcctgacatgaccattccacctgtggagggtgccgccggcggcggcggccaagaaagctgagctacgaatggctggacactgcatgcaagagaggaggctgggcatgggagtagtgagggaccggccatcagcaccttttttctttgttctagaacaaaaacgatattatgttgttcttttctgttttgctaccaaaagatgtgaggctgcatagtatttgcttccttaggcgctactggtcacgcgtaaccatggtatatgtacgttgattttgttttttctaatggctaataatcactacactcaaaaaaaaaaaaatttgcggcc

SEQ ID NO: 24472 - DNA, 993 bp, Zea mays
caaatcgaccggacctgagcgctctcgttctctctactcctccgttctctctcacgcgagcagtgcatccttgagccaccgccgccgtgaggagctccgcccgtccgccgtcatccgtcaaatcagggagcttcacagtgatggatctgaagagaagtgggaaatggcagaaaagacccggcagctaggtattgtgcacgtctctgtgtccgtccgtcgccggatctggtcgtagtggagacgtagtgtctgatcaggcagcaacagcagcgacgcgtcgatagatactagttgacgatagggttgctgtggcaggggcagctgcgtgttggacgacgacgcggtgcccatgccgttggcaagcgtcgcggccgtggcggcaccgcccaaggcgttggcggccaccacagacacggttggccttgtaggaaaacactaataattcttgtttattagtgttgtcttgtctcttggtttaataccatccaaagaagtactgtcctgtcaggaaaacactaataattcttgtttggacgaatcttcactccacttggatggtcaccatgctcagttgtgataacaagacaaatccaagctggttaccaacgcccgattgcacaaaagccattttattcgaatatatccaaatgcaatctgtaaaaagattactgcgaatcagtttaatcccagcaagaatctgggaattttctgttgttgctttgtgctcgcacgagcagcagagctagcactggcattcatggcactgttgtgaatgtgaattctacgcacgagcaacaagaatcatgttttgtttcttaaacttttaattcttcaattgttgtctcatgttactctctgcttggcggaattctatgcaacaagaaaccggtaactgtgctactatactctttccataacaatggcagtgagcatccttccgattttgtaaactattttattgatcaattgaacttggtacgtcatcgtgatatg

SEQ ID NO: 24473 - DNA, 1618 bp, Zea mays
atgacgatagtttaatttattcatattactataatatgcaggtcctgaataccagcgcatctaattaagaatttctaaatgtgagtcactgcaagcaacctctctgacgccttccttgcctcttgttttgcacaaagtgttgtttcgtatcgattttcacattaacatgattattgtttccaattcccaactatgattttgttcttggatcaagaatgaacaatagcccttttggtgctagataaaggaccaacctcccatcatctagcaccaacaactttttgcccttttccttttggtcctgttattttcttttgcataggatgggatggaaggcacaaagcttgtttgcgtatcgtcttcccttgtcttgagttctagagaggtccaattgagttttagtagttgaacctcaaggaaggcacatcttctttgtgcgcttattgtattggttgtcagcatctttgacaagtcacatattggctcttcaaaatctgattttggttctatttctaacaaagcagtgggagacatggcacaactaggttgctccctctttagtttttaacatgtttggcttccgagcaaactttctccagaccccaagaaaatataagatccgatcagatatgtgtcgatgctcatctcagcgtactcccgttgcaacgggcacacacccagtacagctgatatccggaacgagcccgctcggccaaatcgaccggacctgagcgctctcgttctctctactcctccgttctctctcacgcgagcagtgcatccttgagccaccgccgccgtgaggagctccgcccgtccgccgtcatccgtcaaatcaggtgaatctgccaccacctcttctccttccaggccccctcttctcttcccccaccggcccctttcctcctccactatttgtgcttctgccatcgccaccttcctccacgccgtcagcagatctgctctgtcttctcctcccttcaccagatctgctgggtgcagggagcttcacagtgatggatctgaagagaagtgggaaatggcagaaaagacccggcagctaggtattgtgcacgtctctgtgtccgtccgtcgccggatctggtcgtagtggagacgtagtgtctgatcaggcagcaacagcagcgacgcgtcgatagatactagttgacgatagggttgctgtggcaggggcagctgcgtgttggacgacgacgcggtgcccatgccgttggcaagcgtcgcggccgtggcggcaccgcccaaggcgttggcggccaccacagacacggttggccttgtaggaaaacactaataattcttgtttattagtgttgtcttgtctcttggtttaataccatccaaagaagtactgtcctgtcaggaaaacactaataattcttgtttggacgaatcttcactccacttggatggtcaccatgctcagttgtgataacaagacaaatccaagctggttaccaacgcccgattgcacaaaagccattttattcgaatatatccaaatgcaatctgtaaaaagattactgcgaatcagtttaatcccagcaagaatctgggaattttctgttgttgctttgtgctcgcacgagcagcagag

SEQ ID NO: 24474 - DNA, 966 bp, Zea mays
agagggaatagagtggttctgttcctattttctagtgtttggttatacagtaagaaagagcggagcggctctgggagtggctctattccattatacagctgatatccggaatgagcccgctcggccaaatggaccggacctgagcgctctcgttctctctcacgcgagcagtgcatccttgagccaccgccgccgtgaggagctccgcccgtccgccgtcatccgtcaaatcaggtgaatctgccaccacctcttctccttccaggccccctcttctcttcccccaccggcccctttcctcctccactatttgtgcttctgccaccgccaccttcctccacgccgtcagcagatctgctctgtcttctcctcccttcaccagatctgctgggtgcagggagcttcacagtgatggatctgaagagaagtgggaaatggcagaaaagacccggcagctaggtatcgtgcacgtctctgtgtccgtccgtcgccggatctggtcgtagtggagacgtagtgtctgatcaggcagcaacagcagcgacgcgtcgatagatactagttgacgatagggttgttgtggcaggggcagctgcgtgttggacgacaacgcggtgcccatgccgttggcaagcgtcgcggccgtggcggcaccgcccaaggcgttggcggccaccacagacacggttggccttgtaggaaaacactaataaattcttgtttattagtgttgtcttgtctcttggtttaataccatccaaagaagtactgtcctgtcaggaaaacactaataattcttgtttggacgaatcttcactccacttggatggtcaccatgctcagttgtgataacaagacaaatccaagctggttaccaacgcccgattgcacaaaatccattttattcgaatatatccaaatgcaatctgtaaaaagattactgcgaatcagtttaatcccagcaag

SEQ ID NO: 24475 - DNA, 746 bp, Zea mays
  misc_feature (693)..(693): n is a, c, g, or t
  misc_feature (706)..(706): n is a, c, g, or t
attccattatacagctgatatccggaatgagcccgctcggccaaatggaccggacctgagcgctctcgttctctctcacgcgagcagtgcatccttgagccaccgccgccgtgaggagctccgcccgtccgccgtcatccgtcaaatcaggtggccatttggtacaggcgtcggactcccaggaggatgaccggtggcaagaggttcggcggcgggcgggtgccgacggggaccccgtccctcgcgtggtcgtccgtcgtcatcgtcgcctccctcctcgctggcgcctccatcgtccacaacatctacaagcctgacatgaccattccacctgtggagggtgccgccggcggcggcggccaagaaagctgagctacgaatggctggacactgcatgcaagagaggaggctgggcatgggagtagtgagggaccggccatcagcaccttttttctttgttctagaacaaaaacgatattatgttgttcttttctgttttgctaccaaaagatgtgaggctgcatagtatttgcttccttaggcgctactggtcacgcgtaaccatggggtatatgtcacaaccatgtcagcaacataaagtatatgttacgttgattttgtttttttttttctaatggctaactaggcgcgtgcccgtgcgttgcaacggacaatatataatacccatgacanacttatgtacaanatgtgtgttttaatgttacgagaaaatgttttgtaatccg

SEQ ID NO: 24476 - DNA, 1647 bp, Zea mays
  misc_feature (561)..(561): n is a, c, g, or t
tatatatatatatatatatatataaagataccgtaagatacaccatatgaaatgcatgaacaaattatttaacattacagcatggcgtgaaagggcataccataccatatgaaatgcatgaatgaataatttaacaacattacagcattgacagaataggtaggtcctatcagaaagtctatgattatggcgggggaaaagtagattttatcggaaagtctatggagaggcatgcgccagggtgttgctgcatccaagccacacgatccctatctgttccacggccacaggtgagcaaaagcggaaacactgaccacgagttcgtacttgaaagttgggtaaaatgatcattctgagtctcaactaataaaaagagccgaaaattagtatatgcaggtaagcatgtgattttttgttaagtttctacatccatgaatttgattttttttcccagcccaaggaccagtgccaagcagaacatgtccttcccacaagactacttgatgagtagctaccagtccgaatccaaatagaaacaaaggtagaaaaacgagacaacantaggcataagcaagtgagaaccattaacagagtttaggttattgcatctctaatattatatttaaaagtaatttttttctgacaactttaagaggttttgcccttggatcagcatgtcatcatgttcattttaaataagagaagcaacagagttccaaaaattgtatttccaacatctatgtacgatgaacgccgtctcagtcaaccaagtcatgggttcaaaatagcctctcctgcctcagtttactccactacaccccacaaaggtggaagactggcagtgggtctacctttatatgttacaaaagggaactaccaaaaccataggtacagcatgtacattatatttgaaccagataaagtctacatcagttgataaggttcctatggagaaaagaggatagttttttttttctgcacatcattatcttaagaagaggggtccaaaatagaccaacaatcaagggtcagcctaaagtaacttgccttctcatcttttcttcaatgttctctgcctctttggccaggtcaaccgtcgctacaaggtcttcaactcttaatccagaggggccgtgtaccgtgtccccatcaaattgcaaatgctgggtcgttcaattgcacatttgacgcataccatgtgcaagcccgattacaaaaacagtacactagcttagcgttccacattgttgatattcggaatatatggggttcggcagaaaagatattgtatatgaccaggccatgggctgcacgtgtatgctcgattgttatttggctaattcacttggaccaatccatagccattcaacattcatgcgtaccatggagcctcttctttgccagcatttgaggggctggatcgaattcaaaccctcctgtttcactagcatccatagcagccatatcatgtgttggtcgtgctacggttccttcgtttttttgtgcagctggactatttgtccatgcacaatgaaggaaagtcacatctttgaatcatatccaaggtgtccatccctcgtacatattgcataagttgtcaatgcttgttgcttgtttaagaagatagtcaaccttgctcagaaaccc

SEQ ID NO: 24477 - DNA, 1182 bp, Zea mays
ggttattcattcgtccttctattatctttgcctttgtcttctttcctaagatttcactacttctgcggggtgtcacagtcttaagatcatgtcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgtgtttctcaccatctggttcatctggtccaatgctgcgtcatttgtcaacaggtcacctccaaagttcccagaggtcattctatctgaagtccagtgcataaaggtagctcatgttgcaaggaaagaaatcaacgaggctttctatacattgcgtaatgttgcttccggaaaagatttgaaaacatatctgatgacaattacagtgctgtggttcatttccataattggaagctgcttcagtttcttgactctgtcttacactattttcctgatggcatacactctgcccatgttgtatgagaaatacgaagatcaagttgatatcgtaggcgagaaggccctcattgagataaaaaagcagtacaaagtgattgatgcaaagtttatctctaagatcccaatgttgtctgagaagaaacaacactgagagagggtgctccaaaggtctaattcagcacattaccaatatatgaaagtagttcctttggctttgctatatcatcatttagcaacctttaagatgataccatagatattatatggattcctaaggttggaaatttgtgtcttccgagtcccctagaatagttgcttcttcctgtctgacagtgaatttgattttgtatggatgtgacatatatatgcctgaccaattgtcattatttgctattcatatatgttactgggtgtatttaatagctctcaatttatgcagttatgtttgcagttgaaaaaaaaaaaaaaaaa

SEQ ID NO: 24478 - DNA, 2606 bp, Zea mays
cattaagctaattcaattttatgcggagatatttatgtgctttatttttactatagaggagtgagacgaagagtgtcacataagttataaagtagaaacaaattctactaatgcataaaatgatttctcatcctccaccccataaatttaagatagacttatatctgaactttggaaagtggtggaatgtcaaatttctataaaatgaatggatccaaacgccccgttagttttttctgattgatggaaattagtgcgatcggaggtaatttttgtcgattgtttatagccaacaaaaattagctaacatccgtcgattgacccataaaagttaataatttctgtacggatgtcgtcagccgagaattgatggaagttagtttaagccaaccaaaattagcacgacaggagtcaggagttgtgatcagtcgtatattagagcatgacaaataatactcactcggtttcaaaatagtagttgttttagctcttaattttttatctatattcaaataaatttagacataaatataaaacatatacaataagtatggtaggaatctaataaatttttaaaacaaattttattttaggataaatggagtataatatattgctataatgaatgggcaggagaggagatagctcttgcattgcatgtctgacattagcggagggatcggttgctatttgtgactgtccccgtctttaactccccaccattatatctacgacgcaacctccttcaatttcggtttccaacacaacgatggagtgaaggcatgaagacccgaaactgaaaccaaaaataaactgcaggcagagggggaaggagagcggcaggagggtcattaaataaatctacttttctgttgtaagtggtcttgatcttgatcgtagaaaataggttattcattcgtccttctattatctttgcctttgtcttcttttctaagatttcactacttctgcggggtgtcacagtcttaagatcatggtgtttttatgtctcaaacatggtcgcaattgtgacattaggtagatgggagatttttgactgagttttcgtgttttgtgagcgaagtcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttaccgttcgtgggcttccgctaccatggatttacacaataaaccatatattgtttgtgtaatttgtgagctttttttttgttctttaaacttttgacaatctatacggtgtgcaacatccactgatgacaatggcatctaattttccttttgattcagccgccgaccttgtgctgtggaggaacaaacaggcatctgggagcatattggtaggggtgaccgtgatctggttactgttcgagggcatcggctaccacctccttaccttcctctgccacgcactaattgtgtttctcactatctggttcatctggtccaatgctgcgtcctttgtcaacaggtcatccttatgttcctcctagagttcgtagccatttaattcgatccttgatcttattttggaaaaaaaatctactccctctccattccaaaatatagttctttttaggcctcttttttcttgcttttttattcgttgaagagtccctaatattgccagatgtgagtattttaaatcttaatttgagcaagattctttgttatcccaaatgcaaagaattgcctaataattgtttacctatagagaacatatgttatgttggagatgatatgatgtctccaggttttttcaggtcacctccaaagttcccagaggtcattctatctgaagtccagtgcatgaaggtagctcatgttgcaaggaaagaaatcaacgaggctttctatacattgcgcaatgttgcttctggaaaagatttgaaaacatatctgatggtaattaacctgacttctaccacatcttttgttccgatataattaagatatgctgagcctttttatttcttttttttttggcagacagttacagtgctgtggttcatttccataattggaagctgcttcagtttcttgactctgtcttacactagtaaattccttgtctacaccataatatattgattccttcttaaaatctatattgcatggtacttcatataaattacttcgatagtataaataattttaattatgcgcttaaaaacaaataggatcttttattatactctagtactttcaatcaaaataagagtttcttgtacatacaaaaataaagcgtgaaatgtgattgagttttaattaccatttttatgattctgccacttggtctatgaatatttgagcatgtacttctgtgagtaaaacaacaacatgctaaaacctaagtgcatgtagagtc

SEQ ID NO: 24479 - DNA, 808 bp, Zea mays
  misc_feature (758)..(758): n is a, c, g, or t
  misc_feature (763)..(763): n is a, c, g, or t
  misc_feature (789)..(789): n is a, c, g, or t
gctaacacaacgatggagtgaaggcatgaagacccgaaactgaaaccaaaaataaactgcaggcagagggggaaggagagcggcaggagggtcattaaataaatctacttttctgtttcagggtaggaaatgatgtccgagagtgaagagcatggctcgctcctagacaagatcaacgacaagatcaacgagaagatccatgagtataagcactcgtcgtcgtcctcctcctcttcggactcagacgatgacaagaagcccaagaagtctaagaagaagaagctttttggaagaaaacatccattgcatcatgtcctcggaggaggcaaagccgccgaccttgtgctgtggaggaacaaacaggcatctgggagcatcttggtaggggtgaccgtgatctggttactgttcgagggcatcggctaccacctccttaccttcctttgccacgcactaattgtgtttctcaccatctggttcatctggtccaatgctgcgtcatttgtcaacaggtcacctccaaagttcccagaggtcattctatctgaagtccagtgcataaaggtagctcatgttgcaaggaaagaaatcaacgaggctttctatacattgcgtaatgttgcttccggaaaagatttgaaaacatatctgatgacaattacagtgctgtggttcatttccataattggaagatgcttcagtttcttgactctgtcttacactattttcctgatgtttattcggggaaaagtcttaanctganccctattgttgcaaggtatgacaatnagtctaattgccagtactc

SEQ ID NO: 24480 - DNA, 915 bp, Zea mays
aaaaaaaaactttgatcactcgtctattggtcggcagctggagatgctgttcgacacaatcgatggttaaattaattcggactgccaacacggcaagaacagctccaacaaagcttacaggcagccgtcagtacgtacttcgaaaaccctaacaacctcccgtattcgaatcacaatcaaaatagcataacttagcattctggactccggtgtatatatatacgtctgctcgtccagaatcggattaaagctgtacgttaatcacttccacttgcgaccgaacatattcttgtgcttgccaaacatcttcttgtgcttgccaaacttgccgtgcttgaacttgccatgcttgaacttgccgtggccgtggccgtggccgtacatcccgtgggagtgggacaccgtgtgagctccgtacgccgccgcggcacctccggccagcatcgccccgtggcctgcagagccccctgcaccgtggcctcctccgtacatgccaccatgaccgggcatcgatggatagccaggctgtgggtagaccggttgatgggggtacccgctgggaggatacgcgcctgcacccggcgccgggtacgccccgtgcgacggcgggtatccgccaggctgagggtagccacccggaggcgggtacccaccaggtggtaccgggtacccaggcccgggagggtacgcaccgccgcccggtggagcagggtagccgccgccggggtactggccgccgtagtatccaccggcggccgggtaccctcctccgtggaatcccttgtccgccttcgagggatcgtggccgtcgtccttcccgccacccatgtcgcctgcctcccaagtctcaacggctacaactgaactacgagagaattacctgaccaggaacagcttccttggacggaattaatt

SEQ ID NO: 24481 - DNA, 1921 bp, Zea mays
ttttttttttttttttctacgacaacaacttaagatgaaggttcaggcacacgacttgccgtgaaatttagagacagcttacaaccccatgcaggacgggaagtttgccacagagaaatcaaccatgcgcacaaagcattgcacggggtacacacatgaaatgacaacggttgttcacgattcatgtacatttgtgccaaaccttctgagttagcagatcggcaatcttaagtgctgtctaaatgtacatgaatcgaatacaagccgtagtcagtcagactgtggacatatgaatgcagctagccacacaaaactcgcaagctgtttgggtacaatgtacaaattctttagttattaacagcaactagttggagagggcagcgacagaagaatcctgaaacaaggaggtctggttagtcttgcccatcttcttccgccagtacgatatcgcggtgctgtagtgctcgttgcggattttcttcgaggctgtcctccagtcacacttctccatctcttctctggcagccattccaatggtttcccctccttgtccttgggtattatatcaggtatccctccagcacgagcagcaacgactgggactccagaagccatggactccagcactacttgcccgagggtctcggattctgaaggcattgcaaatacatctccactggcgtacgcttgtgagagctcctcaccttggagcattccggtaaaaactgcaggcatgcccgtgaacattttttccaactcggacctgtatggcccgtctccaacaaaggcaatccttgctcctgggagcctctccataacccttttcagaaaatccaaatttttttcacgtccaaaacggcccacatgtattaccaatggtttttctggttcaccaccactcaatctgacacgcatttcgtgcctccgatatttagtatgaaagctttcagaatctacacccttattccaaagccgtattctgtttgctggtactactttagcggtttcgaagtcttcagcaatagctaccgaaggaactagagtaagatctgctgatctgtggaggcatcttataaaactccacgtgggctcaagtaaccaatttaaattgtacctcggtatgtacgctggaagatgtgtgtgataagacatcaccattggaactgatatcatctttgatatagccagagcgccgagaaccataattccaggtgaggtggcatggattatgtccggcttgaatttattcacctcagaaaatattctggggctcaatgccagcgagagtggaacattttggtacagaggacatggaaagctccacgagccaatgacctttgctccatggaactcctcaggggctcccttgtgtgtagtcaccaccagtacctcatcgcccatctctcgtagatgcttgatgaagttctgaaaccggttcttgtaaccggaaatgtaagcaaagggcgacggctcgacgaagagagcaatgcggcgcggcttggagctccactcggcgtccgcctcctgagtctgcaacagcggcacctgcgcctcccctgtctgagacatcctcctccgacgcgacgcgagcgatccccggccgcagtccaactaaacgcagcctgcttcggttgtgccgctcacgcgcgtgccgcggccgcccttatcccgctttcgcccgccccctccggctccggccccgtcccagcctgctgcttgacttgcaacccacgcggggcaggtggcggcggcggcgcgcggaagcagcttcacccttcacggcaacgcgcgggcgcacccaacagcagcaccgagacgcgacggggcgcgcgtaggggaagcgcgacgacgacggcggggacgtggtttgtggtggactggttgtggccgatgtagggtgggcgagggaatggtctcgtgc

SEQ ID NO: 24482 - DNA, 1927 bp, Zea mays
ggagaattttgtgtcgaaccttcctgagttagcagttcggcaatcttaagagctgtcttttttttttttttttgtatacaagccgtcgtcagtcaaactgtggacatttgaatgcagctagccacacaaactcgcgagctgtttgggtacaatgtacaaattctttggttattaacagcaactagttggagagggcagcgacagaagaacccggaacacggaagcctagttactcttgtccatcttcttccgccagtacgatatcgcagtgctgtagtgctcattgcggattttcttcgaggctgctctccagtcacacttctccatctcttccctggcagcctttccaacggtttccctgagatcctttgaactgaggacttgctctatcttcctcacgcactcatcgagatctcccggtgtaaacaaaaagcttgtcttaccctccttgtccttgggtattatatcaggtatccctccagcacgagcagcgacgactgggactccagaagccatggactccagcactacttgcccgagggtctcggattctgaaggcattgcaaatacatccgcactggcgtacgcttgtgagagctcctcaccttggagcattccggtaaaaactgcaggcatgcccatgaacattttttccaactcagccctgtatggcccgtctccaacgaaggcaatccttgctcctgggagcctctccataacccttttcagaaaatccaaatttttttcacgtccaaaacggcccacatgtattaccaatggtttttctggttcaccaccactcaatctgacacgcatttcgtgcctccgatatttagtatgaaagctttcagaatctacacccttattccaaagcggtattctgtttgctggcactactttagcggtttcaaagtcttcagcaatagctaatgaaggaactagagtaagatctgctgatctgtggaggcaccttataaaactccacgtgggctcaagtaaccaatttaaattgtatctcggtatgtacgctggaagatgtgtgtgataagacatcaatattggaaccgatatcattttagctatagccagagcaccgagaaccataattccaggtgatgtcgcatggattatgtctggcttgaatttattcacctcagaaaatattctggggctcaatgccagcgagagtggaacattttggtacagaggacatggaaagctccaagagccaatgacctttgcaccatggaactcctcaggagctcccttgtgtgtagtcaccaccaatacctcatcgcccatctctcgtagatgcttgatgaagttctgaaaccgattcttgtagccggaaatgtaagcaaagggcgacggctcgacgaagagagcaatgcggcgtggcttggagctccactcgccatccgcctcctcggtctgcaacagcggcacctgcacctcccctgtctgcgacatcctcctccgaagcgagcgatccccggccgcagtccaccgcacgaactaaacgcagcctgcttcgcttgtgccgctcaagcgcgtgccgcggctgcccttgtcctgcactcctcctgcttcctcccgggtcgtccgctccctccggcgcccgtccccccgcctgccgcttgacttgcaacccacgcaggcaggcggcggcggcggcgcgcggaagcagcttcacggcaacgcgcgggcgcgggcgcactcaacagcagcaccgggacgcgacggggcgcgcgtgggggaagcgtgacgacgacggcgggacgtggttgtggtggactggcagtggccgggcagaaaaaaaaagtggtggagacaattaggacgagcgaacgaatgagcgagccagagccaaaggacagcggcagacggggaatcgaatcgattctctccagcggccgatcgaaatcaa

SEQ ID NO: 24483 - DNA, 1666 bp, Zea mays
gaacagtgcagtctcttctccgggtgctgacattgacacccgtattgaagctaccgtcagcaacaagcctatacactgcacatacgacgagtacttcgaaattattggagaattttgtgtcgaaccttcctgagttagcagttcggcaatcttaagagctgtctaattgtacacgaattgcatacaagccgtcgtcagtcaaactgtggacatttgaatgcagccagccacacaaactcgcgagctgtttgggtacaatgtacaaattctttggttattaacagcaactagttggagagggcagcgacagaagaacccggaacacggaagcctagttactcttgtccatcttcttccgccagtacgatatcgcagtgctgtagtgctcattgcggattttcttcgaggcagctctccagtcacacttctccatctcttccctggcagcctttccaacggtttccctgagatcctttgaattgaggacttgctctatcttcctcacgcactcatcgagatctcccggtgtaaacaaaaagcttgtcttaccctccttgtccttgggtattatatcaggtatccctccagcacgagcagcgacgactgggactccagaagccatggactccagcactacttgcccgagggtctcggattctgaaggcattgcaaatacatccgcactggcgtacgcttgtgagagctcctcaccttggagcattccggtaaaaactgcaggcatgcccatgaacattttttccaactcagccctgtatggcccgtctccaacgaaggcaatccttgctcctgggagcctctccataaccctcttcagaaaatccaaatttttttcacgtccaaaacggcccacatgtattaccaatggtttttctggttcaccaccactcaatctgacacgcatttcgtgcctccgatatttagtatgaaagctttcagaatctacacccttattccaaagccgtattctgtttgctggcactactttagcggtttcaaagtcttcagcaatggctaacgaaggaactagagtaagatctgctgatctgtggaggcaccttataaaactccacgtgggctcaagtaaccaatttaaattgtatctcggtatgtacgctggaagatgtgtgtgataagacatcaacattggaaccgatatcattttagctatagccagagcaccgagaaccataattccaggtgatgtcgcatggattatgtctggcttgaatttattcacctcagaaaatattctggggctcaatgccagcgagagtggaacattttggtacaggggacatggaaagctccaagagccaatgacctttgcaccatggaactcctcaggagctcccttgtgtgtagtcaccaccaatacctcatcgcccatctctcgtagatgcttgatgaagttctgaaaccgattcttgtagccggaaatgtaagcaaagggcgacggctcgacgaagagagcaatgcggcgtggcttggagctccactcgccatccgcctcctcggtctgcaacagtggcacctgcacctcccctgtctgcgacatcctcctccgaagcgaggcgatccccggccgcagtggccggggagaaaaaaaaaaaataaagtggtggacaattaggacgagcgaacgaat

SEQ ID NO: 24484 - DNA, 1314 bp, Zea mays
ctgtttaaatgttttaattatttttagcagctaactattagttctggtacattagaacatggccgaagccactgacagcaacaagcctctacactgcacatcagcacgcgacaagcacgtcaaaattatcggagcatttgtgccaaaccttctgagttagcagatcggcaatcttaagtgctgtctaaatgtacatgaatcgaatacaagccgtagtcagtcagactgtggacatatgaatgcagctagccacacaaaactcgcaagctgtttgggtacaatgtacaaattctttagttattaacagcaactagttggagagggcagcgacagaagaatcctgaaacaaggaggtctggttagtcttgcccatcttcttccgccagtacgatatcgcggtgctgtagtgctcgttgcggattttcttcgaggctgtcctccagtcacacttctccatctcttctctggcagccattccaatggtttccctgagatcttttgaactgaggagctgctctatcttcctcacacactcatcgagatctccgggtgtaaacagaaagcttgtcttaccctccttgtccttgggtattatatcaggtatccctccagcacgagcagcaacgactgggactccagaagccatggactccagcactacttgcccgagggtctcggattctgaaggcattgcaaatacatctccactggcgtacgcttgtgagagctcctcaccttggagcattccggtaaaaactgcaggcatgcccgtgaacattttttccaactcggacctgtatggcccgtctccaacaaaggcaatccttgctcctgggagcctctccataacccttttcagaaaatccaaatttttttcacgtccaaaacgacccacatgtattaccaatggcttttctggttcaccaccactcaatctgacacgcatttcatgcctccgatatttagtatgaaagctttcagaatctacacccttattccaaagccgtattctgtttgctggtactactttagcggtttcgaagtcttcagcaatagctaccgaaggaactagagtaagatctgctgatctgtggaggcatcttataaaactccacgtgggctcaagtaaccaatttaaattgtatctcggtatgtacgctggaagatgtgtgtgataagacatcaccattggaactgatatcatctttgctatagccagagcgccgagaaccataattccaggtgaggtggcatggattatgtccggcttgaatttattcacctcagaaaatattctggggctcaatgccagcg

SEQ ID NO: 24485 - DNA, 704 bp, Zea mays
gtctgattgccctgttccattgttttgtcgctgggctatttgatattttcgcactgcatgcgcttagacaacctacactacatgatctagctatccctgcagagatcagcactcgctcaggcatgcaatgcaatttttccattagccagcattagctaaaactaggcgcagacgtccttgacacgcatccagaagaccggtaataatgcatgataactacaaacttatatatatagctggtgcctagaactagttaattaagccgcgcgcgtcagtttgcgaccgccttctttggcttgggcgacgccgccggcttctcgtgcacccctgcaggagcggcggcattgaggtccgggatcgttggcgcgcggttgcctgccgctgccgccgccgccgccgttctggcgacgcgctgcttgagctcggtgagcaaggcctggttctcctggttgagcagcagagccttgttgcgcagccgctcgttctccttcatgatgaagcagttgtgcaggtacagcttcgcgttcagcctgtccatatcgtccttcgtcgcccttgttgcctggttgggaagccgctcgatcgctgccccggtcactcgagggccttgctttgctggtggggggcagcagagagcttgtgatgtgagcttgtgctggattttgacacatcccctcggcgggggggcctagtagctgactcga

SEQ ID NO: 24486 - DNA, 1605 bp, Zea mays
tggacctcgtccagactcctagccggcgagctgccgcctcacacgggcgccacaggaagaagaactccgtggctgcggcggcgcagtctgacgacaagatgctcgcgctgtggagcgtggacagggtgagcagcggcagccggtggcatgacgtggacctgcggccaccacagagcgaggcggccgagaacgacaagggaaagaagcggtcgtcgtccgagccggtggttaccgtgaaggacctcagcgtggacaagcaggaggtcctcttgcggcccattgtgggtgcggtggtggtggcgacgggctccacgacggagccacaccgggagtggaagaagaaggtgatcgaccggctatcctcggaggcgcagcggctccgggacctccggtccatcgtccaggagctccgtgccggcgtggaggcgtcgtcggacgcggagctggacggcgtcaaggcccagatggccgacgcagaggacgctatcgcggagctggccgacgcgaacgcgaagctcctgaagaaggcggaggagttcacgtcggcgggcgacggttgcggcgacgtggacctgcggagccggagccagcgcaagatcctggagcgcgtacgcaagatgtcggagaaggccggtcggctggagctggagctgcagcggttccagcacgcgctgctgcggcacgaggaggagcgcgcggcgaggcgcgcggccaaggcggcggcgtccaccgccgtgcaggtgcagcggcggtcgcgggtgcatctggtggagtacctctacgggcggcggcgcgacaaccggcggcccaagcagaaggcgcgcgggccgtcctgctgcatgagagccaaggccatcgacgactgacggtgacggccacgcacgccctcatcagtattcggtagtcaacccgaagatgatggttagttaattaattaatcaggagaaggtgcagtaacgtttgatttaaaattttgcttaagttcatgtcgtcctaggtaagtaattattactggactgatcttagtacgtcgttttttaaacctaaagtaaagtaaggtctaagatgtaaatgggtagtagcctagtaggcccgcagccatgactgtaatcttcggtctcattattcctcgtcagtaaaatttcaaacggtaatcttcggtctcaaaaaaaaaaaaaaaaggccccgggacccaaatttcccccctaatggggggggtttaacaatctctcggccgcgcgctttttacacggggtggttgtgtggaaaattcgtttgtttttatttctccccctcgtttgtgctctacccctcccttttttctttttgttatacattcataatcatacgccctccccccctcgtctttctctctttcttttcgcttcttttttttcatatccgttcgttttccgcactccctctttttattagtttccatccttgcgactcttgtatctctctcttccctctctcctactctgtttcatttttctccctgttcttctggctctactttctccttccttttttcacccctctgttattttgattttctttttgatgtcacccgcctgtctcccactcttcctcacactctttctt

SEQ ID NO: 24487 - DNA, 837 bp, Zea mays
gtgctacgaccgtaaagagtcgctcacagtatcagtctcatggggctattcagtccaggtgttcaagggcaacgtgctgctccctgaccttcttgctgtccagaaaacctttgtaccatggaaaaggggtcgcaatgtcacagatgtgtacatgtttaacaccaaacattaccccagagacgagtgcaaaagaggagctcttttcttcctaaaaggcattacctcgagggaaggcaagacggaaaccacttacaatagacagccacctaggaaatgcccgcctgacttgatcccactgaagagtctgcgtctgataaaagtgacatcagaacggctgcagctggctcctgggaaggccttaagacgccattgctgtgacatcgtaccttcttcatctgatgctaacatagacatcaacgtcagaaagtgcagagatgatgagctgatcgcgatgcattcatagtcattctttattcatatcagttcgtagttgcagcaggccatcatccacatcaactctgcgctgacaccaggccatgcaccgcggatcaacatggatcagcagcacacgttcatagtatagacacacaggatatacagaaaatgcagatgcagaggcagtatagacagacacggatcagttagcattgtttttcttttaaaaaagcagagctgaggcatcaggatttgagtgctccatagtctgacatgtaataacatcaaatagtcgtatttaccagacaaggtcggttccgttttatacagcatattcaaatctactttgttataatggaaaagaaatcacattttattctactgctaaaaaaaaaaaaaaaa

SEQ ID NO: 24488 - DNA, 1975 bp, Zea mays
  misc_feature (2)..(2): n is a, c, g, or t
  misc_feature (22)..(26): n is a, c, g, or t
ancagtggtaacaccccaaaannnnntttttttttttttttttttttctttccgctcttctttttttttttttttttggtctaatagtattagtacatcgttaaattggtttgctcgggtacacacaacaaccaacaaaagtgttcatggcacaagtagtacgcccggccgggttcgttctgacgaagccaaggtcattgaacttggccttaatttaattacaacgacatatagcaaatatctctggctcgcccgggttcctacgtactaccaatagagattagagttttatatagactgaaacctgttggcttgggtcctagcctttcaacgagatgtatccatttctaatcatccactcgagatcccaatggttgttggcattcttggccgtccaataggcccacccaaacgtggcctgtccatacacgttcatctgcgccgctgcgtacttctggtattcctccttggtcgcgttcggcaccttccactccgcaacccactcgccgacgaaggtgagcgggccatctcgggtggtgacggcggcgagctcgccggagaagttagtccggacgaagtcgatgttctgctgcgcggtgaagttaccgaacaagctgttgaagacggtgtagtaatgcacgtcgacgacggcgcccgggaacccacggccggcgaaccagaggagctccgtggagttccccgacgacaggcggttggacatgaccacgtaggccgccggcgcgtgcttccggacggcggcgtacccgtcgcggtagtacctggtgaggctgtccagggtcgctccaggcgccagcggctcgttcagcagctccaccgccagcagcctcgggctcgtcgcgtacctggacgcgaggaaatctatgacctgcaccgtctgcgcgatgctggcgtccgtggttccccactcctgcgtgccgtctcgggacgagctgtgctcccaggggttctgcgacccgggagctgcgtgcaggtcgacgatgacacccagctcgtgcttctctgcccatctgaaggcgttgtccagggcttggagggagcctccgacgtacggagcgggcgggctggggtcgctggcgatccaccatccgacggggatcctcactgcggtcagcccactcgacgcaaagaacttgaagtcgtcctccactatgtacgtgctccaatgctccctcagcagcggcgcggccttgtcggcgccgtagccgttgcagagctggtactccccttgcagctgctgcccgacggtggtcatcaggaacactgacgcgtcgaagtcggaccaccgcgtgggctcgccgtagtccgctatcacttcgccggtcgctatcgcctggacgaagtagccgttcgccgccttgatccggaccctgttcttgtcgaaggggcaccgcactatctggaacgtctccggcaggcccggcgtggtggccgtcgcgacgatgatgccgtcgctggcgccgatgcccacgaactggttgccggacgtgcggaagttgaacgtcgtgtcgttcagcctccacagcttgaacgtctcccagtcggaggcctgcgtgcggttggccacgacggcgccgccgccgccgttgtccgcggtcaggtacgtcttccgcagcgccgacttgaactgcagctgcgtgccatccaggaggtctttgttggggatgccgtcgaagagggagggcagaatccagccctcggtgacgagccaaccgccgaggcacaccgcccggacggggagagccggatacgagaccgctgggctctgctgggacgacgacgctgccggtggctgctgcttcttgcccgtagtaggcgcaggctgcggcgtcctcttggcttcggacaacgaggcgcacaggcacaggaggacgaagcagacgcgcgtcacgggcggcctcaaaccaccgcggaaacccattggcctgtcgcctctggcgcccggccggcctcgagg

SEQ ID NO: 24489 - DNA, 1475 bp, Zea mays
  misc_feature (20)..(20): n is a, c, g, or t
ttttttttttttttttttgnttgaatataataaattgattcatcagcatttcattcatcataagctcataattagtaataatatggagaacgaatttattccaccaaatttataaaataaacttatgatacacaacatcatctaaaatagattgactcttcaaaccaaatgccccttagtttttctgtcttcacgtgagaactctctcagcaagtatctatggtatcacatgtactgcgcgagccattgcttacacatatcaagcactgtcaatgcatttgcatgtaatgcctgatgagcaacatattgaacatcagcgacacttccacttcgtgcggctatttggaatgcactttttagacgtccacagacaacacaagcaagtactttcctgtgattgctgattagcatgtcgataaggcgatctggtctttctttatgcttgttggcataaacatttatagcagcaccaataacctgatcccattcatcatcatctatagtcccccttatattcttcaagaactctgtcaactggcccccttttttcctttctgcgagggatgcagctaccccagcataaatatcaacagctgggagatcaaactcatgaagcattctgaaagctaaatcaaaatgcttttcagccagagtttcaacaaccatgcaccttcgcctcagagtttcagggtctgttggattcccaaaaagggaagttttccactgagagccatctatactattgagggccttcaccacatccatctgataggaaacacgagtggaatatttcattatcgtttccctggtcatttttccaggtgcacccttattccgagcagaccgcaataccaacttagtagcctcgattgttctatctcgtacagataaggcttcttcgaaatgtgtcttggcatgtcccaaatgcctcaaagcctcctcttgagacattgaattcataaataattgaatacaacaaaggccagaagcaacatggtcatcttttagaaccaggaagttgtagagataattaaaatgcctgtgtgtttcacaatagttgcaaatgcgggtgataatagtgttcatgtactgaatcatgtgtgcctcatgatatgtgggcgattgtgttattgtccgtattgtattctccaaaacagccatggcaccatatccaagacagagatcacacaagtcatcaattgtcccataatcagttgttaaaggatcactccatggagctgaagacaaagatgtttccccttccgtggttggttgactgaatgggaagaacagagagcatgcttcagtgtaatggccatgcctgaacatgaaagcaagcatttgtggccgagcataatcttgcaagtaatgaatacactcagcatatcggacactatcaagattgctgcgagggccatcttcaaggtaggaactagcagtcctgaattggctgtctacatgactctggactgtcg

SEQ ID NO: 24490 - DNA, 1472 bp, Zea mays
  misc_feature (1466)..(1467): n is a, c, g, or t
  misc_feature (1469)..(1469): n is a, c, g, or t
  misc_feature (1472)..(1472): n is a, c, g, or t
ccccggtttgcctattagtgctccatgctccatttgttgattagcatgtgccaaaatgaaatgctacaggagagcccccctacaatatcttaactaggcgctgtcctcatcttccaaattactgcatgctgcatgtatgagcgaaaatatccacaaatgattttacaactgtcaaaaaatttcagcagtgaaccgaacaaatctgctggcattcaaatgttttgattcaacatatggcaatatatttgagcctctgattctgctggcaattgattcacgaatgcattttgtttttatttgattcatggccagcaattgggactggatatcgaacattctgctggactcaaatgatatagcttgcactaggttcctcatgttcatttcatttcccccgaacagaatttgtgatgtcacagagtagggatgatgatgatctatatcaaaaaagactaggttcctcatgttcctcatagtcctctccataaagcactaggttccatcatcctgcctctgcctctcttgtatagtttcttccattcaaagtgagcagcaatacttgattgatgtcgtgtgttcagaaagtatactaccattctggcggacttcggctgaacccgaacctgtacgagagcgggaaagtgtgcctgagccttctgaacacctggtggggcaaggggtgcgagaagtggggcaagtcgagctccgccctcctccaggctgcaggttctggtctccatccagggcctcgtgctgaatgacaggccatacttcaatgagccaggatacaagaactcggctgaaacgacaggtggtgagaggtgttccttggcttacaatcagacgaccttcgtcagatcatgcaagacgacgctgtattcactccggaagcctccaatggtgaactgaacaaatatgaatggatacttcatctcttgattgattgattgattgattgatatagcttcatctccttccctgcagcattttgagacccttgtgttgtggcacttccacgagcatgagcgtgccatcctcgacgcttgcagggcttacatgtctgggacagtcgttgggtcgtctgctgggactgggagcaaccgcagatacgtccatgacaagtgctttgcagaattccacaagtcgctgacgctctacactgaacatctcagggctgagtttgctgcaaacacaagacgagtgatggagctggaaacagaagacgagatcgtgcctagcatagcagctagcgtgaaatcgtgttgaaggcaaatgccccacggtgttgtatgttgctctcatcatcagatatttgctggcttagctatttctagcctcattctacttcattcatgtcacttgaataatctaattcatggcaattgtacctgtccctatacctagatggcttaaaatctgaaggtttattacagtttctttctggtgaatcaagagaataaattcanngnggn

SEQ ID NO: 24491 - DNA, 1523 bp, Zea mays
gcacgagccaagatcggccgctgccaactgggggcctcaccgccacccgttcttggaaaacagcacgctacttgcttgaaagcaaagggagatacttgccgcgttgggattctccaactccaactccaaccaagacgaacgatttcatcccagaaattagattatcaggtgcattttgtgtgaggatccagacgcaggaggatggctctcaagaagttgctgcagctcttttgtgtcggaaagaaggattccaagaagaaaggtaaattcatcgatccactctggcaagcctctgcctcccgctcctctgtgaatgtcactgcaaacaagactcatttggatccctgttcaagtgggaatgacactgtaagcgtgcaaaaccatgaagttgaatcctcaagtacggtttcctcgtgggcaaggacagagcatggaactgagattgctcatcataccccccgcgggcgcgcccccgtggtccaagacttctcggatcaccactatgcaaagacttcagcaggaaaggtcacaaaggattgggtgaaggcaatccaaagtgaatgggatcttctacagaaaaacctacctgaatctatatacgttagagtctatgaggacaggactgatctgctgagggctgccatagtcgggccagcaggaactccataccatgatggtctgttcttcttcgatgtccgttttccttgcgaatacccaaagtgcccaccaaaagtatactaccattctggcggacttcggctgaacccgaacctgtacgagagcgggaaagtgtgcctgagccttctgaacacctggtggggcaaggggtgcgagaagtggggcaagtcgagctccagcatgctgcaggttctggtctccatccagggcctcgtgctgaatgacaggccatacttcaatgagccaggatccaagaactcggctgaaacgacaggtggtgagaggtgttccctggcttacaatcagacggccttcgtcagatcatgcaagacgatgctgtattcactccggaagcctccaatgcattttgagacccttgtgttgtggcacttccacgagcatgagcgtgccatcctcgacgcttgcagggcttacatgtctgggacagtcgttgggtcgtctgctgggactgggagcaaccgcagatacgtccatgacaagtgctttgcagaattccacaagtcgctgacgctctacactgaacatctcagggctgagtttgctgcaaacacaagacgagtgatggagctggaaacagaagacgagatcgtgcctagcatagcagctagcgtgaaatcgtgttgaaggcaaatgccccacggtgttgtatgttgctctcatcatcagatatttgctggcttagctatttctagcctcattctacttcattcatgtcacttgaataatctaattcatggcaattgtacctgtccctatacctagatggcttaaaatctgaaggtttattacagtttctttctgatgaaaaaaaaaaaaaaaaaaaa

SEQ ID NO: 24492 - DNA, 1261 bp, Zea mays
ggattgggtacctcgaggcccccccgcgcccgcgcaccgcactgattgggctccaagatcggccgctgccaactggggggcctcaccgccacccgttcttggaaaacagcacgctacttacttgaaagtaaagggagatacttgccgcggggggattctccaactccaaccaagacgaacgatttcatcccactaatcctttttcttttcttttcgtttttatttttaatttcttggttcggttcttgatcacctgttcttccttatgaccttatccaggaaattagattatcaggtgcattttgtgtgaggatccagacgcaggaggatggctctcaagaagttgctgcagctcttttgtgtcggaaagaaggattccaagaagaaaggtaaattcatcgatccactctggcaagcctctgcctcccgctcctctgtgaatgtcactgcaaacaagactcatttggatccctgttcaagtgggaatgacactgtaagcgtgcaaaaccatgaagttgaatcctcaagtacggtttcctcgtgggcaaggacagagcaaggaactgagattgctcatcatacgccctttagtcaatttgatgttgtccaagatttctcggatcaccactatgcaaagacttcagcaggaaaggtcacaaaggattgggtgaaggcaatccaaagtgaatgggatcttctacagaaaaacctacctgaatctatatacgttagagtctatgaggacaggactgatctgctgagggctgccatagtcgggccagcaggaactccataccatgatggtctgttcttcttcgatgtccgttttccttgcgaatacccaaagtgcccaccaaaagtatactaccattctggcggacttcggctgaacccgaacctgtacgagagcgggaaagtgtgcctgagccttctgaacacctggtggggcaaggggtgcgagaagtggggcaagtcgagctccagcatgctgcaggttctggtctccatccagggcctcgtgctgaatgacaggccatacttcaatgagccaggatccaagaactcggctgaaacgacaggtggtgagaggtgttccctggcttacaatcagacggccttcgtcagatcatgcaagacgatgctgtattcactccggaagcctccaatggtgaactgaacaaatatgaatggatacttcatctcttgattgattgattgattgattgatatagcttcatctccttccctgcagcattttgag

SEQ ID NO: 24493 - DNA, 863 bp, Zea mays
  misc_feature (802)..(802): n is a, c, g, or t
  misc_feature (810)..(810): n is a, c, g, or t
ctcgaggccggccgggacgatctcctgattgggctccagatcggccgctgccactgggggcctcaccgccacccgttcttggaaaacagcacgctacttgcttgaaagcaaagggagatacttgccgcgttgggattctccaactccaactccaaccaagacgaacgatttcatcccagtgcattttgtgtgaggatccagacgcaggaggatggctctcaagaagttgctgcagctcttttgtgtcggaaagaaggattccaagaagaaagcctctgcctcccgctcctctgtgaatgtcactgcaaacaagactcatttggatccctgttcaagtgggaatgacactgtatgcgtgcaaatcgagggggccgccccggcaggtacggtttcctcgtgggcaaggacagatcatggaactgagattactcatcatacgccctttagtcaatttgatgttgtccaagatttctcggatcaccactatgcaaagacttcagcaggaaaggtcacaaaggattgggtgaaggcaatccaaagtgaatgggatcttctacagaaaaacctacctgaatctatatacgttagagtctatgaggacagaactgatctgctgagggctgccatagtcgggccagcaggaactccataccatgatggtctgttcttcttcgatgtccgttttccttgcgaatacccaaagtgcccaccaaaagtatactaccattctggcggacttcggctgaacccgaacctgtacctcggccgcgaccacgccctgagccttctgaacacctggtgnggcaaggngtgcgagaagtggggcagtcgagctcagcatgctgcaggtctggtctcatcca

SEQ ID NO: 24494 - DNA, 1212 bp, Zea mays
gacactggccccctcccaaaggtgagtcgcttctcctcttccttgatcgccgatttccggcttctttccttttcccctccgccgccggggattgtggttgtggttgtggcttccgtatcctcatcctcatggcgtgatagaaggttgcttcgtttctttgattggccatggacgtacgtctttcgttttctcggtgggggatgggagggggttcttgatagtgatgcgctgctgctacagtgctcctgctcctgctcctgctgctcgacgctgacggctcgagcttatccctccggcctccggggtctcgctctctggattattcctacttctttttctttctttttgtctcatcttgaattgaaaaacttggccctgcggtgtctcgcctccactggtcactggagcactggaccgatatatatatagagagagaccgaccgacctggcgtcacgcacgcaccgcactgattgggctccaagatcggccgctgccaactggggggcctcaccgccacccgttcttggaaaacagcacgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatgaccttatccaggaaattagattatcaggtgcttctatttgtttgtgcatctcttgtttgcgcctgcgatctggaccttttttggctcctcaacaaaagagaagatgagcctttcttgttggtagttacaaccggtggcgtctcttgttgtgcaggtgcattttgtgtgaggatccagacgcaggaggatggctctcaagaagttgctgcagctcttttgtgtcggaaagaaggattccaagaagaaaggtaaattcatcgatccactctggcaagcctctgcctcccgctcctctgtgaatgtcactgcaaacaagactcatttggatccctgttcaagtgggaatgacactgtaagcgtgcaaaaccatgaagttgaatcctcaagtacggtttcctcgtgggcaaggacagagcaaggaactgagattgctcatcatacgccctttagtcaatttgatgttgtccaagatttctcggatcaccactatgcaaagacttcagcaggaaaggtcacaa

SEQ ID NO: 24495 - DNA, 2737 bp, Zea mays
tacccatcacatttatcgaggttggtggttatgtattcttgacatactatgtcattgggttcgacccaaatgtcggcaggttcttcaagcagtatctgcttctgttagtagtcaatcagatggcagcatcactcttccggtttattggtggggtatcgaggaacatgattgttgctaatgtcttcgcatcgttcatgttgctagttgtcatggtgttgggaggatttattctagtaagagataaagtgaagaaatggctggatctggggctactggatctccccaatgatgtatgcacaaaatgccatttcagtgaatgagatgttgggccacagctgggacaaaatattgaatagcactgcatccaacgagaccctaggtgtgcaagtccttaagtcgcgtggagtattcaccgaagcaaagtggtactggattggctttggtgctatggttggtttcaccatactcctcaacgctctcttcactgttgcccttacatatcttaagccatatggcaactcccggccatctgtatccgaagaggagctgaaggagaagcatgcaatcatcaaaggggaggttctggatggcaatcacttggtatcagcaagcagtcatcgatcaacaggagttatccctgaaactgattcagcaatcatggaagatgattctgccttgcctaaaaggggaatgatcctcccatttgtcccgctctcgctcacctttgacaacatcaaatactctgttgacatgccacaggaaatgaaagctcaaggtgtacaagaagatcgtttggagctcctcaaaggtgtcagtggatcttttaggccgggtgtgttgaccgcactgatgggcgttagcggtgcaggaaaaactactttgatggatgtgttggctgggagaaagacaggtggatacattgaaggagacatccgcatttcaggatacccaaagaaacaagacacatttgcacgtgtatcaggatactgtgaacaaaatgatatccactcgccacaggtgacagtctatgagtccctgcttttctcagcatggctccggcttcccaaggacgtcgattcaaacaacccacgcgtccgcattgaggaggtgatggagcttgtggagctcaaaccactgagaaatgctttggttggacttcctggagtgaatggtctgtcaactgagcagaggaaaaggcttaccattgctgtggaacttgttgcaaatccatctatcatctttatggatgagccaacctcagggcttgatgcccgagcagctgcaattgtgatgcggacggtgaggaacactgtcgatactggtagaactgtggtctgcacgatacatcagcctagcattgacatatttgaagcatttgatgagcttttcctcatgaagcgtggtggagaagagatctatgctggtccacttggacatcattcttcagatctaatcaagtattttgagtcacttcatggggtcagcaaaattaaagatggctacaatccagcaacatggatgctggaagtgaccacaacttctcaggaacagattctaggtgttgatttcagtgacatatacaagaaatctgaactctaccagaggaacaaggccttgataaaggaattgagccaaccagcaccaggttcaactgacctgcatttccctagcaagtatgcgcagtctttcattacacaatgcgtggcttgcctgtggaagcagaacctgtcatactggaggaaccctccttataataccgtgaggttctttttcactggcataattgctctcctccttggcaccatcttttgggacctaggcagcaaagtgtatacatcacaagatttgtcgaatgccgtgggatcaatgtactctgcggtgctgttcatcggggtcatgaattgtacctcagttcagccagtggtggccgtggagcggacagtcttttaccgtgaaagagctgccggcatgtactcagctttcccatatgcatttggccaggttgtcattgagctcccatacgcactggctcaggatatcttatacgctgtcatagtgtactccatgatcgggttcgagtggacggttgctaagttcttctggtacctcttctttgggtacttcacgctgctctacttcacattctatggaatgatgaccgtcgggctgacgcctaactaccacatcgctgcgatcgtctccgcggcattctacgccatctggaacctcttctccggattcgtcatcccccgaccgaaagtgccgatctggtggaggtggtactgctggatatgccccgtggcgtggacgctgtacgggcttgtggtgtcacagtacggtgacatcatgacggagatggacgacaaaaggaccgtcaaggtgttcgttgaggattacttcgacttcaagcacagctggctggggtgggtggcccccgtggtggtggcattcggggtgctctttgctaccctgtttgcctttgccatcatgaagcttaacttccagaagagataacgacgataggagatcggaaatcccctcctggataagtgattttgcattggttgggtcgtgcatgtagattgggcttgtgcatattctgctccttttctgggaggatgatggtgtagtattttgtaaagaattgttctgcgcatctagtaaattctgtaagcgtgtagtcccttgcaaaggatcagctggagaaggcgaggaaatacctcgtgcgttgctgttg

SEQ ID NO: 24496 - DNA, 4252 bp, Zea mays
  misc_feature (584)..(584): n is a, c, g, or t
tactctttttttctttagggatttgtccccatgtagttaaaatggggttttacctaaaggtttttaacaaggcaaccgttgtaaataactctttttaaagcatggtgatctattttttatgtttggatgtatggctaatggttgtatggctatttcaatctgttgcagtgctgctgtgtactttatgtatgtatgacctagtatgatggctcataaaacttgtgcttttatgcttcaatgctttgtaacttgtatgattgtatacttgtattgtatcatgtatggttgtaacttgttgtaagttgtaacatgttcctatatttgtattgctggttacttgctgaatctgaatggttgttgtaatgctgaactaaatggttgttgtaataatgaatggtatgtcgtttgctctgcactgtgccactgttgtttatgaagcgggttccgggccaccacggcctagaagcccagccaagacggcccggttatagacattagtgtcgtgcttgggctggcgtgcaagcccacgtgttggtacgatgtttaatcgtgtcgtgcctcagcctgattaatttggtctagcngtaacatgtttgggccgtgttggcccaacgctgtctattgactttaatctatatcggcttttactaatttctatggtgtttttgtctctataaattacagctatagcagtcaaaatagttggctttaatctgaaactaacagagcggtatatacttatccagccacaccagaaagcataatcattggagtcgcgcgcatgcatgatgtgggggtttccatgcacggtggagagggtggtggaattgagtgcagcagcagtggtggccaaaaagggcagccatcattagcgtctgcgtatggcaagagaacattattaaggacgcacttagatggcgtaaaacccagaagagagcaggctggttcgcaaagcagaaaaaagaacccccctgaattcgagtagtaagaaagaagtaggtggactataatagatgtcatgtcaaatttgatgacgtggaataaagataaatagagaggagagaaacaaactatcactaatagccacctaagagtggattactcatatattttcaagacagcttgtgagagaattaagggtggctctaacattagggcctgttcgtttcgcatggaatgaaggggtggaataaatctggcttggatttcttcaataattattataagttttagagatttagaattaatcctggtctgttccggcagaaacgaacgggcctttaaggttttggaacctttaaaactaatagttagctattaaaaattagttattagattccacacaccatcggttaatactatagctaattgtcagctacctcacacctaacaactatttcattagctaactcaacctagctaataatttattagctgactaattattagttctaagggttctaaataggatctaaatgtatagcttgtattataaaagaatcgaacttttagttggcacgtgacgtgacatggcaaatatcataaaacccactccattattaaccatgcactaaagcagagccacctgcacccacgtcctcccgggcggctccagtgctttcgccgagaggaaagcgcgcggttgcgagcataatgatggattggaacacgctttaatcttccaaacagtgcgtgcgaggacacttccaggattgcggccgcaatcatgctgccatgcaatacacatcatcaacgagtgcagtggatggacagcagctttgacactttgttcagactgcaaggcacgtagttgtatcgaaatcgagagcgcttggcgtgagcaaacactaggccgaaaaagaagggggggcaagcacgcctgcagccatttgctatcatcccccgtgcgtttctctgtcgctttgacagggactttcagtatctctcgagcagtggcatggttagtaaggggcaggtgtaatgtaacagagcagtattgcaataatcttcagcaactggaagaatcagcgagagagaagcgggaaaaagggaagaaagaaggatgaaaaagatatatgcagagcaaggcatggcatagtgagctcgacgatggtaaaacaaccacgagctcactcacagtcacagcctgcctgcctgccgacgctgtcactacacaaatctcaccaccatccgacacgctgcaaggtgcaaccgatcacactcctccagatcttcagtccccctcctcttccaccttcggctcgatgtccttgagaaggccgacgatctgctgcatggcgggcctcttggacggcagctccgcggtgcacaggtaggcgatcctgagcgcctcctccatctgccgctccggtcccgtgtcgcggatcttggggtcgatgatgctcggcgcgaggctcgccttcaccatcgccctggcccagctcaccaggctcgcctccttctgcgccccagggtactcgtcgcccagcggtttcttgcctgtgaccagctcgaacagcacgacgccgaagctgtagacgtcggacttggcggtcgccgcggcgttctccgagccggagaactccggcggcgcgtagcccggggaatggtgtagcagatcggccctggttcctgccaccatcgacagcccgaaatcggacagcctaggctccattgcgcagtcgaagtagatgctgcttgccttcacgtcccggtggacaatctgcgggatacagccatggtggaggaatgccagcgcccttgcggcacctagggcgattttgtgccggaatatccatgttgcagtaccttccggcgtgacgatttcagttgttgcaacaccaccggtgttgtcctcccatgtgtcgccactccagtcttcggttgcctgaactcctagtggcaagtcgtgcagtaggttgtgcagattgccgctttccatgtactcgtagatggcaatcctctgaacccctgccacacagtaaccagtcaagggaactaagtttggatgtttgatccgtcccagccgctcgagctcccttgcagcatcttggtctccgattgctgatccatggaccaacaccttcacagcaacttgaattccaccaggaaggaatcccctgtacactggcccaaacctgccttctgccaacaaggtgcccctgtcgaagtttgatgtcgccgccaagaggtcagcaaatgtgaggctcagcaagggcttctcaaagatgacaaccggcaccgaagttgcaaccttcacatcagcaacccatgtagttgaatcggtctggaaagaaaatggccctgatacagcaggctcatcgaacgacgacacctgcttaaccacaggcagctcatcacacctcttcctcccccttcgacatgccgctgccaagcaaagcaacccaagaacagagaagaacaaggagagcacagcagccagaaccaacttcatccccttatgtttccctctacttttcacgatactgtctggattcacagcaattgggcagtcattcctggactgagcaaatgcagtggcaaacgccgccgcagagagctcagatgcgcaaacagtcaggttgttgtatgagaagttgaaccgatccatggatgtcagcttcttcaccaatgccacaggtatctcacctgtgagattgttcaccgacaggtccagcaagtgtaggccaagagaactcatgtctgggactaccccactgatattgttccgtgacaaatcgagaaccttcaatccaaccattcgggaagagaaatcagcaggaatttgcccatgcagcccagtgcttgaaaggttaacatactctagcccagatatcccacccatggacagggggggggggggggggggaagctggttgtgtgcaagattcacatgcctcaggttcgggttccggccggccccgggccggcctcccgtgagctcgtttcctgacaagtcgaggtacaccaacgccgagccggcatacccactgctgaaattcagcccagagaagccgttgttgctgaggtctatcaccctcaactgctcctggaacgccccgatgatggagccgcggagcctgttgcccgacagattgagacgggctagcgagcggagtggcgacaggtcgggcaagcccccgtcgagtgcattgccggagagatccatagccacgacgctcacacagccgaagacgatggcgttggggacctgtccctggaactggttgtggctggcgttgagcacctgcag

SEQ ID NO: 24497 - DNA, 1138 bp, Zea mays
  misc_feature (1133)..(1134): n is a, c, g, or t
gctgaagagaacatttctaagtactgtgaccaattacggcaagatttaattccaatgaccagaaatatatatgttgcactcattgttgcatacgcaagacttggtaattttgatatggccaagcaggttctactcgataaagaaataccatgtaagttcctcagtgacatcaagagcgcacttgtaggagcgctggcattaaatgggcaagtgtcggatgcacttcgcttgcatgatgagataatgcaacccggcggctccctggaaccaaaagctgccattgccttgattgagcatattcgaacagaaggtgaactggatagaatgcatcaacttctcgatgggctgaatgactcaaacagctggtttgatggctgtggcagagtacttttatactgtgtccagcacaactatcctgatgctgcaattgatctacttaagcagatcagggagaaagatgaaatgagtacatatatggttgttgatcaggttttttgccaaatatgggacatggagaccacaaatttggattttggaatggtgtttcttgatgctgtcaaagagcttggacttaatgtttctcggacaagccttgactttcttctcagcgcatgtgtaaaagcaaaggatttgcgacgtgcccaacagatctggacagaatacgaatctgctggtcttccacacaacgtgctgagttccttgaggatgtatcaagcttttctttcatctgggggacgtaaggcggctaagaagttgttgaaaaagatacaaaaggaagatgctcacgtgcgctacataacagatgcttgtcgtgcgacatactgcagtaaagacttcaagccttctgctacagttaggttaagttccaaaggaagagctagatcaaaacctactaatgaggggtaagaggtctatttacttttaccacttccgttgcagtgaaatactgaaacgggatgaaatcaattcttttgttctgggaaattcgctcgtacttgttaactcctatcgctttggatcttagagactagggtgatcattgctaacatcggattatatcttaagcaattggtggagccatggagattttctgattttaaaaaaaaaaaaaaaaaaaaaaaaaaaaaaaaaanntcga

SEQ ID NO: 24498 - DNA, 1407 bp, Zea mays
gtataccaacatagttcgtttaagtctgattccattcaaagcgccgctttgtttttttttttttgttatacgtattcatgtaaactttatttgaaataaaacatgctcgtaaaaaaatggtctaacacgcgcgcaatgcactagtctgttactattagtgctgctatttcgctttgcattgatagttcctgcttcacctcatgccctcgcaatggcaaccagctgcttgcctacatttttccccgagaacaacccgattagagccgccggcgcgctctcgatcccctcagccacatcctccacgaccaccaccttcccctccttgatgtacctggccatctcctcctcaaaccttgcgtacaggtggaaccagtcaagggcggtgaacccctccaccctgatggcgtttgagatgatgtagaacagattgcgtaggccatggccgtcccgttcctccaggttatactgggagatcatcccgcaggcggcgaccctgccgccatggcgcatgtgcagtagcgcggcgtcgagcgtcgcgccacccacgttgtcgaagtagatatcgattccatcggggaggcagcgcttcagcgcggcgccgaggtcgctctccgacttgtagttgaaggcatcgtcgaagccgaacttggtcttgaggaggctgaccttctcgtcggagccggcgctgccgaccacgtagcaaccggcgatctttgctagctgcccgacgatctggccgacggcgcccgacgccgccgagacgtacacgaagtcgcctttcttgggcctggcgacatgggtgaacccaccgtacgcagtgagccctggcatgccaagaactcccgtgtagtaggagagcggcagctcggtgtgtttgatcttgtgcagcgattccggctgggtgacgagggtgtactcctcccacccactcagcccccagacaagatcaccggcggtgaactcagggtgcgtcgagccgaccaccttgcccacaccgaaattcaccatggcctctccgatgacaaagtccgaggctggcacggtggcgccgtcttcatgcttgctcatgcgaccgcgcatccaggggtcgcaggacaggtagaggttcttgatcagcacggccgtcagccccgctggcacacccagctcgatagtgtccaccgtgatctccatgtcttcttccgtggggaacccggtgacgtgcctccttagcaccaccttcttgttcttctccaccaccatcgccgccttacgtccggccatttcctcaaccaatgaacagagatggctggcttctgtactggaactacgcttagcttgcagatcgtctggtatgctactgcatgccgatcccggccggcgaaacaactcccggccggctcgcccggccggcctcgaggtacccaa

SEQ ID NO: 24499 - DNA, 2123 bp, Zea mays
  misc_feature (2101)..(2101): n is a, c, g, or t
ctccctccccctctcctcttcttgtcgccgtctccctgcagcgttacgctggcggaaaagaaacggacgagcgagatcaactggcggctcaagaaaccagagggaggagtgagtgcacgcaagggtcagagaagagccgagagagcgcgcagcagtgcagtggtgctgtatccgctgcattcttcctccccctttggattccctgactcgcatggtatctggtcagaaaggcacaggctttagtgtgcccgttgctgttgtaacgcccctgtctgctcctgcggaggaggggtgcgcgagacgagagacgcgggaaggagagggacggaggcggggaggagtagtggtgaagtcaatgccgccgccatcgccgctcctccgctcctccgccttcgtcgtcttgctgctcctggtgtgtcgcctgttggtggtcgccaatgggagggccacgccgccttctccgggatggccaccggcggctcagcccgcgctgcagcctgcacccaccgccagcggcggcgtggcctccgtgcttgcttcggccgtggcgcctcctcccttaggtgtggttgtggcggagaggcaccaccacctcagcagggagctcgtcgctgccattatcctctcatccgtcgccagcgtcgtgatcgccattgccgcgctgtatgccttcttgctgtggcgacgatcacggcgatccctggtggattccaaggacacccagagcatagataccgcaaggattgcttttgcgccgatgttgaacagctttggctcgtacaagactaccaagaagagtgccgcggcgatgatggattacacatctttggaggcagcgacagaaaacttcagtgagagcaatgtccttggagttggtgggtttgggtctgtgtacaaagccaattttgatgggaggtttgctgctgcggtgaagagactggatggtggggcacatgattgcaagaaggaattcgagaatgagctagacttgcttgggaagattcgacatccgaacatcgtgtcccttgtgggcttctgcattcatgaggagaaccgtttcgttgtttatgagctgatggagagtgggtcgttggattcgcaacttcatgggccatcacatggttcagctctgagctggcatattcggatgaagattgctctcgacacagcaaggggattagagtacctgcatgagcactgcaacccaccggttatccatagggatcttaagtcatctaacatacttttagattcagacttcagcgctaagatttcagactttggcctggcagtgactagtgggaatcacagcaaagggaatttaaagctttctgggactatgggctatgtggctcctgagtacttattagatgggaagctgactgagaagagcgatgtatatgcgtttggggtagttcttctagaactcctgctgggaaggaaacctgccgagaagatggcacaatctcagtgccgatcaatcgttacatgggccatgcctcagctaactgatagatccaagctcccgaacataattgatcccatgatcaagaacacaatggatctgaaacacttgtaccaagttgctgcagtggccgtgctctgcgtgcagccagagccgagttacaggccactgatcaccgacgtgcttcactcactggtacctctagtgcccacggagcttggaggaacgctgaggatcggcccggaatcgccctacctacgctactaagaagcagtctcccatttgagtttggaattgctgattcagtatggcttgtccaagtggttcaaaagctccagataagttatgaggtcgagcacgggggttattgctccttgcttgcattgccttccttccatggtgttttgtcttgagtgccaatctgagacatgtcggagtgaattggcacggtttttgggtttgtggaggagggctatgtatttcttttggctatataagaaagtaaaaaaagaaaagaagaagaagcccccgtatggttctgctaaaaaaaaaaaaaaaagagcggcctccacactaactcatctgtatcacctttagcacctacgaaaccatgtcgattcatttcaactgctactntcttttctagtacagtgcctgg

SEQ ID NO: 24500 - DNA, 1067 bp, Zea mays
aagatttgcaagcagcctctctctcatgatctggacaagtttactgtaatctcatcgcgatggatcttgtagtcctgagccactctatccagctcagacattagcaactgtttgcgtgcttcaggtattttcaggaaaagcactcgtctgatatctggaattaaagaatgtataaaactaatgatttgactcgccagagctaaatgcttagatgtaattgatttaagtccagacacctgcatggcccctgcaccgagaacaagttggcaagtcctagtgttgaaaagcttcaatatttccacaacacgttggaccacctccaaagatagtgatggtaaacatttactgatgtcaacatattcagataacatcttcaacagtatcaaaccgcagtttaccatatgatagccaacacctccatgtacaattgtttgcaaggtggatttcagattcccggcaacattatttgcactctgagaagtggattcaacctggttttcaccagtcccggatgttactttgccattatcagcattattttcagcagaatatgtcagttcttgacttgtaggctgatgatcactgaactttgagttatcatcagtgctaggcatctccatgccattaacagaagagtaagtggatgaaagtgaaagaacgattgcttgaaactcttcaggaacatccacagcaacccacgtctcttggtctagaactgccttgatttttgtcatccgaacattatgctgataatcaacgaattgcttcgattgttgatgtaggattccacgaatgttgtaacccaacctgcctccaatcttttctgtagcagctataaattcttctgttatgctgtagatgatcaagaattcttgaagccttaacctgggatgtaaagcagaacgaacacctagcagcttagcccaccgtccatgggcagcatcacaagccgcgaaaactgcttcagtgttctctctcaagacatcagcccgaacattctttaacgaatttataatggaaaaatcatttgtttttccttggacaaatgggatcttggaagtatcact

SEQ ID NO: 24501 - DNA, 2853 bp, Zea mays
gattttagtatgcatctaggcaaataacttttactgtatatctagaaagaaccagatggacttataattggaaacggaaagttctgtctatactagcatttaacaattgattgttttcgcaccaggaagaataattacaaacattacaggaataaaatacatgggggtgccatctcaacggcatattcgatacaatggacctaacagcatgaagcagaagcaccatgcaaaaataggtcgtgctgccaaaactcagatttcctctataccagcatctaaccgatatcagcttcccaacgggaaccaaattgctattgtaacaaaacaaaacaaaaaatggcctgaaatggcaaagtgtggagccaaaatttcatcttgggaagtgctaagattagcacatgttactttgttgacatcagaggagctgatttttttttcacaaccccgcacagcaacacctgcacagagttcacgccaaaaatcggcaacatcttggagcacttcacatctaacatatattcgatattccaccattgaacatttgtagacatgagtcagttcctagtgcacaatcattcaccaacttttgtcccaaagttctcagccaagaattcatcaagaagaccataatttggaatagtttctgaactgaagttctcagctggcaacttccggatgcatgcaagaatatgctgaacatctcggcataatctattctttgccagaggagtactgacttccaattttgaaaatgcttctgtaatatgtgaatggaatatttgaaccacttgcctgaatattgtttgcacctcaacctcaagcaatgtttgggaaagaatgcgatgcaaataggtaacttcctttgtaacagctttagcaaattgactcggctgcacgtcattatcctctgggccattccagccttccacaatttggggtaattttctaagatttgcaagcaacctctctctcattatctggacaagtttgttgtgaatttcatctcgatggatcttgtagtcctgagctactctatccagctcagacattaacagatgtttgcgcgcttcaggtattttcaggaaaagtactcgcctgatatctggaattaaagaatgcataaaactaatgatttgactcgccaaagctaaatgtttggacgtaattgatttaagtccagacacctgcatggctcctgcaccgagaacaagttggcaagtcctagtgttgaaaagctttaatatttccacaacacgttggaccacctccaaagatagtgatggtaaacatttactgatgtcaacgtattcggataacatcttcaacagtatcaaaccacagtttaccatatgatagccaacacctccatgtacaatcgtttgcaaggtggactttagattcccggcaacattattttcagtctgtgaagtgaattcaaccttgttttcaccagtcccggatgttactttgccattatcagcaatatttttagctgaatatgtcggttcttgacttgtagaccgatgaccactaaactttgagttatcatcagtgctaggcatctccatgccattaacagaagaataagtggatgaaagtgaaagaacgattgcttgaaactcttcaggaacatccacagcaacccacgtctcttgatctagaactgccttgatttttgtcatcttaaaaaaataatgaaagtttttagtttcaaaaattaggggaaagggaaacacaatttagtttagctagtcttaactatcaagggccttggataatccaaaactcacatgatttgacttttgaacagccagagaagatgaacttcattaattgaaatatattattccaccaccattttgatctaaaaaatagttcccttcgttccaaattatgtcattctagcttttctagatacataataaaagctagtatctagacatagtgtatatctagatgcataacaatttaacaaaatttatgtatctataaaagttagaacaacttgtaattcaaaatggaggggggtatttcaaagtaaagatcaactattgataatgtaaaaatgggtataataatcaaattgagcatccgtgctgtattcaacttgatggacaaccagtcatccataactgagggaaagttaagtgatttttttccattcaataatgatggtcaataattgttttggaagtttctaatcaaataggtgaaatttgaataatagggtttaacttcaaccgttcaacgacataactgcaacattgttttactgacccgaacattatgctgataatcaacgaattgcttcgattgttgatgtaggattccacgaatgttgtaacccaacctgcctccaatctacaagaataaaaggctaagataacatataacttgcttatatgcaataaatgcaaatgattttgtgtatttaatccaaacaagacgtaaccttttctgtagcagctataaattcttctgttatgttgtagatgatcaagaattcttgaagccttaacctgggatgtaaagcagaacgaacacctagcagcttagcccaccgtccatgggcagcatcacaagccgcgaaaactgcttcagtgttctctctcaagacatcagccctgcatgaaatgataaattgtgataatctgctatagtaactgatcacaggcataccgtgacatcagaaatgaacttataatttgcatcttcacatggaatagacaatagagcttataatttgcatcttcacatggaatagacaatagagggcaagttgcagcttaacttaccgaacattctttaacgaatttataatggaaaaatcatttgtttttcctggacaaatgg

SEQ ID NO: 24502 - DNA, 9212 bp, Zea mays
  misc_feature (4915)..(4915): n is a, c, g, or t
tctgtcatgctaatcacaagacaaaattgttggaattcaattccccacgaatatcgaatacagaaagagcctcatattgtgaagaaaaccgaagaggcgaagactaaccttagaagttcagattgtagtagaagtagtagtatcaactctcaagtgtacaggacaggagccaaactcgtgtacacaattacttcaacaaataattcacgaaagagcaatcaagtttatcttttcgaacaatctgaaccttcggataatctacatatccaatctgagccttgggatagttttattcttagcaagccagaaattggacctcgggctctctgtttccaggccttcaggattttcatcgccaagcaggatcgacgtcgagctgaaacaagcaaaacgatggctattggacttccggtttttgctctaggccaatccaataaacaactcggtgtttgcgacgccaaacaaatggctagctttaggactaagtatatgcggtgaggttgcttcttgaggtggttttgttcaacataggcgtttttttttcctccagttatgctagctacgggacgtcctcaccacatcaatatatacagtataactataaatcatatttctatagctattgcagtctaatatccacatcaatatttataatatacagttgaaacgtttgcaacatacatctaaactaattaaaacacttacagcatacgtttgcagcattgacgacgctgtgaatctccgtgacgtgcgcagatatctttggcgcgaagctcggttgcagggtgaatgtaggtggacggcacggtggtgacccggctgtagcccgacggcggcgggcggcggcagcagtgccgcggcgatcggcgtgcgcgagcaagacgctcgagtcccgtcactatcgttttctcgtgggctcatggcttcgtgtgtctccaaactccaaagaagccatggcctgcttgctgagttatggttgaaactcgaaatcagaagaattttctctctttcctccctccctactcattgtaaccgttgggtcgcccaaagcccttcgagaattcgacgttgcaccgacgtaccaacaaaggcccagctagtgatcctctgtgtccgtatgttcaaggtccagcccagctaaaaggtccaggccgggaatgcgaaggtttgcaacccacgaatttaagccttcgcttcagtttgtcctcaggctgcaggcgagatggggttgccaattcgctaatcagaagtacttaatttgctggtacatactaaagcatcaagctttttatcacgcaaagtgacaaagagcattattattattctgtctgatgactgatgaagcagccctggaggatgcggcacatcattagattgatgctgagttgatgccgcacgtatacgtctctatgactgagtggtccagcccggagtatcaggaccacctgcagaggccgcgttgatccactcaaacctctgcggttgtgctattccgtttccgcccccggtgtccttattcagacgcggcgtcgttcaaccggtgaggtgaatggagggagcgggatccatccccctcgaccgccagtccggctctcacccacacacaactcggcgggtcgcggccaacacaacccggtccgccgatcccgaggcgcccgcgaccaagctgtccgccgctgctagacaagtagtactagtacggcgtggaccgagtcgccctgcccgcgcggtttaaatacagcgcagtgccctgcccgcccaggcatccaccgagctcgcagatcgcaaccagctcaggcctcaggctcagcactcagcaagcaacgaccccaacaagatcacacacgcactagcgcatacatacacgcagccgcaggcaggcaggcagaggaagctgccgagaatgccgggctcgggcacatgtatcggcgggaagaaggttggcggcggcgccgccgcgcctggcgtgcacccgcggtacgtgccggagagggggcgggtgctcagggacgccctgggctcgctattcggctgcttccgccgccccaccaagacccgccctctgccgcggtgagcggcgaaccgccgctgtggagttcttttcgacggaccgcgccgtccgccggccggtgaaagcagggccgcggcatgcaatggactatggacatcccggagggcaacaaactctcatgtacttacttagtttgatgaggaactccctcgtctttttcgattgtggttgtgcatataaactttacgtattaaaaacgggggttatcatttgcgccatgtattgttccgttgaccctctgtttctggcgcttcattcgacggaacggaacgcagagaggcatagacgaaagggttgcgtgtctgcaacacaccagacaaacaaaaacaaacttctacacgtactccactcctgtcagcgagggttattacagactgagagagacttgcttgcgaagaaagggctgcatgagatagaacaaaataatgaaatgtcgagaaaagtcttaaagtcaaagtcagcttttagacttggccttttggacttcgttttattagttctttttatctttccctctctgtctctatggtaggggtaggggttggtggcggcatctcaatctgcactctgcaggcttgccagcttcatggctgcacacctgcagtgctatctctagtgacaccagcgctatagtttcttacgtactactatataattgattaattgtcccctccatttgaaaaggaatataattttaggctactactcactccgtttaaaatataattcgtttgacttttttaactctaactttaaccactcgtcttattttcaaaaaaaatcataaaaaatctaagtcacatataaaatatatatgataataaacaaaaccacaacaattttttttgtttctcgcaattctttaaataaagacgagttagtcaaacttataatgaaaaaaatcaaatgagttataaattggagggtacctagttacattattttaaatttaactaaatctatatgaaaaaaacgtattgagtatggtacggtaccgaatagacggtattagaccagtcgtaaagtatattttttttattatttatgtttgttctcttttgcggtcattaatatttcttttcgataaacttggtttgaccagagatacagaactagattgctagaattgcgtccattgtcaaaaggaggcggtgttcagtaattgttgctcgcttcaacttggaagaaacaccaaatgcgtgtgaatccgacagttctgcagaaggttgacctagaggtcgacgtcaggctagctagctccattccatctgctagtacagctggcactctgtcgtcacgcggcactccagagcctctgctgcgactcttatacgcagagaacaggtttctggtgcctggtggctgaaacaaattgcacctaacactaaactcaataaggggcatgttatgtttgatagctcccactaaattttaggtcatgttctaaacctctagaacaaattgttagtcacttaataatttgttaactggttttaggtggattgagataactaacaactaatggttaagctaacaattagcttacccattagatgacccgttataaacctcttagctaattttagccggttactattagttctaggccatgtttggttcgagagactaaagttagtccctctattttagtcatatttaatccctaaattgccaaactggtgggactaaaacaatgactaaatggtttttgtctctagtcccttaaggggtgactaaaaggaactaaaccatattaattccatttttttacccctcctttatttcagttgcactaacgaagaaagaatgctaaggggtattttggtcctcttataattcatttattgcattttgaataattttagtctctagaacaaaacaatgtagagactaaattttagtcctctaactaaactttagtctctggactaaaggaaccacgggcccttagaaatttggaacaatactttattcatctaaatttaagtccctagataggcaaacatgtatataaactaaaactagactacactttagttcctattctaagtatttgcatctgtctctgaataaatagatttacagagttgaagtaaaacttaaaccaaatttagagagagagaaatccatcaaaattaatggcagcaaattagtatcattacttgtgatataaaatatatttttcataatatgtttattttaaacttaaaatagtttgacttacgctatgtccagcagcatgcggaaagaactgagcatgcgttttttttttgtgtttccgtggtcgactattcgccttctagcagaaaataaaccctcagcctccgagaatcctagattaatgggtttctctctcctctggagaaccaacacacctaagctcgcgcactggcagtgtgaaaactgaaaagtcgacgatgaccgttcgtccatgatccgtcgcgagccggtttaactccatctccatggacggacggcatgcgaatatgcgatgtggcgtaactatagcatgcatgcatgcatgcatacatggcaatggctgattgatggtccggggtcgaggttggtgcacgaacctgtaatattctcgcagcaaagttacaaagctgacgcggatcgccaggattgcttgcgctttactagctcacacggcaaccgcatgcgaatatgcgatgcgacgggcccggcgtatgcttgtgttgccggaacaaaacaaggcgaacaaaatggatggggtcctccctccgtccctgcaccctggccgtctggtctgcattgcgtggatccgcaccgtggatttcggttggtatatatgcacgtttgcaaaagcaaggccttatttangtcctgtttgatctttctaacacttattaacaagattaaatggctaatggacaaacagttagtcggcatgtttgtaggttaatgtgctaaaattagccggtagtttggcacaatgatccaaacaagccattagatactctagtatttatctcaacccacgtgtattcaggtggattagagtataaattaaattaatttacaccttaggcgtcgttcggttgttacggattggtgggtcagaatgattcctaaccgaattgtttctctactttatataaattttaattagctggaacgattccgggtgcaatccgacacgaacaaataagatctcaatctatccaatctatgtggattaagatgaataatagagtatcggtttctttgttcagtgctccaaaacactttaaacacaccacaatcatacataggtaggagtaacaacctgcgcacactgctctaccaaagagtacggtggtgactggtgacagaaattcatggcgcttttgctcacatcaggtgatcagcctgaaaaggccagcgacacaaaaacgctcggatgggtgagtgctgagtgggtgacagaagggcgcgcggcaggcacgcacacgcacctttccgccgccgcaatccggagcggaggaggccccgcgcgccgagctttttcccacggccgaggcccagagcggacaggtggcgcgcctggccggcaggcggcagcccgcggcctccttccctgcaacttttccacgctccgccccaaatcccaagaaactgacggggcatcggcgcacccacccacgcagacgcaggtaaaagaagcttccactcactcactcactcactcccagttgccccgtatcagccagtatcttcagatcatcaccattcaccacttcaccgcccagcccagccagactctcatcaggcgaacccgtccgtccaccacccgtcggccgtcgccatcgcgcgccacttccgctgcagttctcgcccttttctccctcctttcgcccgctgccggctcggcctcgatgtgcaccctcggcgcgcacgccactacgccagggcgggagccagcagcagcggtagggtagcgcagtgcttatcttctgtctataaaatgggcacgcacgcgcacggcagcagccgcggcctcactttccctgcgcgctccccacctcagctcagcttcagcccgccgctctccaaggtcgccagcgccatgacccctaaaggtgggcgcgtgggggacgtcggcagcaagaagccgactccgcgagcacatccgcgctacgtccccaggagagggtcggtgctgaaggggatcgttcgaggcgtgctgggcctcgtcttcactctgatcagcgcgccggcgaactccggcggccaccgcgtgcgcccggcgccgccgcccgcgcccggagaagggggtgaaagtgatgatggcgcggagcaggggaagtaggtgggtgctggtggggtttatctgcgcactcactctgcggtggcgatcggctctcgacgacccaaacttttatctgggccgtccgttcactgcttgtttgatgtttgtgtcgtcgtagcaactttgcagtacgttttgttcttgcacatgtacctacgcgtcgtgtctccttgtgtttacatcgagtctccaaccactgctagtgcttgtgctgtggttttttttgtttgtttctgcagatggtttttgagcagctgagcagatatatctcaggtgctagtcactccaatttccttctgttaagagtttcttgtttttctcagatgtttttttttttggacaagaagcttgcaggactacttaacgtaaaaacgaatgaaaaaagcaaaatctacatgttgaagatgatatccaggaagaagtcatgcgacatacatgcattttcacggacacgatttttaggtccagacgaccagatcatggattcactttttttccttcttttcttttcttctttggaagacttgggtccagataatctcttccggagctcgtaattctcaagtttaacataagatgtcacagcttgtatgtggagttagtttgtccaatgctaattgcatcggcaacgaaaattaaatcactccaacttgtcccaccatgactcaacaattgctagtgtcgcagtaacttgtaaaggtttagcccgttgagacaatctaatcttactggaattcaattttacatgcagaccaaagtttttttttttttttttgaggggtaatttgttttcttgaactgagggtaatatagtttagggctacatttttatctcaactctaacgctgtttttaccaccggaatcggacacttcatatgctaaaagcaaatagagagagagacggaaaggggagaaatgtaatcaatctgcgcacgaccatcctgtttgtttctggcgaatcctacccctggccctcactcgaagccaattccctccaagctccatgggccatggcgatggttggatatcaggatatttttcaggttccaggttttgagcaaatggttggatcagaaaacatttctgacacagatggcagggtgaaggttgcttgcagaggaacggagtacatcaacagttcaacacggagatgcaatggaacaaatccagatcaaggcaaaatgtctagacaaaactgcttgtgcatgatgtctcactgcatctctcgtatctattccttaaaaccacacacacacaaaagcttctgccagcgaaccaactgcaccaaaatttttggcctagcctttaactttcttggacctctttgggaaaagcttgcgcccctcaaggagaacctgttggtgcatctgctcccacaccaagtcaaactggtcatggaatctatcctggtaccacaacttgagctcaggatagagaaaaccaggatcaaaattccacacgcctctcagtgctgcccggctgtcgactaacttcggaccgatcttcatcctgctaagaagatctcccactctccgttgcctggcaggccccaacacagcggatggtgacagcgcgaggaaatccttggcgtcccgtagacatggcaggacgtcccctttaagcaacgcgcatgcaaacacctgcagccggctcgcaccgtctttgataggtaaactgtgcaacggaagctgccagttatgacgagagaagaccgggctaacgtagcagtagacttggtcgttcagtgggtcatagtacggtttcggatcttccagcggcgcagagaaggtgcagagggaactggcatacttcaaaagccaccctggctttacggtcgttacaccgtgcatgtatagcctctttgtactaagtagctccgagtaaactacaagctctggggcaacttgggcgacagatgatgatcggtgcagatatattgtatcatcaagtgcacaagactgataacgaacggctcgaacctttcgatcgtcttctgatggtttcaaataggtgtgaatcctccttgcaactctatcagcccatccagcgcaaattccttgcccaagaagttcctcttcattcaactgcaatatactgggctcgttcctccaggcccgttcaacctcagcagagtcacccgaattccaagcaaactcctcgcaccatttgctatggcgaaatattaactgcagaagctgctttctcaactttgacatctcttccatggttttaagatgaagtgaattggctctgcagaattccactgggttttctgacaactcaaagaactgcagggcacgagcgatggttaaagcatcactgctagggttagaaaacttttcccgtgcctctctaaccacagccttgagcttcttctgtctcttcctttcccatggaccattagcttccagattagtgttttctactgattcaccataagtgtcacattcatccaattgcttgagaaaaggattagtaaaattcaaacctgatgcagcagcagcagcatatcctaatatgaagttagatctagcaaagccttgctgcttattcttcaaattcttaatcactggaagaaggagacgagaatgtcttgggctcatggggtaccgcgcccgcgcctcgcccataggtgtaagttttccatcactataaagtgcttccaatgtctttaagcaacgctcagcttcaaccaaactttccttgtttggtggtgttgggaaaggaaagttctcaacctgaaattcagcatatgttttgtatgagctaaaaaaaaggctaagaaaaatattgttatctgatagagaaattattaaccatatgctgca

SEQ ID NO: 24503 - DNA, 2223 bp, Zea mays
ggccgctttttttttttttttggccgctttttttttttttttttttgcttttcgggatgaagaaatgtttattcaacaacgtatgatccatcagtccccctattacatactcgtggacgttatcaagggccaaaaaaaatgagtaggcttggagattacatcctaattagtacctccaactcgcagcaaagggaatatacccaaatgaatctgtaaaaaagtaggtaacagtacatcttcacatccttctgcgcgggtgggaatcctctctcccagggaaggaaggtcagctttcgacaattgtcgaatgttttggagtaggagtcggcaaaagggtagtcagtcttgcaaatcccatcgttaatcgccctgtagacagtagagctggcggatattgcctgaagcgtataaccaatccttgaactgaacgtgaagggcagttgccaattcccttttccggttctcatcaagctgcagctcccgaatcatcttttggatatcttccagagcagaacgctttttgctttgggatgtcccataaatttcaggcagtgggaaaggattgcagtttgtaggcccttgcctttcatccccaaaccaactaggaatcaaaaaattggtgaatagatcaggatccagacatgttgctgattcagctttaacatctgaaactccagcaggatgggataatgaatcatgtggatcaacaactcccaacacaaaaggttggtcccatttgttgacactgggatcgacagccacttgtatcatatgttcatgcagttgtgggtagcacgtattgaatggagcaacttgtaatttatggttgtcccccaacacaagaggttggtgatttactcctatgtagaagatgcattcccggcagttggcaatacaaatccgttttgcagctgcaatgatatgcactctttcacaatgctccacttttactaccttaccaacagcaccaagaacaactgtagcatcagaacaaccgtacacagtagcatacttcagcggtgctaatatgtagataacagaatcatggcagttcaaaacctttatagaattccctttgacatcagatgcatgcttgacaacagaggttttggaaaagccctccacaaatgttacatttctgtagtatgcaggattggcacttggtgtactgttccgtgggtgacttgtattggcctcagccatggtcacatcaagatcagacatggtttgctggttgctttcctttgctgcggacctctcagcagaatattccagtgaaaaagctattttctgtgacatccaatcaagaacctgagcagcagggacaggcacatcaggcatgtctggatctgagcatgcaaacaatgtagcagcctggcttaaagaagttccttctgagaattgaactagaaatccaaggtgctcaaaagtctccattgtcaacaccagtgaatcatcaccatcaccctcaacagaatctgccaagagagtaagaatattcgccatatgcttttgcagataggacaactgatgaatttcttcatcagcttgagaaggcataaaacgacggctgttactgcgaacaagctggatcggggagagtgcggagaggtacccatcgaacgcggaggtggacggccagacgtccgccacgacgggcgagtccttgtgcgcgctccgcgggacgagacgtttgtaagactggatgtagaggaagagcagcatgtcgcggatgtccgcggcagaaccatccacggcgccgtcgccgagcgcggggtcctctgccgggagcacagccgcgagcgtggcgagggcgagcgccgcctgctcctgcgggatctgcaacgcctccgccagggccgcggcgcgcacgcgtccgtccggggctgaggcagcgagcttctccttgagctgggcgagggtctgcgccagcgtaccctccgggaagatgagcttggggatgggcaagagcccgtgctcgaatgcctcccgccgcgggcggagcagcgccgcgggggacggggtggcgggtaccggcggcgtcgccggagtcggagaaggggacgcgtccggcggctggtccagggcctcgtcggccatcgcggcgacgcgagaggcgtggagggaagggggagatctgcgatgcgggtcctctcttcttttctggttcatcaccttactaggggcatgttttcgccaagtttctaagaaacagctttttat

SEQ ID NO: 24504 - DNA, 1538 bp, Zea mays
  misc_feature (75)..(75): n is a, c, g, or t
gttccgggccccccctcgaggatttttttgattctaattcggtaagacacgatttatcgtctttggcagcagccnctaagcaaaacggaatgaaatgtttatttaacaacgtttgattcattagtccctattacatactccgtggacattatcaagggccaaaaaatgagtagaaacaggggggaaattaagcaatatcacatcctaattaatacccaactcgcagcaaagagaagacttggagaaatacgcaaatgaatctgtaaaaaataggcaatagtacatcttcattttttacatacttgtgtaaataccgcaggtgagcagggtgggagtcctttccatggaaggaagaggtcagcttcgacaatcgtcgaatgtttttgaggagtcggcagaggataatcagtcttgtaaattgcaccattaatcaccttgtagacagtagagctggcggatattgcccgaagcgtataaccaatccttgaactgagcatgaagggcagctgccaattcccttttccgattctcgtcaagctgtagctcccgaatcatcttttggatatcttccagagcagaacgctttttgctttggaatgcctcataaatttcaggcagtgggaaaggattgcagtttataggctcttgcccttcatccccaaaccaactaggaatcaaaaaactggtgaatagatcaggatccagacatgttgctgattcagctttaacatctgcaaccccagcaggatgggataatgaatcatgtggatccacaactcccaatacaaaaggttggtcccatttgttgacactgggatcaacacccacttgcatcatatgatcctgcagttgtgggtagcatgtattgaatggagcaacttgtaatttatggttgtcccccaatacaagaggttggtgatttactcctaggtagaagatgcactcccggcagttggcaatacaaatccgttttgcagctgcaatgatatgcactctttcacaatgctccacttttactaccttaccaacagcaccaagaacaaccgtagcatcagaacaaccatacacagtagcatacttcagtggtgctaatatgtagataacagaatcatgacagttcaaaacctttattgaattccctttgacatcagatgcatgcttgacaacagaggttttggaaaagccctccacaaacgttacatttctgtagtatgcaggattagcacttggtgtgctgttccgtgagtgacttgtattggcctcagccatggtcacatcaagatcagacatggtttgctggttgctttccttagctacggacctctcagaagaatattccagcgaaaaagctatgttctgtgacatccaatcaagaacctgagcagcagggacaggcacagccaggcatgtctggggtctgagtttgcaaaaaatgtagcagcctggccttaaggaagtcctttctgagaatctgactagaaaatccaaggtgctcaaatgtttaaacacaataaagttggaacgggaggggggaaagg

SEQ ID NO: 24505 - DNA, 2284 bp, Zea mays
gttaattgttattcgactcccgtttgggcggattgggttccgggccccccctcgagttttttttttttttttttttcttttttttttttttttttttttttttttgttttttttttagcaaaacggaatgaaatgtttatttaacaacgtttgattcattagtccctattacatactcgtggacattatcaagggccaaaaaatgagtagaaacaggggggaaattaagcaatatcacatcctaattaatacccaactcgcagcaaagagaagacttggagaaatacgcaaatgaatctgtaaaaaataggcaatagtacatcttcattttttacatacttgtgtaaataccgcaggtgagcagggtgggagtcctttccatggaaggaagaggtcagcttcgacaatcgtcgaatgtttttgaggagtcggcagaggataatcagtcttgtaaattgcaccattaatcaccttgtagacagtagagctggcggatattgcccgaagcgtataaccaatccttgaactgagcatgaagggcagctgccaattcccttttccgattctcgtcaagctgtagctcccgaatcatcttttggatatcttccagagcagaacgctttttgctttggaatgcctcataaatttcaggcagtgggaaaggattgcagtttataggctcttgcccttcatccccaaaccaactaggaatcaaaaaactggtgaatagatcaggatccagacatgttgctgattcagctttaacatctgcaaccccagcaggatgggataatgaatcatgtggatccacaactcccaatacaaaaggttggtcccatttgttgacactgggatcaacacccacttgcatcatatgatcttgtaatttatggttgtcccccaatacaagaggttggtgatttactcctaggtagaagatgcactcccggcagttggcaatacaaatccgttttgcagctgcaatgatatgcactctttcacaatgctccacttttactaccttaccaacagcaccaagaacaaccgtagcatcagaacaaccatacacagtagcatacttcagtggtgctaatatgtagataacagaatcatgacagttcaaaacctttattgaattccctttgacatcagatgcatgcttgacaacagaggttttggaaaagccctccacaaacgttacatttctgtagtatgcaggattagcacttggtgtgctgttccgtgagtgacttgtattggcctcagccatggtcacatcaagatcagacatggtttgctggttgctttccttagctacggacctctcagaagaatattccagcgaaaaagctatgttctgtgacatccaatcaagaacctgagcagcagggacaggcacagcaggcatgtctgggtctgagtttgcaaaaaatgtagcagcctggcttaaggaagttccttctgagaactgaactagaaatccaaggtgctcaaaagtctccattgtcaataccagtgaatcgtcaccctcaccctcaacagaatctgccaagagagtaagaatattcgccatatgcttttgcagaaaggacaactgatgaatttcttcatcagcttgagaaggcataaaacggcggctgttgctgcgaacaagctggatcggggagagcgcggagaggtacccatcgaacgcggaggtggacggccagacgtccgccacggcgggcgagtccttgtgcgcgctccgcggaacgaggcgcttgtaagactggatatagaggaagagcagcacgtcgcggatgtcggcggcagcaccatccatggcgccgtccccaagcacggggtcctcggccgggagcaccgccgcgagcgtgccgagggcgagcgccgcctgctcctgcgggatctgcagcgcctcagccagggccgcagcgcgcacgcgcccgtcggggactgaggcggcgagcttctccttgagctgggcgagggtctgcgctagcatgccctccgggaagatgagcttggggatgggcaggagcccatgctcgaacgcctcccgacgcgggcggagcagcgccgcgggggacgaggtggcgggggccggcggcgtcgctggggccagagacggagacggggccgcgtctggcggctggtccagggcctcgtcggccatagcggcgacgcgaggggtggggcgtggaggacgaagggaagatctgcgagtgcggcgtcggaatggcgaggatcgttttcgattaggatgttctaggtaatggtctcgtgc

SEQ ID NO: 24506 - DNA, 1018 bp, Zea mays
ggttagtttctacgtgcccgtttaaactaacgggcgcgtccaacctccccttgccaccgcgacgccaccgcaccaagggaggtcggcgagaaagcaaccgcggaagccatggcgaacaaggcaacagcgccgacctcctggcggtggcggcttctgctgctacttctcgtcaccgtagccgccttatgctggattcctccggcgatcgctgctgtggcggcggccgcagccgcatcgacgtccaatggagcacggaggtcgctgctcggcttcgtggaggcgcaggggaacgcttcctaccactgcacgctctccggtccctgcgttccctgccagtattctgagaagaacgatgaaaagtatagctgcagcgaaactggctatcgcctgcccttgaaatgtgtacaggcacaaaatgctacaaaagaaggaaacatgagcaagcagaggaagatattggatgatgcatccacatcaggtggcacaaaatccgcatcaggtggtccaaagcattatattacttacagaagttgtgtgccgttggttggagaggagaatttatctgttgttggttttgagataatgatggccggaatgttgctagtaagtggcccgttcgtatattaccggaaacggcgcacaaatcttatgcagggagctgcaagaatcccgacaagtgatcctaggttctagtatgggggacatggggtaataacggatcgcatacttgtgttgatctggtctatctttcttgtgattttgcctcttgtcattgtactattatatttcacacatgtaattctggaagaggcgaagtgcttttttagttctcacaggagtaggaaccacagtggttagtctcatcgacctggtttacttgggtcaaatcacttgtgttacatattcaaatttatggttttgttacccccaaaaaaaaaaaaaaaaaagaaaaaaaaaaaaaaaagttgataatttatgcgaccaatgcgatcatttttctgaaaaaaaaaaaaaagtc

SEQ ID NO: 24507 - DNA, 1652 bp, Zea mays
tttgtcgccgggacgatcttcggagtcttcaccactactgtccacatcataactgtcactgtgttatggctgcggcgtggtggtaggcgaggggtatgcaggggagagtggaggaggagagcggcttgagaacaagaacgcagaacgtagcgaggaggtctgtcgtcgccggcggctaaaggcgccaccgtcgaagaacagcccacctctaggaggtaactgtattattcttcgatgccttcttacaaactagcagccagcctttatagtataggcggcagggaacacacccaatcaacttattactttctataatggaaataggaaactctactgtctgctatagcagaaataggaaactactgattgatatactggagataggactcgcctgattgcttccaattcggctgcctgattgcttgcttcctttcctattcttccagctcttctagctcggttgccttattggtggaggttcccttcttgtgcctgcgcccataggtgttcctgtagaagaatgagtccacaacacttcccccctccccctggaacagctcgtcctcgagctgaaacaccggatattctttcttgaagtcttctagtgaaatccaagaagcatcaacagctgcctgtccgtcccaatgtaccaacaattcccatacgccatgtttgagacgagcacgaatgattttcaagggtttaggaaccactctgccatgcacaagaggtggcaactgcactggatcacccaccggaggggtacccacgaaaggcttaagaagagccacatgaaacacattatggatgcgagctgctgctggtaaacgaagacgataagctactgatccaatctgctctagtacttcataaggtccaaagtacttagggcccagcttggtggcacgagctggagtgatacccacggctgtgcggtgatgcaaacggagccaaacccagtctcctactgcaaagacaacctcccggtgcttcttatcatgctgagcacgcattacctcctgagccaacaataaccgatcacggatttcagcaaggaattcatctctatctctgagttgggcttctactgctgccacctttgccgccccctgttcaaattgcagcaaggttggtggaggccggccataaaccacctggaaaggagaaacaccaatagctgtttggaaggaagaattgtagcaaaattctgcccacggtaaccactgtagccaagaacgaggtcgatctcctgctaagcaacgaagatacatagtgataatgcgattagtgacctccgactgcccatccgtttgtgggtgaaaagctgaactgagaagcaatgtcacccctgctaaacggaataattcagtccaaaaagtgctagtaaaaaccgggtcccggtcactaacaatagaacatgggaacccatgtagccgaacaatctcatcaaagaaggctttggcaacaacggtggctgaatatggatggctgagtgggatgaaatgagcatatttggaaaaccggtccaccacagtcaaaataaccgatttcccaccaactttgggaaagccctcaacgaagtccatagcaatatcactccaaacagaagagggaactggcaggggctgcaggtagactataaaggatccccg

SEQ ID NO: 24508 - DNA, 1183 bp, Zea mays
atttgcccggttttgctcctacgtgaaacggtacacattcccgtaaatacaacattattacatataagattgttagtagtatttattttcatctcaacaaaaaaaagagaaagaactaaagaaaagaaagctatgttccgatgctgaatctcccttcaaccaatcagaatgcactacaaaaccgaaccctatcctcatccataaagttaagtgtgttagctgtgtttctaattgtaattgatgcaacattttcttcgtggacatactgcagaatcttgtatgcaccgttcagatatatgcaccgttctttgttttgaacgaaaggagaaaacatcctcgagccgaattccgagcttatcttgtatgttccatgtacgagcgtgtagtcttctcaacttgtcacacggctgcaagcgtcacgctcgtgcatggttggcctggccacagcggttgatcaactcaaaaaatagtatgaaatcagttagcctgtggaagtaagtctatgcaggcaccagaagatcttgcttctctggaaacgccagtgcatatagtagtctgcattctaccatattcaggtcaccctgtatcatcctgatcttcagtatcatcatcaaggataacgtactttgaagtcccattggaagattggatatttgtcccagcatcttcactgtgatgcccttttttgaaccttttatacttgtaaatattgaatagactgacaccaaatattattattgccagcccaagcgcctttaaccatgtaaatggatcattaaagaatagcacagcaaccagaatagtgacagcttccttcacaattcctgctacagtcactgtgacagcgctagtcacagaaacaaggacatattctgtcaaaaccatgaaaaaggccaaagccccacctagaagcagcaacacactgcttcttattatgtgagtagaactatcaaaaaagtgacttgctctgaagtcatgccatggatccatcacgatggaaataattgctgttactattgccatcaccggggcaacatgactcatcaaggtaaaaggattctttaatgcatattcctctttctggagaagaatctgagtcatggaccagcggaaaccagccataacagcagcaagcataataaacataaatccccatagattaaattctgtctctttagcaact

SEQ ID NO: 24509 - DNA, 2241 bp, Zea mays
ttttttttttttttttttcgaatatttatcgtctaatagttcaattttgaagctgctcaaaatacgggaaacaaagttgagatggaccgggccgacttggcactgttttttttttttttgtaataccaatacggtgggaagaacttcaacttgtggtgctcgtgtgtaaaacagtatacagtcccatacatacaacattacatatacgagtgtttattttcatctaaaaataaataaagaaaagaaagctacgttccgatgccgaatctctcttcaacaatcagaatggactataaaattgagtcctatcctcttccagaaagttaagtgtgtcagctgtagttctaattgtatttgatggagcattttcttagtggacataatgcagaatgcctcgttcagatatatgcactgttctttgttttgaatgaaaggacaaaacatatgtactgataccaggttgtatcttgtatgttccatgtatgtgtaatcttcccaacttgccacacggctgcaagcgtcatgttcgtgcatggctgaccagagtaattgatgaactcaaagaatatgaagtcagttagcctgtgaaagtaagactatgcaggcacagatgatcttgcttctctggaagcgccatatatagtctgcattctatcacattcagatcagcctgtatcatcttgagcttcagtatcttcatcaaggatgacgtattttgaagtccaattggaagattgggtatttgtcccagcattttcattgtaatgcccttttttgaaccttttatacttgtaaatattgaatagactgacaccaaatattattattgctagcccaagcgccttcaaccatgtaaatggatcgttgaagaatagcacagcaaccagaatagtgacagcttccttcacaattcctgctacagtcactgttacagcactagtcacagaaacaaggacatattctgtcaaaaccatgaaaaaggccaaagcgccacctaaaagcagcaacaagctgcttcttattatgtgagcagaactatcaaaaaagtgacttgctctgaagtcgtgccatggatccatcacaatggaaataattgctgttactattgccatcaccggggtaacatggctcatcaaggtaaaaggattctttaatccgtattcctctttctggagaagaatctgagtcatggaccagaggaaaccagacataacagcagcaagcataataaatataaatccccacagattaaattctgtctctttagcaactgttagtagaactccaaacgaaacaaccagcatgattccaagaaggctaaagcttggtttctcaagcctgaacataaaagcaaagagaagaatgaaaattggagaagcagatttacacattgtagcaaatgtcacagtaatgaaaacaagtgaaatgttgctcagatttatatcaagagcagtagccaaagctgttgggacaactcgtaaacagtaatccttccacgacattttgtttggccctccctccaggccacgttgctggaaccacactatggccctggacgccacagcctgcatcgtgaaatgcaccgtgttcatcaggaatggcgccgggaacttccacatgtgcttccccagcatctccttgttgtacagagtcaagcatgtgctcagcgtgtaccaacacgctatcaacccaatgaccttcgcaagcaacctcggtgagatcggcagatcatcagatctcaccgtcgcccccgcctcaatgtccataggtgagctcccgccgcccgaggaggatggcaggagcggtaggtcgaactcctctgagtcgtcgctgtcgctgtcgctgatcgccgcagcaacggcagtattggaggcggcggcgacagaggtgtccctgcaccaccgcgagaacgacggctcccttcggatcccgcccactttcttccgctgcccaccaccctcctcccgtgactctcccgcccgctcatcgagctccacggctaccgtcaatggaaccgcgccctccacctcatccgagggatggtgcacgtggccgtcctcgacgacgcagtcccccatgggacggggacggctgaaggtcctacagaagctcggatctggcgtgcgtcgctgatcgcatcagcagcgcgggggcgcgaggtacgcgttgaagagtcggcaacagcggcggttgccggccaacgcgaagccgcaggcgaggggttttgcggcagatttggtt

SEQ ID NO: 24510 - DNA, 2522 bp, Zea mays
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttcttctttttttttttttttttttctcctacgtgaaacggtacacattcccgtaaatacaacattattacatataagattgttagtactatttatttttcatctcaaaaaaagaaagaactaaagaaaagaaagctatgttccgatgctgaatctcccttcaacaatcagaatgcactacaaaaccgaaccctatcctcatccataaagttaagtgtgttacctgtgtttctaattgtaattgatgcaacattttcttcgtggacatactgcagaatgcctcgttcagatatatgcaccgttctttgttttgaacgaaaggagaaaacatctgtactgattatcagcctgtctcttgtatgttccatgtacgagcgtgtagtcttctcaacttgtcacacggctgcaagcgtcacgctcgtgcatgactggccacagcggttgatcaactcaaaaaatagtatgaaatcagttagcctgtggaagtaagtctatgcaggcaccagaagatcttgcttctctggaaacgccagtgcatatagtagtctgcattcttacctaccatattcaggtcaccctgtatcatcctgatcttcagtatcatcatcaaggataacgtactttgaagtcccattgtaagattggatatttgtcccagcatcttcactgtgatgcccttttttgaaccttttatacttgtaaatattgaatagactgacaccaaatattattattgccagcccaagcgcctttaaccatgtaaatggatcattaaagaatagcacagcaaccagaatagtgacagcttccttcacaattcctgctacagtcactgtgacagcgctagtcacagaaacaaggacatattctgtcaaaaccatgaaaaaggccaaagccccacctagaagcagcaacacactgcttcttattatgtgagtagaactatcaaaaaagtgacttgctctgaagtcatgccatggatccatcacgatggaaataattgctgttactattgccatcaccggggcaacatgactcatcaaggtaaaaggattctttaatgcatattcctctttctggagaagaatctgagtcatggaccagcggaaaccagccataacagcagcaagcataataaacataaatccccatagattaaattctgtctctttagcaactgttagtagaactccaaatgaaacaaccagcatgattccaagaaggctaaagctcggtttctcaagcctgaacatgaaagcaaacagaagaatgaaaattggagaagcagatttgcacattgtagcaaatgtcacagtaatgaaaacaagtgaaatgttgctcagatttatatcaagagcagtagccaaagctgttgggacaactcgtaaacagtaatccttccacgacattttacttggccctccctctagacctcgttgctggaaccacacgatggccctcgacgccacggcctgcatcgtgaaatgcactgtgttcatcaggaatggcgccgggaacttccacatgtgctttcccagcatctccttgttgtacagcgtcaagcacgtgctcagtgtgtaccaacacgctatcaacccgatgaccttcgcaagcaacctcggcgagatcggcagatcatcagatctcgccgttgcccccacctcaatgtccatcggtgagccgccgccgcccgaggaggatggcagaagcggcagctcgaactcctctgaggcgtcgctgtcactggtcgccgcagcagcggcggtattggaggcggaggcggcagaggggtccctgcaccaccgcgagaacgacggctcccttgggatcccgcccattttcttccgctgcccgccaccctcctcctcctcccgcaactcttccgcccccgccgcgtgccccacggctaccgtcaacgaaaccgcgccctccaccgcctccgagtagtggtgcccgtggccgtcctcgacgacgcagtcccccatgggacggcgacggctgaaggtcctacagaagctcggatctggcgtgcgtcgctgatcgcatcagcggcgcgggggcgcaaggcacgcggtaaagtgtcggcagcggcggcggccgacgcgaagccgcaggcgaggggtttttccggcagtttggttcgctccgatttctggtagaaaggtccccggccag

SEQ ID NO: 24511 - DNA, 1506 bp, Zea mays
tcgaggcctggcacgggtagtcccaccgcacccgactccttggatttgaattagattccgtcggaaccccggccgccgcccgctcgccggggtcagccggcccacatacacgcgcccgcgttggcgtattctattcgccaagagccaaggggattggggaggccgtccatgttgcgtgttgtttagacgcgccaaaaggcaaaagcgtggaggaggctcatcaagcacaagcacgccacgcgatccacacacggcaagcaacgcccagggctcgtgctcgccccgcgacccgcgaaagatctgtgctggttcgctcgctcgctcgcgccgcgccgccgcgtgggggtgccgatgagctgcgcggggcaggccggcgggtggctgctcgactacgcgctggtggaggaggagatccagggctccgagttcatctacatggtcgacgacccggccgtctccagcgtgatactggggtttgatgctcccaggaaggaggacggcgtccaggacaaccccggcgccaagaagagatcccggccggagtccagcgcgccacccggcaccaaggcttgccgtgagaagctccggcgagacaggctcaacgaaaggttcaacgagctctgtgccatcttggaacccggcaagccacccaaggccgacaaagtcgctatcctaagcgacgctgcccgtctcctgaaccagctgcagggcgaggcccagaagcttaagcaatcgaacgaatcgctccaggagtccatcaagagtcttaaggctgagaagtccgagctgcgagacgagaagacgaggctcaaggctgagaaggagaggttggagcagatgctcaagggcgtcgtcagccacgccgcggtggctgctccggggcccttcgtcccgcaccctgctgcggtcgctccatctttccaccaccacccggcggcgtttgctcaggctggaaagttcgtcccgtaccccagctacccgccgccggctgcgttctggcagtggataccgccgacgtccctcgacacgaccaaggaccccgcacactggccgccggtcgcctagccgacctaccacctcaccgtggcatcattcatcggtgatgcgttgccgtgtgtactgaatttgatcgaagcatgcctgaaaaaagaaaccttggctgctgctcgtgtcaaggacgtgatgtgctgaagttcaggcgatctaggtcggctggagaagtctatgtaacagccataatgctaaagcaatgaaagtgatatattaattgaatcgggctagtgtttcctgaaactacggttatttagacattgcctggaaggctagaacaatgcaaacttgggtaacattgtgacgaaaaaaaaaaaaaaaataccatctccatattcaaactccactacgtgtagagtgcaaaacagtgtttagacaatgaccatataactgaactgctggaggtctaacaatgcaaatttggctaacattgtgggctgcaatatgagaatatgt

SEQ ID NO: 24512 - DNA, 2046 bp, Zea mays
  misc_feature (10)..(10): n is a, c, g, or t
aacaactttntaggagcagaaaagagaagagaatagatggaaagctttgacttttggacttgtaatcaatcaaatgacattcactttttgaatgattatcttatttcacgtagataggcaaaactcttttataacaaaaaactttgaaggaggattttatcatctttttctcaaaatttagacagatgcccaagcgcgcacaagaaaacttggcagaaacctctaattaatttatttgttgttcccgttggagttggacccggcgcccgcggccgtagaaaggtcaattcgagacggaaccttcttggagattctgttgtggttgtggcatgaaaacgcggcgaagcaaaggaaagcagagagcgtccggatccccacgtgcctcgtcgctcggcagccgtcccggcatcaagaattcagcatccaccggctggcacccacgaagcctcgagagccgccacctctcccaggccccctactcggtctcctctcgctatataatgcatccaccgcaccgatccgagcttccccacgcgtccgaggtcggctcatcaacatcaggccatccaccaattcactccgacagctaacacgtttgccgccgatggggtcgtcggtgaagaaggcggcagtggcggagacgacggcgcgggcggtggaccaggcggtggcgtacgtgctcatggccgccgcgctcgccgtcacctacctcgtgcactgaccaccgcgcggtgaactcaagtgccaattttgatacatcctacggaaaggaggacagacaagctggagatgacgtactatgattcaatcgcagcggaggattcgactatctagggtcgccaccgtacttcttatcgatctcaaccaaacccttcgttattgtaaaaaagatgtactacagatcttctataacgaacagtgctcatgagggcaaacatgtcatgcactcatgctctaggataaaagaaaagaaatgtcgttggagatcttccatgcaatggatagtgttcgtgagtgctaacagtacgtgtgctcggtcatgaggcctggacagctatgttacccgtgtcaggatacggatacgcgatacgtcgataccccgatacgccatttctcaaaaaacaccgatacgtaaatatatattataaataaaaataaatagcaggattattagcgacgtgaaaactaccttcgctgccaccggtctcagtagatgcagaagcagaagcatttgaactcgttggccgctgccataggatctaacaagaccagagttatagcagtcaacagattgagaagcaaggagtttgagaagcaagaagggaagataagaacacagacccacaaaacacaccgacgtcgatctgtggatcgatgagcgtcactgtgacacggatcgacgacaatggccataaacccacagtttggcagcggcagctacagacccaccaatcatcaggcgacaactccaatcggcgactgatgaccacagatcgactgcggcagcggtcacaagcccacggctcattaggcggcgactccaatcaatgaatggcggccacatacttcgtggcggcggcaccaatcagcggctggaaggctgatagccacagaccttgctgcgcgccggcgactggcaagctgacggtcacagacctcgtgacgcgccgacggctgctccaatttgtgactgacgggtgacggcgaccacaaaccggctaactgcagcggaggcgaccggaccgacaaactgcagcagaggcggctacagaccgacgaactgcggcaattggggacgcgcaagaggaggcagggaggcggctttgggcagtggttatgcgatacaggagcacgagtgtatactatgaactagggttgggacgtatcccgcaggtatcggagaggtatccatggagtatccgtctttttttatttatttaaatctgcaaaaatatctgatacgtatccggaagtatccgagaggtatccgtatccgatacagtatccgacaccggtacatgagttttgtgaagtatccgcgcaagg

SEQ ID NO: 24513 - DNA, 2684 bp, Zea mays
cacgtccaagactccaagtaatgcacacctaggtactgtttgattcacgaaatgtaacgtaaagggtaatggtaatggtttacaattgattacggacggtaacaagtttgaatagtctggtatcaatttttagtccaaccgtaatcagataccatactaaaaatagatatcagtctattcaaatttgttaccatttgtgttacatttcttgaaccaaaacagcacccaaattcattcgcgaattgcgatgcttcacctccgtgtcgactgttgcgatgcttacaagagacaggacctcgaccacaagtttcgaacgggcttctctgcacttgacactggcagtgcacactacccgctcgcatgcagcacggccgttgtctattatatgatattgccttgtttccatttcacagagaaattgcagtctatcatacatgacgtgcgcctggatcagcagccgtcaagcgcgtacgatgacttgggccaacttattgcaaatagcaaccattttattgaataaattacatattcttacaccaaaatcctctgtagctaagcaaagtggaatatacatttttgctcctcaagctgagtacacactgatagtctaaacgtgaaacccaacagtagcatcgacaaaagaacaaaagaatgatcatagagaagtgaaacgtacagtctttgcctaggtggtacttctgtccactctgctcaagtccacacttactgcccaagcttcctccatatgcctttctttgctgtcaagcacttcaatttgccaaacacaaaaccggacttctgagggttgccatccacaagcgagttctcgtatatctctttgcattcttgtacaacctccttcgcttccttttttggaatgccttcccgcattgccacaagcttctcgacaacctcaggcgggcaatcaggttgatgttccagtatattagtgtaaatgagagtaaagctatccaaactctcagctgaagctagctccctcatatctgccagaatccgcactctgctttcaacttttgtcacgttgatgtgttccctgaagaaatccataagcacctcttcatctaacctcatcctctctatcgtttcttcttttatgtagtttttctgagaaaggagatggtcaacatagaccacaattgtttcctctatgcaagcctccacaaatcttcgaaatgatctttcttcaatatacattttaacatcaccaaagtaatcagcaaatgttgcgacaagatattctgtgaccattccctccagccagtctttctggtaaagcttcacgagtagatcctgcacacctgggtcttcaaaaataacactaacagtttggaggacggcctccttggcaacctcaagaaatcctttgcaggtgtcttcaaaattaacctgttcagcatagttttgtggaagcgcctccaatgtactgctacttagctctgatgaaagttcatagcaacgcagattattgttaatcaatgcacatagagattccagaccaacatcagaagctggctcctcaagcctttgcctctcagctgcttgaaaatcaagcatgacctgaataaccgcaagtgcaattcgatatagcatgacgtctgtgctgttgtctctaactatctgaacttgctcggtcaatattctgaatagatccactgctgcaggtgtatatagttttccatcctctgtactctttggtggttgtgttttgtcagcctccaaaatgttgctgtaccatttcttggttgttgcctgcatacgctcaacatacatgttcatgaggggatccaatgcaccactttcagaacaaacttgggcaagtgattcatccacaccaagaccaatcaagttttcttgatattgcacgacccaaccagtcaccttcaggatatttatattttgaatatcgtttgctctatcactgagaagtcgaagcatctgaatgaatctctcagtatacaggtttaccatgagctggaaaatttcatacctaggaggaaagcatggtgcaacataatcatatatatcgccaagctcatctccaatagctttggcttcctccaaagcttccatcaagtcctccacaaaaacaagctcagtaagcaacttgttgaagcgggcctcaacagccatcctgatagactcatagcatttgtccttgtagccctttccctgaaccttcgatttttcttgagtgccctttcttggggtaactgttgcccctgcacctttttttgcagttctacgttggtttgttattgtcgccatagcaccagcaccctcagcctcagctgcttcttctgcaacttgttgatctaagatctcttgcatttcaacaaccctcaaagctcgaaccaatgtctgaggactctcttttgaaagtttgggacgctgggtcgtccggctccataatgttttctcaaaggtttcccatgttcggtcaacatcctcaaagtattctcttaatcttccaacttcttccttatgagatgaagcagcagctagagcaaaacgcctcttaccatcaagagctgtagtctctcataagtgtgaattaactccttgtcgttgcttaatgagtcgcgtgctgcagcagcctcaacagaaatagacatcatacctcccatatccttagagttgggtcaaattcccggccggccaaaagg

SEQ ID NO: 24514 - DNA, 3169 bp, Zea mays
  misc_feature (2374)..(2374): n is a, c, g, or t
  misc_feature (2869)..(2869): n is a, c, g, or t
agcattctagttctactgctgatcttctgcatggccatggtgaggaacccaagagaccttgaaacatactaggagtactagcagtagaggatttaaacctatcttggagtttgcaactggtatcttcttgcaagatcccaaggccaccgtaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgtggtggcggaggaggccaagaaccggcagctggcggtggtgcccgtgggcacaggaggcggaggcggggcaggggtgaggtaccgcgagtgcctgaagaaccacgcggctgccatcggcgggagcgcgacggacgggtgcggcgagttcatgcccgcgggcgaggaggggtcgctggacgcgctccggtgctcggcgtgcgggtgccaccgcaacttccaccgcaaggagccgccgggcggcgacgggcggcagctgtacgggcaccaccaccaccacccgctgagcccgctggccgcggtgcacccccaccatcaccgggggctgctggtggcggcgcttcccccggcgccgacgcgcatggtgatgccgctgagcgccgccatgcaccatcaccagcagccgccgcagcagcaccacagctcggcgtcagcggactccgacgacgcacacgtgccaggggtgcgcgggggggaggtgcagcagcagcagcaggcaccggcacggaagcggttccggaccaagttcaccgcggagcagaaggcccggatgctggggttcgcggaggacgccgggtggcggctgcagaagctggacgaggcggcggtgcagcgcttctgccaggaggtcggcgtgaagcggcgcgtgctcaaggtgtggatgcacaacaacaagcacaccctggcgcggcgcggccacgccgggctccccggcgacccggagctgctggggccgcacgacggccagctcggcatgccgctcccggagccggcggcggagcccgcagttgctgctgcggctgcggctggacttggagtgaccgaccaagccatgtctttcgggactggacgacattgatcaagagagtctaatgctgactgaatcagccttgcggcatagggaagctgttttctttgttaatctgctgctgatctcatcaatctagccgtagctttagctgcattcgcattccactgttccatccatccatcctagctatccatcaaccacaaactgatgatgcggagtctccatggatttctattccttgttgatttctgtagctgctctccccgctcttgactttaattttttagtgctcgagtgactggtggtttgggaggtgagactgaatcactcactcttccgcctaaaaaaaaaaaaaaaaaatttcatcatgctactgtcgttgtggtgtttagtcagccagccagagagtgagtgctacactagtactagtgattgatcaacagctggtaatctgatacgcctggctgccgtgcatgcttagcaggcctgtaaccgaaagaatctactagtaaattatgatcagattaggctaatgattggtgagagagagagagagagatgtggcgttgagaagagaacaagagcgcacacagatgcataatacgcaatgtggctggctgggccgccggagcgagcctgaattattgctgggggcctggaccctggaggaggagatcatgtgggcgtgcaggggggcaggggagcatgtggcgcgacgtcgtcgaggcgatcccaaaatggatagccacttaatgccgtgctgcgctgcggtgtactgtactgtacactaccgatgcatgtgtgtgcaaccagcgatctgccaaacgcaacatgcgtgatctgccgtgcagtggactacgtactctagcagcagcattgctatcaggacttggtgcttttgatttgatgatctggtttggtttggttttgggggaactgagaaagctttgatccagaagagcattatctctgtttttttctctctcctaggaaaaaaaaacatcctttcagtcttctccttcctagttccctacctcttgtctcacggaaggggagcaagaaagaaacaggtcacatttctgattcctcgccaatggccagaatctcttctgcgcctgaaaaaaaaaacccccgcgcgagagtactagtgtgcagcttctgaagggagcaagcaacacatgcacgcacgcacgcatgggcaagaaccaaggggagccctnttctttatctatcagactcagagtatcagtggccaccagtgggtacatacatacaggtgaggtccagtttatttagatctgaatcggctgcctgattggccccccccccccccgtgctgttctggaccccatctggtgctgggcttcgccactttgcctggcaataatctgaatccagaatgtctttgggccctccctgcaatgcaatgcatgcatgcaggcatgccttgcccttgcccaccctcctcagcacagcagccatcacctgagatcagaccacagcgctacgtagtacgctagacactcctctgttgtcgttaggacgaacgacggaccaggacggagcgagcgagctcgtactgttcgtatcacgggctgctccagctccagtccaatccgacccaatctctcccagcaaagcaaccacactctgctgtactctgctgcgcctgcgccgtgttgtcaatcaagctcgaccgatcggcctcgcgtctncaccgacgccacttgccgaaaagcccggggattaaaaagggaagctactgctgctcgcaccagcatagctacagtgcctcgcgtcgcgtattgccgtcttggttgatcccctctcccgaacgtgctccgatccatcgcgctgtctgaaggcaggcgggcaagcatgcttttaatcatggcgacgctgaacggaggttggtgacgacgactgccgacgagacgagtcggccggtggtgcgctggtgctagtgcggtagtgctcgtgcagcgcgcagtagcatttgctctctcctacgacgg

SEQ ID NO: 24515 - DNA, 1662 bp, Zea mays
ggaccctcgaggccggccgggctctctctctctctctctcaaacaagcttggattcctgacagtgcaagcaaagcaaagcaagcagagccgaagcttggagtatttctcttgcttcatcccctctcttattaacacaacacatctgagagacatacagcaagctctctccccattggccatatctagctcgtagtctacactgcctctaaaccttgacatttcctttgtattcccctttccaatttgcagtagtttgtaggtagaccgcaaggtggttttttcttgcagcaatggcggccaaggtttgacaaggcatgacgtcctgattaagccccctcgcggcagccacaagatttgttgcagcgtgagacaggagctgcggctgcggaggaagtgagcaaaagcatggatctttccggcacgcagggcgagctgccgatggcaacaatgcacgccggcgggtcgccgtacctggggctgcaccacgggcacccacagcagcacaaccatggcgcgaacggccggcacatgtcgccgccggatgtggtggcggaggaggccaagaaccggcagctggcggtggtgcccgtgggcacaggaggcggaggcggggcaggggtgaggtaccgcgagtgcctgaagaaccacgcggctgccatcggcgggagcgcgacggacgggtgcggcgagttcatgcccgcgggcgaggaggggtcgctggacgcgctccggtgctcggcgtgcgggtgccaccgcaacttccaccgcaaggagccgccgggcggcgacgggcggcagctgtacgggcaccaccaccaccacccgctgagcccgctggccgcggtgcacccccaccatcaccgggggctgctggtggcggcgcttcccccggcgccgacgcgcatggtgatgccgctgagcgccgccatgcaccatcaccagcagccgccgcagcagcaccacagctcggcgtcagcggactccgacgacgcacacgtgccaggggtgcgcgggggggaggtgcagcagcagcagcaggcaccggcacggaagcggttccggaccaagttcaccgcggagcagaaggcccggatgctggggttcgcggaggacgccgggtggcggctgcagaagctggacgaggcggcggtgcagcgcttctgccaggaggtcggcgtgaagcggcgcgtgctcaaggtgtggatgcacaacaacaagcacaccctggcgcggcgcggccacgccgggctccccggcgacccggagctgctggggccgcacgacggccagctcggcatgccgctcccggagccggcggcggagcccgcagttgctgctgcggctgcggctggacttggagtgaccgaccaagccatgtctttcgggactggacgacattgatcaagagagtctaatgctgactgaatcagccttgcggcatagggaagctgttttctttgttaatctgctgctgatctcatcaatctagccgtagctttagctgcatttgcattccactgttccatccatcctagctatccatcaaccacaaactgatgatgcggagtctccatggatttctattccttgttgatttctgtagctgctctccccgctcttgactttaattttttagtgctcgagcaaaaaaaaaaaaaaaa

SEQ ID NO: 24516 - DNA, 1509 bp, Zea mays
  misc_feature (162)..(199): n is a, c, g, or t
ggggacggccagctgcacggcctcaagttcggcaagaagatctacttcgaggacgccggcggctccagtagcagcggcggcagtggcagtgccagcgcgaccgcgcctccagcgacgcagcagccgtcgccgccggccgcttcgcctagggccgcgcccggnnnnnnnnnnnnnnnnnnnnnnnnnnnnnnnnnnnnnngcccctcgacggcgcccgcgcccgcccgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcgagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagcaacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccggcgccgcgcaataatcagggctccgcgggcacgttcgaccaggctggcaacacgatggactggtcgctctaggccgggggccgaaataaagcgcagcagatcctagccgcgcagggagatggaggaggctgaaagcctgatgctgcacgctgcttgcttagcttagagcatccagcatgataagagtgatgaactgatgcggtgtcaggagactagtttattctgtgcttcaccatgaactcgtctgtcgcggcgtctatgtagacagacggcacgcagacgtccgtggtttgaagttaccagtatgcttgtcggggactttgctcgcgatgcattaatctcattgttcaccatccagaaatctcatgttctctaaaaaaaaaaaaaaaa

SEQ ID NO: 24517 - DNA, 3827 bp, Zea mays
cattgctgcacagttgcactccccccctcttccacctccacctctcattcaattgattgtttccagttgtcacttgttggttgcattcgctctgcagtctgctcccccgtgtttttttttccagtcccactcccttcattcacagtctagggttttagggaggctacctagacgaagaccagacggtttcaggtccatcataccacggacacgctacaaaactatagatgcgctaaacagtgggagctagggaaagaaacttggctcggtttgacggagcttccatcccatttcatctatggcgacggcttctcctcctgaagctgaacaagaacgaaggaggaaaaaaacaaaagctgctttggcattactgctacgctttaatgcttcgcttgaatggtgctcatgagcacaggttggtctgatggatgctcctcctaaaaatatgatagagtgatgtgactcagcctgcccctgccctgccctgcctgtctgtcagttcgctttgcattagattccaccgctaatactactcgggtatcccagtgaagcctgtcagctaacaagccattacaataagcgattagtagccttgagcctggttatacgtgtggtccccaaaaaaggaacagcaacagtgaggaattttcaaaggagtctttgctttgccgatgcagtagtattttaatttagaggagtcccaactttgcacaggttgacactatccattgttttagctagctagcctgcctcaaatatagcattatacattgtttgtcccctgtacttaaccatactacatcgggcatccttcgcccccgccccccccccccccccccccctttttttttttgcattatgcaaatggtcccccgaggaagaacaagttgtagcctttgcaatgtgttgttcttggcgctgcaactttacaggttgtacgatcctgttcatccggtgtaagatctggaggatttctagtcccttcaggtgctacaccaaactagactgttcctggaacagctttgtttcctttggatacaattagcattttcattcataaatcttaattcagtcatctatctaatttgacatacaatagagagagagagagaaactaaacatgatggtggcgagctgcatctaatttgatatgggtagggcctggacacattaccctagcggcgaccgcaggctttgtgctttaggactaggctacaggagtgtcctcatgtccccagcaaaagagaagggcgccacagttctggatttggggctctctactaaaccacactgccacttatagcaacaaggcatatcattagagaagagctaagttggaccagccaccagtaccacttggcgttattagatggaaacctcattattggtgggtgtgtactgttgtgttaagcccggcatcacacatctctatgaaatgattacacacacactttctctttgcttttcttttctttttagtatggatgtgcaggtgtcattatgagcggcataagacagaggttaatgttaatctttaatgggggatgtgcagtagtacaaccctaacctagggagaagagaaatgttactctctttgatgattgtactggcattcccactggctttgacctaaagtgtggtttcctatatccatgtcgcgctaagcgctatgcatgttgctagctactactgagataaactagtgccttcaacttgctacgtactgtcccaccattcagcttgcactttattctactgtaagagttactactatggtaaatggtttatgcttggtccatggaacttttttactgcctgatttgtttgcattctacacaaaagctatgaatctacagcaatgtatatgtggatttatagaatgcaacttccattacttataaaaattctgttgctgtgccaccaacttccattacctgtaataaactgggatcaagggcgcgtgaatgaacacacctctgtttgtcgcatcaatcgcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcggtaaccaaaagctggtttttaccctgtgatgtcgtctcggcgaccaaagttcccgtcttttttttgtaaccgctaatgttcatgtgcttggtccagaagagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagccacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccagcgccgcgcaataatcagggctccgcgggcacgttcgaccaggctggcaacacgatggactggtcgctctaggccgggggccgaaataaagcgcagcagatcctagccgcgcagggagatggaggaggctgaaagtttgatgctgcacgctgcttgcttagcttagagcatccagcatgataagagtgatgaactgatgcggtgtcaggagactagtttattctgtgcttcaccatgaactcgtctgtcgcggcgtctatgtagacagacggcacacgtccgtggttcgaagttaccagtatgcttgtcggggactttgctcgcgatgcattaatctcattgttcaccatccagaaaaaaaatgttctctaaaaaaaaactggcccgtccatgctgccgctgctgtggtctttacatcaccatggctccgcctccatgcatcatcatttctactgaataataatgtgcttgtaccctccaacgttgccgcctggcattgccaagaatcggttccaagggggtgttgtttaagtaaagcgagaccacaggcacagcgcggctttgcagcatgctcttggcaccagtggtgtggtgtggtgttgctgctgatagactgaccgacggcagaatgagatccacgcagcagcttctttcaaatccacaaaattttctcagtggagaacaccagcacctttcctgcgaaagattttttccccttcccttgcgaattcatttcccttttgcccaaccacacagtctgctgcgcaggtgtttcaatttccttcgctcttttgtccagtctccactgttggttgagcagccggcgttctcgatttcttcactgttctggatctgttgtacaggtcgggactgtagctgccgctgcgctgcgtgattgatggtcggaacagttctgaggaacccacgctcgaaagaaaaccaatagaactgcatcgaccgcaaatgctgtcgtctttcgcca

SEQ ID NO: 24518 - DNA, 1959 bp, Zea mays
aacttgttaccgctggtaatcgaatgtgaactattactatttacgttacaattttgggaaccaaatggcacgttagcttttgtggacgcagcttgcaccgaccaccagaacctcaaaatgttaaattggtacatgcatataatggtaactttcttttgttagttttgaagaaaaattaacattactttttttcaattagtgttgactccagattgattcaaacatgctaagaatttgggagtttaatctgatttgatctattcctttgcagtttacaagtactatggcccgatgaagatgcccatgccctaggtgttggtcgattatatgatgtttctatggttcattgcttcacttattttgtcatcatatagttaagtgtatatctatgcatagtgtgcttgctaaagtaaaatgtctttaatggttagtttggtggcaagagaattgaagaaaatttatgagtgggaaatcccttactgttcaaaatccatggaattgaataataaaggattttctcctccatggatcacctccaaatccattgtcaccaaaccggccataattaagagtctactaggaagcgcgaagcatgcctcctgttctagtcttcagtatcaaagggacaaggtgaaacaccgaataattgttatggtgaaacagatattaggtcaaatagttgttatggtgaaacaccaaacagttattattaaggtctaaagcatcgagggaagtagtaaagttgtcagatgtgaagtatggagggacgtctataccccgtgaaatctccaacgcagctctaacacgaaggaagcaatttaccagtacaacgtgagtaggggtagggcaatgagtagcccgtgaaatctccaacgcagctctaacaagcaatttaccagtgcaacgtgagtagcccgttcgtgtcgttcatggttcatttgcttttgagggccttctagtgcgatctgcgctgtcttagggttgctcggtcgactttcacacatgtcgcagacaatattttttttttttttatgaatcaacacgatattaactgatcgacaaaatgttcaagtaggcccttcccatgtcaactgggccaacaaaatgcaagtgaagtctacaactgccaactgcagcgaaaattgtacattgcggtcggtagagcatacaataatgcaaggagccaggagatcctgacatgctacattcaacaagaaccactatatcagctccggtcctacatttgtcatcacggcgacctttggcacctgaaaaatacctggcagcattggacggatcacatctgcatgtctattgtaagagaagatgcggtggctaccttctcccttaggttgaacttccttgctatataaggcctgacatcttcaacgccgaccaagctttctaagaacgggagcaatttcagcagctccatgtcattgggatcatcaaaccagctttctataggaatgccattgtccaactggaacccaaaggcctgcaacgaggaaagcggctttacatttaaatcctgccaaaacccaacaagtgaacaactaaaagctaattcaagatgaataatgcagatgtactgataacagctgcgcatgatccaaaagatcaatgatgatggatgatagatttcagaactacaaaggctcctgctactgctaaaaagtaaagacactcacactcagcatctccagcacatattaagtcagaagatgatttgtcatgaaatgcacctagggactagccctctatacaggaaacagtaaaaaagattctacttatttgttcaataagatactacttattagtttatattagctatcccaataattctgagaagctatgtaatgcccaggaagtaccatgaaccacgacatgcaggaattccacaccaatacatctttattcatagcgtgttccaactaaaaaaattaaaggacattatag

SEQ ID NO: 24519 - DNA, 2110 bp, Zea mays
acggagaatagttgcttgctctcattactaagactttttagcattagagaatggttggatgaagttacaagtcatgcagcgacgcataggcaaatgctggaatgttgtgtggcgcgcccccccccgagccccttttgtcttttgtctggatcgatgttttttttttaaattctgcgcagatgggataaacccttaccttaacaagcagtccgcagcctgcattccacagaactaccattcttctggtagaggctccttatgaactgtacaacaaccacagctgccacatagagatacagttgctccctgtttctctcccccgtcccacccccgctagtccactaccctagttctgagttcatttcttctacacacagctggagttcgaatcgcctgaccagttgtcaggcccggagcttcgcgaagaggctgccgaaggagaagaagctgctcctgaccatgctgccggagcttggctccgccgctttggccaccgcagcaggcacgcccacgctcttgacgttgagcatggcggtctggccaaactggcccctgagcccctcgacggtcttcatgtccactggctggcccgaggggttccggacgtagaagacgtttgtggcctgcccgcccgccgtcgtcacgtcggcgcggctcaccgtgagcccgtgctcccggagcaccctcgtcacgtccgacagcaagcccacccggtcccggccgcacacctccagcgtgaatccctcggatactcttctggagatggctgcttccaggcacctgatcaccttctctgcttcgtctttcagaagcgttttgccgtccttgcggcggatgtacagctcctggatgccgtagttggcttcggacgacacggcggcatggaacacgacgtactccatgtccgtgagcgtgcacacgatgtcgaacagcagcttggaccggtccttgcacttgacgttcaccacggagtaggacttctcctcgcagtgctccaccgtcacggccggccggtcgccctcgccgccggccgccgcgtgcgcgccgtcgccgtggacggcgtccacgtcggcgtgcatgagctggtgcagccgccggtccacgtggtgcggcgtcgaagaggcggccgcgaagttggcgtgcgcgccgctgccgtcgtcgtcgtcccccgcgccgccgccgccgccgtacccgcggagcacgtggcgcagccggtcctcgacccgggccacgcggtccgggtcgtcgatggcctgccccgtggccacgtcgttcacgtacacgacgcaggccacgcgcatgcggtgcgtccacacctcggcggccagcacgttgcactggaggtcggcgaggaccgcgaagatctccgagaggaggcccctcctgtcgggccccttgagctcgatggcggtgtggtcgccgatggagtgcagccccaccgacctccccgctgagttgctgccctttgcgcccagcaaattgctctccggacctaaagccttctcaatgtacttgatggtcttgtcatcagtgatcttctgcccttgcttatcaacgacatggaacacatccatgaaccacccaccatcagaggtgatgtaggctttgaagatgtgaaggtccacatcgctcgggtcctgcagcacctccagcagaatgccattcttgttcatgctgtcaaccttcaccaaggtgcagtcgctgcatgtggtgttgtcgatgcaaacccttggggggttgatgcgctggttgaagttctcgtactccggatcaaagtagggcagcatcttcggacggagcccgtgcgcggatccttccactttcactagattcttctttcaccctgagctctgcgcctcagataacctcgtctcgtctcgtctgcccgatcctttgcggcggcggcgcttccgattgatcgaccgccttccttcctccttcctcctccctctgccggaattctgcttctgcttgcttgcttgctcggttccgatgccctgctcctacatcgcacgagcacaaaggtgggtgggactgggagagggccagtgaacacaagggccggggtggaagaatcaaatcgagaaaaggaacggcagaggggagggat

SEQ ID NO: 24520 - DNA, 1956 bp, Zea mays
ttctggcagttaagactttattgccatagttaatacatataatgttctttttttttttgtttggttcaattctgtatattaccataccaatgcgcattcctaacaagatcgacatcacttaccccactaatcggttgacgccactcagcaatttgacactggagcgaatctctcatggtctcacacttctcatgccttggacacagttcactctagcgtacctctcttccagttcaaactagaccatatgtgtatattagctctagtacatttggatacacatgactctgatacaactagccttcccttcatacttgagcctagctgtagagttctccaatggaatccatcatcatattcgcgatgacttggttcgtcctttccgttggatggacagcatcccagtacaggtacttgctagggtctccacatgttcttcgccctcggcatgtttgcccaacttcgatcacccccgatccgcagcaccctcttgacacttcagttaggccaaaggtactaggatccaccgttgcatcatgtatggtagtatatgtgtctatgtatgaagtccgtatctggtgctgaaaatttatgaaattcaacagctgaatcagctttgagttgaacgaattggcaagctgatttaacgtctcgtcgcatctgtccgatcctgtgcccactaaagtccgggcaatcggcaagcaacccatcgggggcagtccaacaaaaataaatctccttcctccaagcattatcatggcctgggtataattagcgacatgtgctgtcaggtgattctcatacagttccatactaattgcattcgaccgattcgatgcaaggtagactgaaagcaaatcgtttgtaccagtgcttatcacaaaggcagccctgttaacaagtcgctctgctcttcttggtccaagcagtgttcggataagtagcttgtaacggaagaggttgtgcacttgttcagagaatgacaccacatttattctgttggcagtgctgtcgtcatatccggagccgcctgatgcaaagctcacacccctcctgagctgggccagcctcagatttgggtcaaagaaacctggaataatcctggatatgcctagtttctcagctaacatatctgtggctaaccggccattggtgaatcggccagtcggcctgcgaccgtagaagttcaagccgtagggcaagaaatttgccctggctgtggtgggcagatggttgttgtttccagggtccacggttgagtctccaagtacaaggagtgtagtacagcccgtagtgcggttgatcgtcattccaggtggtgccggtgcaggaggttcctgtggtggcacgaccaaccttggcggtgctggatcctgctgatccgtcggtgctggtggccgtcgatgtggtgatccccgacgtcgtggaggtggaggtggtgatgttggcccaggcgcctgcggtggcgtttgctcatctgctgttggtgcttcgggggactgtggtgcagcctccggtgcatctgctgctgatgctgctcttgcgcagtgcaactccccggcaagcaatgccactatgatgagtagcagctggaaacccctcatggcttgtgttgtatgagcaggagaaatccgcggcaagcaaagagctagggatcgatgcatgtatggctatgcagcactgtaaagtgtggcatgaaatccccatgtatatatgcaaggcctatgagcaaaatgcggtgccctgtgaaacccatgaatcaaaaggcgatctggtgcatgttaggtgggggctggtttggttactctgggctactttgtgtgagcttccattcagatatagagggagagagggatgccaatgtgtgtgttccctggttgagctgaagaaagaagctgcataccgtctgtgctgctgtgggattcttggagagtttgtgctggttaaaattgctca

SEQ ID NO: 24521 - DNA, 678 bp, Zea mays
aggatactatccctcgcgtccgcagtcttgtcttgatgatacctggttcaaaaagctcgtcgggaagaggagcaaaacaaaccctatctaaaccgcggcggactcttcgtccagcaaggtttcccatccagatccggccacgccacttgctcctcttctccgccacaccgatggtgtacgtggattcctgggacgagttcgtggagcggtccgtgcagctcttccgcggcgaccccaacgccacccgctacgtgatgaagtaccggcactgcgaggggaagctcgtgctcaaggtcaccgacgaccgcgagtgcttgaagttcaagacagatcaagctcaagacgcaaagaagatggagaagctcaacaacatcttttttgctctcatgacacgtgggcctgatgttgatatcagtgaagtttcagggaaggaacaggcagagcaacagcaagcgaagaaaggtcggggaaggaggcaataatgcggtctgatccttatttgttacagaaaattcacaactggaatgatggattaacatttcattgactttttgtactctgaagaaagtttttccagtacagaaccgagaacaaactaaatgcactctatcatgaatgaatgcatgattgagaaaaaaaaaaaaaaaaaaaaaacccccggaccgccccgcctgaagc

SEQ ID NO: 24522 - DNA, 963 bp, Zea mays
ggtaccctcggagcctgccgggcacgactctcggcaacggacatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcgttcaaaaagctcgtcgggaagaggagcaaaacaaaccctatctaaaccgcggcggactcttcgtccagcaaggtttcccatccaaatccggccacgccacttgttcctcttctccgcaacaccgatggtgtacgtggattcttgggaggagttcgtggagcggtccgtgcagctcttccgcggcgaccccaacgccacccgctacgtgatgaagtaccggcactgcgaggggaagctcgtgctcaaggtcaccgacgaccgcgagtgcttgaagttcaagacagatcaagctcaagacgcaaagaagatggagaagctcaacaacatcttttttgctctcatgacacgtgggcctgatgttgatatcagtgaagtttcagggaaggaacaggcagagcaacagcaagcgaagaaaggtcggggaaggaggcaataatgcggtctgatccttatttgttacagaaaattcacaactggaatgatggattaacatttcatggactttattgtaattctgaagaaagtttttccagtacagaaccgagaacaaactaaatgcactctatcatgaatgaatgcatgattgagaaacgcccaaggcttcaaccctgcttcgtttttctgcacgggaagcgttttcatccatgttttctggtagaggaatgtagcttgatactctgcctgatcttatattgcgcactgcctgttggggttgggccatacgattttaggctattctcaatgggaatgaatttcctagcaaaaaaaaaaaaaaaaa

SEQ ID NO: 24523 - DNA, 1397 bp, Zea mays
tatatatatatatatatatatatatatatatatatatatattattctttatttgtcgcgatatagtttaaaaataaactagtgaagaataaatattcgtaatattacctccctaagtagcgagacgagagtctccatgcatctagaaaaactaccgatcaacataaacatggggatggatgtgaagacctacgcctgctgtcggcgttcgtctacaccttctcgctgtgcctattccccaagcagagcgatctacaacgacgactgcacctctacagtacgtacggttgctttcgtatctcttccccatgcaagcacgggtcgttgctttagccaaacataaatctcatcagatccagaagttgcgattaatggttaagagcaagatcctgcaagggatctaacatttaacaatgacctacgtctggagctggtagtggagcgcgcttgaggcatcgctggcggcatggtggagagccgtccctagcaccacacctccgaacttgaggaaagtcacctgtatggccaatatgatggatgctggctcaatgcatggaacaaacagcctcctcagctccggcgacggcctgaagtcgtcctcgatgtcaccaacactgaggtcagcatgagcgaccacaaagagtgcgccctcgccggtgcaggtgatctctaccctgccatcgttgttgacgccgaggcggccagcgagggggtagaaggccaccaaggtcttggccatagcctccttgagcctggccacgtcgaagaaaccatcggcggcggcaacatcgctggggctgtacaggtagactgttggggtgtggcctctgctgggcagaacgaggtccagcggagagagcgagagcccctccgacggtgtcggctcgctcggcactacaaacgacgactctaccacatgcactacctcagaatccatgatattgctgctagtagaaactgcacctcagctgtgcggtgctatgtgagcccgcgatttttactcgatttaggcacgtcatttaatttcacgaaaatagtattggaacgttaacaaggcatgcatgcattgctggacttgcagaaaccttaattacctcagctgtgcggtgctatctgagcccgcgatggggggaggagattctaaccggtcgattatttatagatggctaaatcgacactctgatacgattcgtattattttgttacggcacgatacgatctacatattaattgcacatgctgagatgcttattgtacatgccgaggtctagactgatgagatgcttattgcacatgccggcatgagatgtgtcaggtctagactgtcatctcagtgtggtggtcaccacgattagacaagatttaaatcaactagtgatttgttggatacgattgtga

SEQ ID NO: 24524 - DNA, 817 bp, Zea mays
cacctacttttctgaccgaaaattgcgcaagaataggccacccactggacgtgtggagagagggagaaatcagttcgcttcaaataattatcaaaggttacatcaccatgtcagaacagatatggctgcagatatgggatctggtctggaattgaggcatgagctaccacagatacatattcctggtgcaactgatcatggaatgccatctccaatgagtataccaatgtcatcgtcatctcttaactctccaagagatcaattgaaggtaccagctcattctccatcttcccaggttcgaaggaataattttcatggcaatggtttcatgctcctgcaagacagtaagcttgagtccaggacctttaacagtaaacttgagtctgggatattggggccgttgcctttagaagttacctccaaagaccatgctagcagatcagaatccgcttccagcaatcaagtttctggacctgtgagtactgtttctgctccccgaaacactacgacagattccaatctaatgagggatggcgcccaatcatatcgcctcaaggacagcagagacttccccccactgtccagttgaatgttgatggcggtacactgtagtatgaactgagaggtgactgtcaacgccgcacttgatcaccaggcaaaattaccgatgaatggtctgtgctgaaccgcagcagtggcaccgagttgttgctccctgaaaccagacaacatgttgtatatcctgccatttccttcccgtactccaggcgtcagattcaccttgtccctgcgatcagccttacaccctcatttggcc

SEQ ID NO: 24525 - DNA, 3861 bp, Zea mays
ggcatgatttgtcatgccaccaatggttccttgtctctaggcttggattgcaaaagagtcaacaactgcagtgcacctttatacagcaatccctgtggtgatttctcttatcggtttaataacatcaacatttcagattccatcaatcatgatgactcaataaaacagaaacaatgtaactctattgctggagagaaagcgataaagtctatttctgatgggttgctagatagtgaaggctcaagtcatgctagtactgatgattcagtaagtgtgaggaacagtggtgacttctatgaagctttaacaactatctcgccatctgggagacgttatgccccacatcaattttaccaattagaaaatggtaaggtggttgttagacataacacaaacatgtcacaccatgggatgccaacaaagcagttcacaagcagatcttaccactcttttgaagatgctaagtatcacaatgagttttcaggaagctttctgccacccattgagcataatgcttactcttctgctggctttgttaatgttctggccacctctaactcagcatgtacacatgaaaattcacaacttggtggagccaataataacatcttgaaagatctcactggagattttgagacatacttccataatcttcagtatgcgcaagggttccagcaagataatccagtaaacccgttttcctctggaaggcctgctccaccatccctgcaatgtcagaacacgtgcccttcaaatggtcgaggaagaaaaaatccatattcatatgctagcatgaatggtgcagtcccttgccctccttacccatctggctatcttgtgtggagtccatttattcaaccagatgatcctatggctatgaggacccgtggaacaggcacctacttttctgaccgaaaattgcgcaagaataggccacccactggacgtgtggagagagggagaaatcagttcgcttcaaataattatcaaaggttacatcaccatgtcagaacagatatgcctgcagatatgggatctggtctggaattgaggcatgagctaccacagatacatattcctggtgcaactgatcatggaatgccatctccaatgagtataccaatgtcatcgtcatctcttaactctccaagagatcaattgaaggtaccagctcattctccatcttcccaggttcgaaggaataatttccatggcaatggtttcatgctcctgcaagacagtaagcttgagtccaggacctttaacagtaaacttgagtctgggatattggggccgttgcctttagaagttacctccaaagaccatgctagcagatcagaatccgcttccagcaatcaagtttctggacctgtgagtactgtttctgctccccgaaacactactacgacagattccaatctaatgaggtatgtatggcatattattttcatcgccagcactaacaataattgtatggcagaaatgatgtttaatgtagtgggcatttccatgttacaacaattagatgttttactccttgtagtttggtactttggtgtttctgcaaagttatttagatagttgtgatgttgacggtcgggcattaatacatagagtaaattatactgcatgtaatttttttttgattatatcgtactgggttccttggtcttgactcttgagaaccacacgtgcgtaccattttgatgcgaggcaattcaggttgtcattggtcacattattattactatgtgaatcaagaaagaattggtgtccttggattccgttggcttttctgttttgggaatgcagattttactagcttaccattaaaagcttactgatggacttgataaatacacatctagatcatgttttgtgctgagtttactagcgtttattacaacgtctgaccctgcactgtacaattcacagggatggcgctcaatcatatcgcctcaaggacagcagagacttccccccactgtccagttgaatgttgatggcggtacactgtagtatgaactgagaggtgactgtcaacgccgcacttgatcaccaggcaaaattaccgatgaatggtctgtgctgaaccgcagcagtggcaccgagttgttgctccctgaaaccagacaacatgttgtatatcctgccattttcttcccgtactccaggcgtcagattcaccttgtccctgcgatcagccttacaccctcatttggcaaaaaagaaaaaaaaagaaagaaaacaaaagggacagcaagagaagcagaaggaataaagatgcagggttatgacatgtagatagtactgttactaggaaaaggtcccccttcagacatgttggagggctagttggttgtgttgttgttgagaatagcgtttttagtagcctttgttggcgtttatataacgagtaaggggtctggcaggatctcgcaacaaataaattatctcgcaagtctgtgcgcgtcctgatcgatccgcgtggacgcaaaaggcgaaaagcgcgtaaacctcgcgcgcgttcacgcccacgcactgtcgacccgctgtcccgctacggcgccttgcatgcgtatgcgtgtctcccagccatgcaggcgtcaaactggttgaccgaatgccgtcctcccctgcttgctcgatccaagaacaagaacatgcatctcggtctgcaataatatatattctcacctttttatagatccaagaactaaaaagacactgtggcgtacgttgcctaacaatgaagacgcgatcgcgaaacacttggaactgaattgtatcatgtatcgatcggtatctacatttacatcctgtagactgtactatatatgtactcaagccaaaaaaaagaaaaaagaaaagaagaaataaatgaagaagaagtttgaatggaagacgaggagaactagtatcagcgtgtcgtttttccgtcgttggagagtgagcacgcacggtcgatgtcgatcgagatgaaatgaaatcagttggtgcgtttgctgggggcggagggcggcgccttgccccggggcttcttgttgagcagccactggtggcggccgccggcgagccgatgatgccgccggccctcgtcgtcgtcctctctgggcacggtcgccgacggtgccgcgaagacgaccgtcgctgtggtctcggcgtcggcgggtacaggcagcagtatgacgtcggtggcgtcggtcttgtcgacaagaagcacaggcctgcagctggatggctgcggcccgacggcggccggccggccgaggaggaggaggaacaagctgctgaagcggggcggccggagccgcgtctgctgctgtcttcctgtgctgcccattgacgcgaatgcgcgggccgccgggcaggcgttggagtcgtcgtcactcgtcaggtggagtagctagctggacgcggacggtgcgtgtgtggatttggatggtggagagagagagagagagagagagagagagagagagagagagagagagagagagagagagagagagagagacgcgggaaggtgtgagggagaaggtaaggcaggagaaaagatagatatatataatatatataggcggcgaccggcggtggcttggagacgacggagtccatcggaacgaaaggaaaccgcgtgtgagtgactgaacgccgcactgtgtcgtctttgtccttgtcttgcctgtttacattatatataagtcttgtgcctgaccagtttgtattaaaaaataactgaattgtagcctttgtcatagatattaattggaacttggaagtattaaatataatctaattaaaaaaaacaaattatacctaattagtccatgtttcgcctataaactcgttaagcccgct

SEQ ID NO: 24526 - DNA, 670 bp, Zea mays
atgggatctggttcggaatgcaggcatgagctaccacagatacatattcctggtgcaactgatcatggaatgccatctccaatgagtaaaccaatgtcatcgtcatctcttaactctccaagagatcaattgaaggtaccagctcattctccatcttcccaggttcgaaggaataattttcatggcaatggtttcatgctcctgcaagacagtaagcttgagtccaggacctttaacagtaaacttgagtctgggatattggggccgttgcctttagaagttacctccaaagaccatgctagcagatcagaatccgcttccagcaatcaagtttctggacctgtgagcactgtttctgctccccgaaacactacagacagattccaatctaatgagggatggcgcccaatcatatcgcctcaaggacagcagagacttccccccactgtccagttgaatgttgactgagaggtgactgtcaaccccgcacttgatcactaggcaaaattaccgaagaatggtctgtgctgaaccgcagcagtggcaccgagttgttgctccctgaaaccagacaacatgttgtatatcctgccatttccttcccgtactccaggcgtcagattcaccttgtccctgcgatcagccttataccctcatttgccaaaaaagg

SEQ ID NO: 24527 - DNA, 2255 bp, Zea mays
gcttgcatgcctgcagccgggacccggtagccggcagcgtccaacgcatcaatgcggtggcagcgagagctgcccggccatgtcaacgacagagaatgattggggagccgacgatccgtcatctgaaattctgaagtgtgcgacggggcaatcgcgcaccaccatcgcgtccaaggagtcgaggacacagcacgacatggccatatcgacatttccatgaccatgaggcagtgtagaaccaaggccacacgcggcacagtcgcacagagctgcacgggcaccgggcacggcgtggccgatggaacatggaacttaagactaacgtagttgccacaacgaccgagaataaaggccagtttgttcctccctaacttgccaccactgatttatctccaaaagtgtaaatatcgtgataaatcgggatacatcgggctaaatagcaaaactttgacatgaaattgaattgggttcaaaactaaatcagttatagtattgcaataagatgtaattcaaattctattgtttgtgtttagtgactgaattagagacggtctaattccaaacaatttaatggatgacgttctgccgtattggaaacgagactttctagttataatccaaaattccaaagaatttagtctttgattccaaatcgtactaggagagactttctagttatagtccaattcaagagaattagatctcttattccaaatcccaattctagtgcaccatatacaaccaaacaacagaattcacttccagtgcaccttttttttttttttagcagaattcagaaaagtttattccaattaccaattccatgctccaaattcaagcagggtattagataagttgtggctccttagacgggaaatcaaaccggccctaaaactaccatattcatatgcacgtgactaacgtctccatatgatattccatataagcacttccacgcctgcagtgtgctttacaagctcaaacggggaacagattcagacgcgcgtgacaaacgtcagcatactctgtttttgtacatttggttcctttcatccctacagtgttctttacaagctcaaattggtaaactagagagcaatacaacatcacaattcacacatgacgagttcacaaatctggttgcttttgacagcaagcaagataccggtttgaatctccatgcacgtctttggagaggcatgctggtggctacaattctcaaagtgctcaaaaacaacgatagtattgaagccatgttagcatgaaaaccaagtaacagcatcaaaacagcaacgctatcatgttagggaggatacaaaaggtaaggatcaacgactgctttgataataacattactaaaaacatatgaataaaagaccaaaaaatggaaatcatgcactaatgatgatcacattgatatggactaatggtgcagccttacagttccgaaacaagatgtatttgtcagcttactgtgattctgaagtatctttatgttgaatacttgactagatagttaaacttaaatgtgctagatccttgagtttgctccagcaactggggagaaaaattcaacagccttcaactcagaatttgaatagagcattcttgtacttaattctatggctactgtttttcaagaaattatttctgctttcagatctatcatcgttgccacgcaaaagaaaaataatccccttcaacttgttttttcaaatgggcaccaccaggtgctgattcccacatatactggctcccagtaaccaaactcattggtgtcattgcatatagcattacttctgtgcacaattggcaatcaacagttctactagatctaataccatcatcaatttccctcatgaagtcctactccaataattattataacacataagtaacaaataatggccctcaagtacattaataagcacacaaaatgtgtttctgcatactgcaagacatctcagagcagcctctcttcatgaaactacatattgatccttcatcctactcagtggcatcactaggttatctccaaaaaacaatttcaaggacaaaactgtctctcagtctgaactcaggatccaatagtgttattatccctagctcaagtaaatccaaagttagtgcatgagttttcccttgctaaaactcaaaagatgacaccagcagttataagttaagcttgcatttaagctctctgcggcctgcatagctgggcattgatattactagtctctttcagctatttgcag

SEQ ID NO: 24528 - DNA, 898 bp, Zea mays
  misc_feature (20)..(20): n is a, c, g, or t
gtaccctcgggttcgccggnattctcgaaaaaactaaaagtgggggccggccgggattcggcaaagttccggcctcatccgctgctttcctcgcaactatcggatcttgcgaaggcatcgtcctcctatcctataatcgcatttcgaatcgcaaacggagacttcgcccctcttcacagattctaatcgaatttgccaatctgcaagctaacgtagtgattttctgtggtggtggtgatgtgcgatcgcaggaacaatcaccaatcaccatccttaagaagatgatgcgatgcactgtaacgggcggcgggtgcgttgcttcgtggattggtgatcggaggtcgccggcggtcaaccccttcagcgtgcggatgtcgacgggcaacggtgggtggtgcggcggcctgaggtcgcgggcggcggatctctccggcctcgagatggcccatctacgtggcggcatcggggggctcttccgcgcgagcccgcgctatgggcgcttgcaagccacggccgcagttgaccctgaagatattccactggagaaggttcaagctaaatcctcaggacatgttatgccatatgttggtgttgcttgtttgggggctattctgtttggttatcatcttggtgtggtcaatggtgcgcttgaatatcttgcgaaggatcttgggattgctgaaaatgccgtcttacagggatgggtggttagcacatccctagctggtgcaacactaggttcctttaccgggggatctttggcagataaatttgggcggacaagaacattcatcctggatgcagccccactggctgtaggtgcattccttgagcgcaacagctcaagatatccgcaccatgattattgttcggctgcttgcttggattggtattggga

SEQ ID NO: 24529 - DNA, 938 bp, Zea mays
gaggcggacataggagctcttcgtcgtcctatcttataatcgcatttcgaaatccccaaacggaggcctcgccactcttccgaacctgtagtcgcttacccactgccaactcagcgccaaactgtggagatttttttttttacctatttctatttatggtggtggtggtgtggtgtgcgatcgcaggaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatctcgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaatcggtatcggggtctcatctgctcttgtacccctttacatatctgagatctcaccaacctgaattcgtggaacactttggtaccggttatcaaactttttatttgcattggaattcttgcag

SEQ ID NO: 24530 - DNA, 752 bp, Zea mays
atcgccactcttccgaacctgtagtcgcttacccactgccaactcagcgccatactgttgaatttttttttacctatttctatttatggtgatggtggtggtggtgtgcgatcgcaggaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctcagaatgctagttttgctcagaaaacatagagaagcttcgaaagccttctcactagttatagacggtgctacacttgtatcagaatgtcagatgcttacaaaaggatgagttcatgaaaaaaaaaaaaaaaa

SEQ ID NO: 24531 - DNA, 2109 bp, Zea mays
gcacccatgagagaaattcgcacccccattccagcgaaattcctgcgttgaaagaagtccggccccttccgctgcttaactatcggatcttgcgaaggcatcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcattcttggacctggagactctttctagtttcatgtagttttagaaataagcgaacggcaagagtaccaatcttaggtgacttggtgtgtgcaatgaggggttgtgtcagaaataagtgaattggattgtagaatttcagaaataagtgaattggattgtagaatttcagaaagtgtgttccccttatttattcgctgcagttccatgct

SEQ ID NO: 24532 - DNA, 3092 bp, Zea mays
  misc_feature (10)..(10): n is a, c, g, or t
gccggccggngtccaaatagaggaaaagtaaggattacttttgataaatagatttcgagttttttttttcgttttctggcttttatcgtgtgaaattcgtacaccccatccgctgcttaactatcggatcttgcgaaggcatcgtcctcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaatttcagaaagtgtgttccccttattttttcgctgcagttccttccatgctagacctatattactgacagttttcttcatgcgcccttatttccttttggcctcaagatttgcccgcagctttatgaggaaaggattagtgcgtcattatttctgtatatcacagcacagtagaagtaacaaaaaaaaatacaaaaggatgatccttttgcatgtactggttcttctatttcttatcatattcagcctgcagatctcgtcgattcctttccaaaaaggttattagttgttacacttacacatcatcatcatgactcaatgaccacattgagggtacgattaaaaaaacttattgaacattttttttactacttaatgttccaattttgttctaattaagaccatatgcaggagtaccaaatcaaggtgatgaaatgcaatcacctgctgtagtcaattactgtcaggtctatctatgctatgcatcataaacaaactgaatccatatggttcaaaattctacgtcttttagccattcagagatacaatcctgatgcaaatcgtctaacacaccaaagtacaatgtgttgaagtgtataaatggaccatctatcttctttaaatagtttaagcttttgaattgaactggttggtttatccactataacatggtatcatattcagaggtctcgagtttaaatcatggcagaggcttaatttgttccaccgctcctaatcctgatagaggatttcctaccaagcccctgctcctttatttccacatccctttattttcacatttgcgtctgttaagcatggtacttgaataaataaggaggtatctggcaaatcttattactctgaatccaattaccaatgtggcacttcactctttatattttccacatctcagattatcatacttagacctgtatgtgaatattgtaaaattatctaaatagtttttgctacatttgaataaggttgtgtaggaaacgggtgacgccta

SEQ ID NO: 24533 - DNA, 2454 bp, Zea mays
aagttccggcctcatccgctgctttgctcgcaactatcggatcttgcgaaggcatcatcctcctatcctataatcgcatttcgaatcgcaaacggagacttcgcccctcttcacagattctaatcgaatttgccaatctgcaagctaacgtagaacaatcaccaatcaccatccttaagaagatgatgcgatgcactgtaacgggcggcgggtgcgttgcttcgtggattggtgatcggaggtcgccggctgtcaaccccttcagcgtgcggatgtcgacgggcaacggtgggtggtgcggcggcctgaggtcgcgggcggcggatctctccggcctcgagatggcccatctacgtggcggcatcggggggctcttccgcgcgagcccgcgctatgggcgcttgcaagccacggccgcagttgaccctgaagatattccactggagaaggttcaagctaaatcctcaggacatgttatgccatatgttggtggtgcttggttgggggctattctgtttggttttcatcttggtgtggtcaatggtgcgcttgaatatcttgcgaaggatcttgggattgctgaaaatgccgtcttacagggtatgacatacttttacatgctcaacttactcataccttttccccgtgtttgtaaaggaacatctaacacttcgattgactgtgcagtgcaatgctttctttgccaaggcatacaataggcatggtttctaaatagtagatagatgactatattcactccatgataatgggtgctttggagatatcttttttccatatgcttcactggacatctgcttattactcaggatgggtggttagcacatccctagctggtgcaacactaggttcctttaccgggggatctttggcagataaatttgggcggacaagaacattcatcctggatgcagccccactggctgtaggtgcattcttgagcgcaacagctcaagatatccgcaccatgattattggtcggttgcttgctggaattggtattgggatctcatctgcacttgtacccctttacatatctgagatatcaccaactgaaattcgtggaacacttggttctgttaatcaactttttatctgcattggaattcttgcagctttgttagctggattgcctttggcaggaaatcctgcctggtggaggacaatgtttggaattgctgtagttccatccattttgctggctgtaggaatggccttttcgcctgaaagccctcgatggctattccagcaaggaaaggttattcaagcagaatcagctgtaaaaagactatatggaaaagaaatggttaccgaaattatgtatgatctgagagctagtggccaaagttcttctgagaccgaagctggctggttggatcttttcagcaagcgttactggaaagttgtgagtgtgggggcagcactgtttttgttccagcagcttgctggtataaacgctgttgtatattactctacatcggtgttccgtaatgcaggcattacatctgatgttgctgctagtgctcttgttggagcagccaatgtttttggcaccatggttgcatcttctctaatggacaagaaaggaaggaaaagccttctgatgacaagcttttctggaatgggtgcttcaatgctactcctagcattgtccttcacctggaaagctctggcaccttattctggtactcttgctgttgttggcactgttctgtatgtgctgtcttttgctctaggagctggtcctgttcctgccctgcttcttcctgaaatatttgcctccagaataagggccaaggctgttgcattatctctaggcatgcactgggtatccaacttttttattggcctgtacttcttgagtgtcgtcaacaagttcgggatcagcaatgtatatttgggatttgcatcagtgtgcgtccttgcagttctctacatagctgggaatgtggtcgagaccaaggggcgatcacttgaagagattgaacgggaactaagtgtagcagaatgatgtgcttttgctagtcatgctgcggcgccgttttggtgattttgagaatgcaaccaagcacacaaccgagcatccttggacctggagactttctagtttcatgtagcagttaccgatcagattcagaaacaatgaactcgtcgatgtttctggagataagttttcgttttttgttctaaaatttcttgtttctcttgtataggagactttgagatagtttcagctctaaagacgtgaatatggagcagctccgctgaaaaaaaaaaaaaaaactagtaaaatgtttagctatacactagctctagatttacgaaacagagatttcccttggaatgacttgttttgctcttgatgttggctgacatatccttcgaagcaatttggagtaaaaatacacaattaaaaaaaaaaaaaaaaaagcggcc

SEQ ID NO: 24534 - DNA, 2002 bp, Zea mays
  misc_feature (998)..(1002): n is a, c, g, or t
  misc_feature (1130)..(1134): n is a, c, g, or t
  misc_feature (1143)..(1147): n is a, c, g, or t
  misc_feature (1261)..(1265): n is a, c, g, or t
  misc_feature (1291)..(1313): n is a, c, g, or t
  misc_feature (1554)..(1558): n is a, c, g, or t
  misc_feature (1973)..(1978): n is a, c, g, or t
ttgggtacctcgaggccggccgggtttttattacctatttctatttatggtgggggtccctcgggccgcgtgcgatcgcaggaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggtgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggtcgattgcttgctggaattggtatcggggtctcatctgctcttgtacccctttacatatctgagatctcaccaactgaaattcgtggaacacttggtaccgttaatcaactttttatctgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtnnnnngactgtatggaaaagaaatggttaccgaaattatgtttgatctgagagctagtggccaaagttcttcggagtccgaagccggctggtttgatcttttcagcaagcgttactggaaagttgtgagtgtnnnnncagcactgnnnnngttccagcagcttgctggtataaacgctgttgtatattactctacatcggtgttccgtagtgcaggcattgcatctgatgttgctgctagtgctcttgttggagcagccaatgnnnnnggtactatggttgcatcttctctaannnnnnnnnnnnnnnnnnnnnnncttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaacnnnnncattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaatttcagaaagtgtgttccccttannnnnncgctgcagttccttccatgctaga

SEQ ID NO: 24535 - DNA, 2247 bp, Zea mays
ctggccgggaaaaaagggggccctcgaggccggccgggaagttccggcctcatccgctgctttcctcgcaactatcggatcttgcgaaggcatcatcctcctatcctataatcgcatttcgaatcgcaaacggagacttcgcccctcttcacagattctaatcgaatttgccaatctgcaagctaacgtagaacaatcaccaatcaccatccttaagaagatgatgcgatgcactgtaacgggcggcgggtgcgttgcttcgtggattggtgatcggaggtcgccggctgtcaaccccttcagcgtgcggatgtcgacgggcaacggtgggtggtgcggcggcctgaggtcgcgggcggcggatctctccggcctcgagatggcccatctacgtggcggcatcggggggctcttccgcgcgagcccgcgctatgggcgcttgcaagccacggccgcagttgaccctgaagatattccactggagaaggttcaagctaaatcctcaggacatgttatgccatatgttggtgttgcttgtttgggggctattctgtttggttatcatcttggtgtggtcaatggtgcgcttgaatatcttgcgaaggatcttgggattgctgaaaatgccgtcttacagggatgggtggttagcacatccctagctggtgcaacactaggttcctttaccgggggatctttggcagataaatttgggcggacaagaacattcatcctggatgcagccccactggctgtaggtgcattcttgagcgcaacagctcaagatatccgcaccatgattattggtcggttgcttgctggaattggtattgggatctcatctgcacttgtacccctttacatatctgagatatcaccaactgaaattcgtggaacacttggttccgttaatcaactttttatctgcattggaattcttgcagctttgttagctggattgcctctggcaggaaatcctgcctggtggaggacaatgtttggaattgctgcagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgttttgttccagcagcttgctggtataaacgctgttgtatattactctacatcggtgttccgtagtgcaggcattgcatctgatgttgctgctagtgctcttgttggagcagccaatgtttttggtactatgattgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtcagcaagtttgggatcagcaacgtgtatctgggatttgcatcagtatgtgcccttgcagttctgtacatagctgggaatgtggtcgagaccaaggggagatcacttgaagagattgaaagggagttaagtgtagcagaatgatgtacttttgctagtcatgctgtggccgcgttttggttatcgagaatgcaaccaaacgctcaaccgagcatccttggacctggagactctttctagtttcatgtagttttaggaataagcgaacagcaagagtaccaatcttaggtgacttggtgtgtgcaatgagggtctgtgtcagaaataagtgaggcttgttcggttatttccaatccgtattgtttggttatttccaatccgtatggatcgaagtggattgagcgggattgatatgtattttgacttgttatggatttaaaccgactcaatctcatccaatgtacatggattaacatcaaaccgaataagccctgagttggactgtgaatttcacaaataagtgaattcccccctcagtgaattggattgtag

SEQ ID NO: 24536 - DNA, 1865 bp, Zea mays
gacgtgtccgtctcttagcgaggatgcaggcttaaatcgcagcaccactgcgaaacccgaccgctagtcgtctcgtcactgccgtttgatccctccacccgtttccagaagcttcgcggctccgtcatgcgtcccgccgtcgtcacggtgctcctcctagtagcagcggccgcctcgccggccgccgcactctactccgccggttcccccgtcctccagctcaatcccaacaacttcaaatcgaaggtgctgaactcgaacggcgtggtgctggttgaattcttcgcgccgtggtgtgggcactgcaagcagctggcgccggcttgggagaaggctgccggcgtgctcaagggcgttgccacggtcgcagcgcttgatgccgatgcgcaccaggcgctcgcgcaggaatatggaatcaagggatttcccactattaaggtgttttcccctggtaaacctccagttgattatcaaggagcaagagatgtaaagccgattgtagagtttgctctgtcacaggtcaagtcccttcttagagataggttgagtggtaaggcatcagcagggtcaaatggcaagacatctggaggctcaagtgagaaaagtgaaccaagtgcatcagtagaattaaattcacgcaactttgacgagcttgttgtcaaaagcaaggacctttggattgtggaattctttgcgccatggtgtgggcactgcaagaaattggcacctgaatggaaaaaggctgcaaagaacttgaagggccaagtgaagctagggcatgttgattgcgatgctgaaaagtccttgatgagcaagtacaaggtggaaggttttccaactattttggtatttggtgctgataaggagagcccattcccctaccagggggctagagttgcatctgccattgaatcctttgcattggagcagttggaagccaattctggcccggctgaagtttctgagttgactggcccggatgtcatggaagagaagtgcgcttctgctgccatttgttttgtatcattccttccagacatccttgattcaaaggcagaaggaagaaacaagtaccttgagctcctgctctctgtagctgagaagtttaaaaagagtccatacagttttgtctggacagctgctggcaagcaagctaatctcgagaaccaggttggtgtgggcggctacggctatcccgccatggtagctctcaacgtgaagaaaggtgcatacgctccactccgtagtgccttccagcgcgacgaaatcatcgagttcgtgaaggaggcagggcgtggtggaaagggaaaccttcctctgaacgatgcacctacagtagtcgcgtccgagccgtgggacggcaaagatggagaggtcattgaggaggatgaattctccctcgacgagctcatgggcgacagctcctcagcaaacgatgagttgtgattctgatgattcttggactgatctgcgtgtcgattagccagactgtaaatctgaggaactctgttttgaaaaatcattccttgagtggcataattttccaggctatggatgctagaatggattaaggagaactgatgtgatagaccttttctttaacgttttttttatccctgaagtaaagtcagtttggacgtatatgttgaacaagtggtctccgctttagaacatgctcttctgcttacattggaatattggatagacagacccaaacctccagtcctactcccacaggacagaagacgaaacatactggagtagtggagccctgcaggcttttggatgaggttgacatccgcatatgtcatctagaggttagagctaacaataaaaatattcatataataaaataaagttggctc

SEQ ID NO: 24537 - DNA, 1261 bp, Zea mays
aatctccagtcgattatcaaggagcaagagatgtaaagccaatcgtagagtttgctctgtcacaggtcaaggcccttcttagagataggttgagtggtaaggcatcagcagggtcaaatggcaagacatctggaggttcaagtgagaaaaatgaaccaagtgcatcagtagaattaaattcgcgtaacttcgatgaactcgttgtcaaaagcaaggacatttggattgtggaattctttgcgccatggtgtgggcactgcaagaaattggcacctgaatggaaaaaggctgcgaagaacttgaagggccaagtgaagctaggccatgttgattgtgatgctgaaaagtccttgatgagcaagtacaaggtggaaggttttccaactattttggtatttggtgctgataaggagagcccgttcccctaccagggggctagagttgcatctgccattgaatcctttgcattggagcagttggaagccaactctggcccagttgaagtttctgagttgactggcccggatgtcatgggggagaagtgtgcttctgctgccatttgttttgtatcattccttccagacatcctcgattcaaaggcagaggggagaaacaagtaccttgagctcctgctctcggttgctgagaagtataaaaagagtccatacagttttgtctggacagctgctggcaagcaagctaatctcgagaaccaggttggagtgggcggctacggctatcccgccatggttgctctcaacgtgaagaaaggtgcatacgctccactccgtagtgccttccagcgcgacgaaatcatcgagtttgtgaaggaagcagggcgcggtggaaagggaaatcttcctctgaacgttgcgccgacagtagtcacttccgagccgtgggacggcaaagacggagaggtcatcgaagaggatgaattctcccttgacgagctcatgggcgacagctcctcagtaaacgatgagttgtagttctgacgattctgtaactgatctgcgtgccgattagcctgactgtaaatctgaggaactctgatgttttaaaaactcgttaaattttcagattttggatgctagaattagaatggttaagattaaagagaactgatgtgataggcacatctttttttgtccctgaaataaagtcagttgtgggcgttgcttgccgcaacaaatggtgtcgctttagatgagatggtctctagcaacatcatctatatttatcctctatatttatttgg

SEQ ID NO: 24538 - DNA, 967 bp, Zea mays
ctcggttgctgagaagtataaaaagagtccatacaggcaagtgtcagcttagctaattacagaccttacgaaaatgtgtctgcttcgtcactttcaaaagaaaggaaaaaggtcaagagtttaaccgatacagtagtttcctttagtgccatgaaaaaggaacagtaatattggcattcaacagtaacaggtgtgtattttaaatgctaacatatagaggtaaaacaagatgcagggtaaccttgcgtgaacaaaatatttaggttgatatttgaaaccataaactttacaagcatactgcaacgactagtgttctattctatgtcaacaaaagcatgccgtgcaatcgtttttcttgaaattccctcttctttggtactacacaccctgtgccggatgctttttgccatgcagttttgtctggacagctgctggcaagcaagctaatctcgagaaccaggttggagtgggcggctacggctatcccgccatggttgctctcaacgtgaagaaaggtgcatacgctccactccgtaatgccttccagcgcgacgaaatcatcgagtttgtgaaggaagcagggcgcggtggaaagggaaatcttcctctgaacgttgcgccgacagtagtcacttccgagccgtgggacggcaaagacggagaggtcatcgaagaggatgaattctcccttgacgagctcatgggcgacagctcctcagtaaacgatgagttgtagttctgacgattctgtaactgatctgcgtgccgattagcctgactgtaaatctgaggaactctgatgttttaaaaactcgttaaattttcagattttggatgctagaattagaatggttaagattaaagagaactgatgtgataggcccatctttttttgtccctgaaataaagtcagttgtgggcgttgcttgccgcaaaaaaaaaaaaaaaaaaaaaaaggggaaaaaaa

SEQ ID NO: 24539 - DNA, 2227 bp, Zea mays
ctttctccccctcccctcccctgcgggcttctctcacgagctcccccggcctcgccgccgccgccaccgccgccgccgccgccgccgccgcctgctccggcgggcgggacccagctcgcagcgtctcccctgcggcgaggtacacgatggagggagcgggcagagatgccaaccctttgagcggttacagaattggcaaaaccctgggaattgggtcgttcggtaaagtgaagatcgcggaacatatattgactggtcataaggtggcgatcaagattctcaatcgcaagaagatcagaagcatggatatggaggagaaagttaagagagaaatcaagatactgagattatttagccggccgcgccgcgtacgcctttatgaggtgatagatacacctgctgatatctgtgttgttatggagtatgttaaatctggagagttgtttgattacatcgttgagaagggaaggctacacgaagaggaagcccgacacttttttcagcagatcatatctggtgttgaatattgccataggaacatggttgctcaccgtgatttaaagccagagaatcttcttttggattcaaaatgcaatgttaagattgccgattttggcttaagtaatattatgcgtgatggtcactttcttaagacgagttgtggtagcccgaattatgcagcacctgaggtcatatctggtaaactatatgctggtcctgaagttgacgtctggagctgtggagttattctttatgctcttctttgtggcactctcccatttgacgatgagaatattccaaaccttttcaagaaaataaagggtggaatatatacccttcctagtcatttgtcaccttcagcgagggacttgattcccagaatgctggttgttgatccaatgaaaaggattacaatacgtgaaatccgtgaacatgtgtggttcaagatccgacttccgcgctatttggctgtgccgcctccagacactgctcaacaagttaaaaaggtcgacgaggaaactcttaatgatgttattaagatgggttttgacaagaatcagctaattgaatctctgcaaaacagattgcagaatgaggcaacagttgcctattatttactcttggacaataggcttcgtacaaccagtggttatcttggatctgagtttcaagaatctatggactcatctttgtctcaagtaatcgctgaaacaccaacttcagcaactgaacttcgtcagcatgggttttcagaatctccaggttctggcttgaggcagcattttgcagctgaaaggaaatgggcccttggtcttcagtctcgagcacatccacgagaaataataagtgaagtgcttaaagctctgcaagaactgaatgtttactggaaaaagattggacactacaacatgaaatgcagatggagtcctggctgccttgagagtatgatgcataacagtgatagcttcagtgcggagtctgctataattgaaactgatgttttcatggagaaatcaaccccgacagtgaagtttgagattcagctttacaaaacgagggatgagaagtaccttcttgacctgcaaagggtcagtggatcacatcttctctttctggacttgtgttccgcctttctaactcagctgagagttctttgagcctgacatgattggcttcccaagcactccttgatgcacccagtggagtttcaagttacatttgagatgtacataatgaccatatataatcctccagtagattatattttctggagcatgtaatgtagacgttagaggcttgtcctggtttgccaagatggttgttacctaaggtcctaacaagaggccgcaggcgagcccagtccaattagatgatgtgaaaaatttttggcctttttttagtctttggacatgttatcaaattaagggggtcgtgctagcacgatacccaaactaagaaataccccattgaaaactgaaaacaaagcttgctcgttcatactaaaaaaaaaaaaggcactaccccccggtgcttattttactccatagacagtaattagatgtcacattcacgtcacgtgcatattcatcacaactgttttaggtattatggattgcatacgttttcttttggatccttcgttctggtggggtgcactcttgttagtttgtttttaatctataccagcttctactacaatattttgtgtctatgaattgcagctgca

SEQ ID NO: 24540 - DNA, 2013 bp, Zea mays
  misc_feature (998)..(998): n is a, c, g, or t
  misc_feature (1495)..(1495): n is a, c, g, or t
ccggccggggcggtaggtcccatgtgagcctcgcttttctcctctcttggaccccgcggccccccgcgctggcgtcactcgcgtgtcaggcgcattctgcctctttctttctccccctcccctcccctcccctgcgggcttctctcacgagctcccccggcctcgccgccgccgcctgctccggcgggcgggacccagctcgcagcgtctcccctgcggcgaggtacacgatggagggagcgggaagagatgccaaccctttgagcggttacagaattggcaaaaccctgggaattgggtcgttcggtaaagtgaagatcgcggaacatatattgactggtcataaggtggcgatcaagattctcaatcgcaagaagatcagaagcatggatatggaagagaaagttaagagagaaatcaagatactgagattatttatgcatcctcatatcatacgcctttatgaggtgatagatacacctgctgatatctgtgttgttatggagtatgttaaatctggagagttgtttgattacatcgttgagaagggaaggctacacgaagaggaagcccgacacttttttcagcagatcatatctggtgttgaatattgccataggaacatggttgctcaccgtgatttaaagccagagaatcttcttttggattcaaaatgcaatgttaagattgccgattttggcttaagtaatattatgcgtgatggtcactttcttaagacgagttgtggtagcccgaattatgcagcacctgaggtcatatctggtaaactatatgctggtcctgaagttgacgtctggagctgtggagttattctttatgctcttctttgtggcactctcccatttgacgatgagaatattccaaaccttttcaagaaataaagggtggaatatatacccttcctagtcatttgtcaccttcagcgagggacttgattcccagaatgctggttgttgatccaatgaaaaggattacantacgtgaaatccgtgaacatgtgtggttcaaaatccgacttccgcgctatttggctgtaccgcctccagacactgctcaacaagttaagaagctggacgaggaaacccttaatgatgttattaagatgggttttgacaagaatcagctaattgaatctctgcacaacagattgcagaatgaggcaacagttgcctattatttactcatggacaataggcttcgtacaaccagtggttatcttggatctgagtttcaagaatctatggactcatctttctctcaagtaatcgctgaaacaccaacttcagcaactgaacttcgtcagcatgggttttcagaatctccaggttctggcttgaggcagcattttgcagctgaaaggaaatgggcccttggtcttcagtctcgagcacatcccccgagaaataataagtgaagtgcttaaagctctgcaagaactgaatgtttactggaaaaagattggacacttcacacnattaaatgcagatggagtcctggctgccttgagagtatgatgcataacagtgatagcttcagtgcggagtttgctataattgaaactgatgttttcatggagaaatcaaccccgacagtgaagttttagattcagctttacaaaacgagggatgagaagtaccttcttgacctgcaaagggtcagtggatcacattttttctttttggacttgtgttccgcctttttaactcaactgaaagttttttgagcctgacatgattggctttccaagcactcctttatgcacccagtggagtttcaagttacattttagatgtacataatgaccatatataatcctccagtagattatattttttggagcatgtaatgtaaacgttaaaggcttgtcctggtttgccaaaatggttgttacctaaggtcctaacaaaaggccgcaggcgagcccagtccaattaaatgatgtgaaaaatttttggcctttttttagtctttggacatgttatccaattaagg

SEQ ID NO: 24541 - DNA, 6131 bp, Zea mays
  misc_feature (2492)..(2492): n is a, c, g, or t
  misc_feature (5431)..(5431): n is a, c, g, or t
ttgggtacctcgaggccggccggggatcaagtgtcagactgtcaggcgcactccgcctctcctctctccgtcgctgggcagctgggcttctctcccgactcccgagcagccgagctctcctgctcggcctcgcctccgccgccgcctgctcgagcgggcggcacccagctccctgcatcttcgctgcggcgagggggtacacgatggagggagctggaagagatgccaaccctttgggcggttaccgaattggcaaaaccctaggaattgggtcgttcggtaaagtgaagatcgcggaacatatattgactggccataaggtggcaatcaagatcctcaatcgccgtaagatcagaagcatggaaatggaagagaaagtgaagagagaaatcaagatactgagattatttatgcatcctcatatcatacgcctttatgaggtgatagatacacctgctgatatttatgttgttatggagtatgttaaatctggagagttgtttgattacattgttgagaagggaagactacatgaagaagaagcccggcgcttttttcagcagatcatatctggtgttgaatattgccataggaacatggttgctcaccgtgatttaaagccagagaatcttcttttggattcgaaatgcaacattaagattgctgattttggcttaagtaatgttatgcgtgatggtcactttcttaagacgagttgtggtagcccgaattatgcagcacctgaggtcatatctggtaaactatatgctggtcctgaagttgatgtctggagctgcggcgttattctttatgctcttctttgtggcactcttccatttgacgatgagaatattccaaacctttttaagaaaataaagggtggaatatatacccttcctagtcatttgtcaccttcagcgagggacttgattcctagaatgctggttgttgatccgatgaaaaggattacaatacgtgaaatccgtgaacatgtgtggttcaaaattcaacttccgcgctatttagctgtaccgcctccagacactgcccaacaagttaagaagctggacgaggaaacccttaatgatgttattaagatgggttttgacaagaatcagctaattgaatctctgcacaacagattgcagaatgaggcaacagttgcctattatttactcatggacaataggcttcgtacaaccagtggttatcttggatctgagtttcaagaatctatggacccatctttctctcaagtacatgctgaaacaccaacttcagcaactgaacatcggcagcatgtgtttacagaatctccggggtctggtttgaggcagcattttgcatctgaaaggaaatgggcccttggtcttcagtctcgagcacatccacgagaaataataagtgaagtgcttaaagcactgcaagaactgaatgtttactggaaaaagattggacactacaacatgaaatgcagatggagtcctggctgccttgagagtatgatgcataactgtgatggctttagtgcagagtctgctataattgaaactgatgatctcatagcgaaatcaacccgtatagtgaagtttgagattcagctttacaaaacgagggatgagaagtaccttcttgacctgcaaagggtcagtggaccacaactcctctttctggacttgtgttccgcctttctaacgcagctgagagttctttgagcctgatgacatgattggcttcccaagcacaatccttgatgcaccccatggactttcaaattacattcgtgctgtacataatggccatatataatcctccggtagattatattttctggagcatgtggaccgtacaggtatgtcctggttgccgagatgattgtcacctaaggtcctaaacaagaggccacatgcgagccccaggccttcttcctcaattagattatgcgagttttgttcggcctttctttagtccttggacatgtttttttctttgccttgtttggttgtgtttggatcaaaggagattgagagctggtttgatgaccagggaaatggaggggattaatggggagaaatctccttcctatttgaaattgaatagcaagtggatatctctcccatgcatcctctctatttcccgtatcaccaaattagccctgaggctttgtttggatactctagtatttatctcagtacatatggattgggatagattaaaatgtaaattaaactaacttacacctcaatccatgtgcatagatgtaaatactagattattcaaacaaagcttgagggggattaaatccccttatattcaattttgactagtgagagatttaatcactccaatcccatttgatcccgatgccctaaggtgatcgtgctagcatggtacctaaggctgaaaatgttccattgaaaactgaaaagaaagtttacccgttgatgtaccagtatcaactctgacataacaggagagacagtaattagatntcacagcaagtgcacaatcatcacttcatcagataaaattactattttaggtattgtaagatgcatctccagaggatttatgagaaagggcactcttgcgttttttttttttgaagagattagggcagcaaataactgaatctgtgctctagctcaacagcacgaggacatacgtaatgtacatgggtcagcatatgattttactttttacagtaggaaatgctagaaaagacttagctagcctaaactataatgtacagcggcaacaccgatggtgtggtatcagtaattctcgggtgcataagaagctgaatcaagctgccccatctgctcagtgatctgatcaacattgtcctggagacgaggacagcagcggtctacggcagtcttcacatcctcttttgcttctattgcctcgcttttaccctcggcggcgtctgtgagaaaccgctcccagaatacatcgttcactttggccggcacatgggaacctccagtttcactggtggtatcatcttgcgaggtgtcgccggttgtggtgtcagagttcatatcgactccagcagctgtcctatgggcatgttcatggagctgtgccatcggcagcatcgggctctgggcgtagtagctcgggggttctgccaacggagaagacgactggtcttgccctgaggtcgaagcgaaggggttctggcaagctgatggctgcagatcgatctcggtatccattggtgccgagagcatctcgcctagagccagagcagggctgggttcagcaacaccagcggcgtacaacatgccttgagcagcagacgtatgcgctgttgccctctgcaagaaactctccagcgacaccagggccagctccatcttctcaaacggctcggcgctcagaaggcggatcggagacatgcctggcgtctccgcgcccaccgtctgcaggaacggcacctgctgttcttcgaccttgggttcgtcgacgaagaagtccatcttcggaaccctcctcttcttgctgaagtggtccgcccccgtcgccgacccccacgaaacgaccccgtgtccgaccggcagcaggatgtcgcgcagggaggccacgatgttcctctggcgctcctccatctgcgccagcctgcgttccagcgactgcatctgccagctgatcccgcaccgctgctggctcgccctctggaggtccgtcaggagcaggctcttctcgtacttgagcctgctgatctcgtcctcgagctcgcgcctctccgactccgccagtgggccgttcacctgggtctgcggcgagtggctgtgcaccggcttgcgccggtggatgttcttcaggaggtgcgtgtgccccctaacgaagtcgtcgttggcgaactcccatctctcgggatcgatctttcggaaaccctggaagtgaagaaccaagttagcagcaggcggaaagtgaggacagacatgaggagtgaggaccagctgttaaaaacagccgccacttttaaaacatgggcttcctactatactgtttacgaacagagcagagagcacacagaatcccgtgctaaaaaaatcaagaaccaactttgaattgaatgcccgtaatgctcctgttgctatttgggttatgagacaaatacgtctctcttcatgaatagacgactccacgatcaggtgcgctggtgccaactgaacatgcgaaaaatgccgaggaaaaaggcacatcgtcttgaggaagatagcagacaggaaatggcaagaaatagacgcgcaacagcaacatgtcacacgcacacagagagagagattgagagagggagatttagaggcactcacgtatgtgttgagctgcctgatgaagctggagaagttgttgtgcttgaagtacttgggcagcaggtcccgtgagaagtccggcgggttccacaccacgaagcttgcgccgccggggccccacgacacgacgtggttggtcgccgggtcctccaccatctcgtaggtcttgatgaggaacggcggcggctgcgagctggaattggaaccctccatgccggccatgcacctcctcctgtctctcctccgactgatgatgggcgaagaattaactaaccgacgctcccccaactctgtcttacccaccggaatggctcgcactcaaccgcagcgagaaaaattctcgccaagctgccgcaaggacgacgaaagcaagggctacggctactgaaggggaagaaacctgagcggttgctaggatttttgctcctcgcgttggcgtcagctcgggcgcggcagatgagcgagccgaggcagcccaaggggcagaggagaaaacgagggggagtggcgtcgcgcggcggttttataaagggggtcgggtcgcgcgtcgtgtcgtgtcgtgtgtccgggtgcgcggcgggccaccgggactcggacgacgacgcggacggtgactgggctgagcagctcgcgctggctcgctggcgcccgcatcctgggctgggtatacatcggctggcggctggtcgttgcatgggggcgtctgaggtttgactggccaatgcgttggcggaccgggacccaggtcgcttctagaagaaggcgcgcggaaacgggtcccggcggcgggccgtcaaagttcgccgcccagcgcgcacgggcaaaggctcggtgctgccggtcagcagggcaagcgagccagccgccagcgttcgatagctgtcggtcgtctgggtgactggaacaacagcagcagcaggccagttttggggccgagacgtcccgacctctgtgcgcgtcccgtcacatactcgcatgtgctgctgctccgacacttcccttccctaagctggcgaccgttgctctccagtgacgtcggtcacctccaggagccaggaatcttcccaacgcccctcgccctgcccctgcggcaccccgcgcggccnggttggagggtcgagcgagacgcctttccatcgcccgtcgggtcgtcgcgggcaggatgtgaacggtctcggcgggcgaccattcctgccgagaattttcagcggtgcgccggtgcccgcccgcgcgccgtggaaaaagagggccgcggatcgccaggcgagtggatgctagcgcacgcacgagcagattcgttgggcagaagaaccacgcgccgacacgacggcgacggcaggcttgaactatgtccgcgccgcgggcgctgcgtgtgtgtgtgtgtgccaccttttcttccttaactttgtccccaagaatgaacgaactgaaggaaaaaaagtctagtgttttaatcgatctgcaagtgtgtcacgcagtctcagatcaagagtcaatttccatgctgataccgagaggcaaggttaatttgggtcattgaataccagtcggtagtatttggtcatttgcatgtcgttgttgttcttgccacagatcaagttgtgaggtttgtggtgctgctagagatgtccaaacgggccgcccggcccggtccggcctgggcccggtgaagcccggcccgctaggcacgattaaaaaaccgggtcggaccggctaagcacgcgggctcaatttcttgtccgagtccggtccgcaacgggcctaaatgggtcgggccagcacaaaaaaagcgggccggaaagcggg

SEQ ID NO: 24542 - DNA, 2710 bp, Zea mays
gacgagttatttagctagtctcttggagatgctcttagcttactaaactaccagggcatttaaggaattaaggtggcctaaactagtctataatgtacagcgctatatatagctttacaaatggactatatggatcagcagcgatgctgtgatatcagcaattctggattgcataggagtcgttctcagctgaatcgagctgccccatctgctcagtgatccgatcaacattgtcgtggagacgaagacagctgcggtctacggcagccttgacatcttcctttgcttctatcgcctcgcttttgccctctgcgtctgtgagaaaccgctcccagaacacatcgttcaccttggccggcccatgggaacctccggtttcactggtggtctcatcttgtgaagtgtcgccagttgtggtgtcagagcacatgtcgacttgagctgccctatagtcgtacccatggagctgtgccattggcagcagcatcgggctctgggcgtagctcggaggttctgccagtggagaagacatctggtctcgccctgaggtcgaagcaaagggattctggcaagctgatgactgcagctgcagatcgatattggtatccactggtgctgggactgagagcatctcgccaagagtcagaggagggctgggttcagcagcagcagcagcagcaccagtgcacatttccagagcaggcgcggggggtgccgccctctggaagaaatcctccagcgacaccaaggccagctccatcttctcaaacggctcggcatccaaaacgcggatcggcgacacgcctggcgcttctgcgcccaccgcctgcaggaacggcagcacctgctgctcttcgaccttgggttgttcgccggcgacgaagagatcggtcttcggaatcggaaccctcctcttcttgctggagtggtccgtcgtctccagcgcggaggccggaacacgaacgaccccgcgcctccgcaggatgtcgcacagggaggccacgacgctcctctggcgctcctccatctgcgccagcctgctctccagcgactgcatctgccagctgatcccgcgctgctgctggttctgcctctggaggtccgccaggagcaggctcttctcgtacctgagcctgctgatctcgtcctcgagctcgcgcctctgggactccgctagcggcccgctcgcttgggtgcgcagcgagtggctgtgcaccggtttgcgccggtggatgcgtttcagaaggtgcttgtgtcccctgatgaagtcgtcgttggcgaactcccatctctcgggattgatcttccggaaaccctgaaggtaaaatgaacttagcaggcagatcaaagcgaagatcaacagggaaaaaaaacataaggaccaaatgctaaaaagatctgtcactcgaaagctttacgacggttccatggtaagttgatccatggaaggaaacggtgaaaaaacaaaacagaatcgcagccgcaacatctcttcgcagcaaaatttgacgaagaaggggtggtagtggtacagagagagatgagacaacacagagccactcacatatgtgttgagctgcctgatgaagctggagaagttgctgtgcttgaagtacttgggcagcaggtcgcgcgacaagtccggcgggttccacaccacgaagctggcgccgccggggccccacgacacgacgtggatggtcgccgggtcctccaccatctcgtaggtcttgacgaggaacggcgtcggcgagctggaccctccaccaccgcctccggcgccaccgtgcgagttggaattggaaccctccatatgccgactaacgatggggcgtgcgtgtgcaggaatttccctgggtctttctacttctactaccccgccagaacagaattgatcactccgccgcgcgccaacttcacaccgaactgtaggaacaaagtttatcgttcgccaagctgccgcgcgcgacgaccgcgactttattctggtgggatcgtgctgcaagaacacacacagatacagacgcgtcgacccatgagtgcgggcgaacagtagcccaaccgcagacgtaggagcggagaatgcaagctctcaagaagcaaccagctctagctagtcacgattgtaagtaagaatgaagcacaagttttcgggcagagagggttttttttctgcccatttgtagtgaaaacattctgtatagtagcaaaagagaagcagcgtcgacgactcaccaaagtacggagtacttgttagttactcctccatccttgggctttcgctggaatcgggccgccgccgacgaaagcaagctagggctactgaaggggaggggaggtcacggaagcctggccggctggcgggtaggagaccgcggcaactcgctaggatttctcccggttagctcgcgtcagctcagacgcgcgcggcagatgtgatgagggagccgaggcggccgaagggacagaggaaccgagggaggaggagtagcgtgcgcgtgcgccgccgccgctggcgtcgcatgcggcggtcttataaggggttgcgttgtgtgtccgggtgcgcggctaccgggacgcgaacgcagacgtggacgcctgtacctggagtggagccgtggggcgtgtttgtcgccgtggcccagcagcctggctgcgctcctgggctgcagctcttgtgtttgcgtcgcctggttggctcgagatccag

SEQ ID NO: 24543 - DNA, 777 bp, Zea mays
actcatgtgtcagactgtcaggcgcactccgcctctcctctctccgtcgctgggcagctgggcttctctcccgactcccgagtcccgagcagccgagctccccctgctcggcctcgcctccgccgcgaaccgcgcctccggctccgcctgctcgggcgggcggcacccagctccctgcatcttcgctgcggcgagggtacacgatggagggagctggaagagatgccaaccctttgggcggttaccgaattggcaaaaccctaggaatcgggtcgttcggtaaagtgaagatcgcggaacatatattgactggccataaggtggcaatcaagatcctcaatcgccgtaagatcagaagcatggaaatggaagagaaagtgaagagagaaatcaagatactgagattatttatgcatcctcatatcatacgcctttatgaggtgatagatacacctgctgatatttatgttgttatggagtatgttaaatctggagagttgtttgattacattgttgagaagggaagactacatgaagaagaagcccggcgcttttttcagcagatcatatctggtgttgaatattgccataggaacatggttgctcaccgtgatttaaagccagagaatcttcttttggattcgaaatgcaacattaagattgctgattttggcttaagtaatgttatgcgtgatggtcactttcttaagacgagttgtggtagcccgaattatgcagcacctgaggtcatatctggtaaactatatgctggtcctg

SEQ ID NO: 24544 - DNA, 2532 bp, Zea mays
gcgaattctgtgcctcgtgtgggaagatatcttttatactttgatattggaaaaggcacttagtgatcgggaaagatgcccgccgagttgataatctatgccaacgcatttatttgagttacaggctattagagggaactggccactttaaagaattgcatgagattattgaagatgcaaaagcaaacattggaaagtgaggttgggccacttgatggaatgtcggcaaagaatgcacatggtatcgtaagcaggttctcagctggtatcgctgtgcagaaactatgctctacagcaattcaaagagctgacgagtggttgagttctcctgacctgcatcttcgaggtgatgatcattcttacataaaatattagtacaatagttttgggtgttgcttcaaaagatttatgcacttctttctttgcagattcattacctgttgcctgtagatttaaatttgtagacatgccatcttcttccctcattgtcatcttgaaagattcctcgtcttctgacactatcaaaggttataagctatgggactggaagagcagagagcaaccaagtatggaaaagcctgttattgtgtccaaagatgaaagaaaaatacttctttatgaccttaccccatgcacagaatattctttcagagttatatcattcacagatgatggggtacttggccattcagaatctagatgccgtactgaaagtagggagatatttgtcatgcgtgcaccaaagaatgcagtgggaggaggggctacacatgcgcaaaaaaaagacaggaaccagtcttgtaagtcaactgggttcaagatccgagatatttggaagaactttcaggaagctttagatgcagaaggctgttttgaaggattttctgaagatgtacatgaaggttcctgcagcagaagtgttacagagacagagttatctggagcttgtcgcaaacttcatttcaactcatcttctgtccccgacctaaacgccgaggttcctgtacccgtggactacactgagaaccattattattctaagaagggacttgtgaggtcaaatgacagtggcgactctgagacctgcgccgttggccagactgcagagccgcctgcagttgaatctcggcaagtaagcaagatgaatagcgtaccagttaataaatgcgagcagaatggtgcttctgctatttgccatgaaaagatgctctccggatcgactaggcaactggatggggattatgagcactgcgtaaaggtagtaaggcagttggaatgcgatgggcacatcgaaaatggtttcaggatgaagttcttgacatggtatagtctaagatccacagaccaggagcgcaaggccgtgagcacatttgtcagaacgttaagcaacgaaccaagcagcctggccgagcagctcgtcgattctttcggagaaatattaaacagcaagaaggccaaaaccggtttctgcagcaagctatggcattaggacaaaaaggactagatctcaagatactgctaactcactgattatccatatttttcactgaccggtgcagtgaaattctagtttattccatcaaatttgacagcgatgaaaagggggcatctgtgagaataggagattattttgggcagcaagtagcctgctctgaaataattcttttccatcaggaagtagtggaaacttgattttcattggattacctgggtgaatccaggaattattgtagaaggttgtctttttttcccctttgttgttgtggttcgctgagaaattctttggagatagcagtccgttggttattctgggttattatataaatcatggtaaatggaatgtgatggtacgaagtctctggtttacttgtgctatcgtttttgttatctttaccctagggccctgtttgtttggttggaattgaattccattctaataatcataatttagatacaaactaattaagttaatacatttgtatatgtaatttatttgtatattagaaaagtgtgctataagttgtacattagaaaagttgtatgtaaatctataaaattaatttctatctctcaccccatgaatttgagatagagttatatataaactttagaaagttatagaatgtcacattctaaaaaataatatactccaatagttagattccaattcctcaaaatcaagggaaacaaacggccctaggagtttttcttttttttatagttaacacttcttcaggtcaatgataacttttcgataatgtcgttagctttataaaatcagaggtaaaacgataatgtcgttagctttataaaatcagatagaggtaaagaacgcaaagactatgcaagcatcagatgcaagcgttcaagcgagtcttttggtccgttaaatctagatcaaaacgtatgttatatttagcacttaaatttttccaccaccactttgtgtagttttatatataaaaaaactaacaatgtttggctcacgagcatgaaaatagcacattcatttacgtgctcttctgtagatag

SEQ ID NO: 24545 - DNA, 2902 bp, Zea mays
aataaaattcggtttagagaaatggtggattcatcaagggagtgtttggtttgaggaatcactccatccaaaatgtggtggtgcataatgggtccattcctcaaatttggtggaatgaccacattcctcatattagtactaactaactaactataaagaatgaggtggtgatgaattaactcattccattcaataaaccaaaaaaaatgaggagtgagaagatgatggagtaggtcattcctcaaaccaaacagcctacaaagtcttgatagatgtattttatatgtgtgtctaggtttattatcactcgtttgaatatatacataaaaataaagagctaaaacgactactaccttggttttcaaatatttatcgtccgttagtttgtttttgaactaaaatacgacaaataaaagagaatagagcgagtactattttagaacggagagattactatacaacctacctaggatgcaaaagttcaagttgagcaatacaaatacctccactagtacaattgacgacggtgaatattcatattcattgactctggtagtctctggtacacctccggcaaacccccgtttgtaagagaaatcgatgatgccctaagtatatactgaaatgcttccttcagatcctaatacaccttataaaaaaaagattggagggagcaaataacttggtaaccatataccaaagaaatttatgaactactattttcgttctcgaatatttatcgctagttaatttgtttttgaattaaaacatatttcctccgtttcgttttagtagtcgttggatagtataaaattaattatccagcgataactaaaaagaaacggagagagtaataaataaaaaacagcgacaactaaaaagaaacggagagagtaataaataaaaaacaatataagactagcgaagagattcgttcccatggatccctcgtgagccgtatacttcagcacaccgcgccacgtctccttccctctccacctgcagcacccagagccgtctccttttgctgtatataagcccatcgtctccctcccaactctctaatctcccccttaacaactccactcccgcggaaaaaaaacccatatccctccggcataaacccaaaaaggttagcagcctcctcctactcgatctcccagatccgcactatctctgatgctacctgcttctttattactagctgtatcgatcgatcgatccagcgttgtttagctgacgagtcctgtttaattctgcgtgtttagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatgtaagcatgcacatatatgagtgctgagtgctaactgctatcagatttaattaagctaggttgggttcctcgctcctccattaatgactgacgtcacacgtgctcgccatgtacgtacggtgtggtgtgtgtgcagcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggtgccgcccgcagtatatagcttcagtttattggtcgatggagagcatattctccaacgaccgagtggcgtgtggatccgtctaacctcgcttgttcatctttatgcgtcctcttggccgcatccattccatccggccgggctcgcaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcgccgcgtgcgcgctgcctccgctgatggacgtgtccggcggtggcggcgccaacatggcggcggcgtccatcgagctgctggcgccaccggcaccacacgtgacctgcttctccaacgcgctggagggccagttcttcctgaacccaccctgcctccacccctccacgtcgccgctccgcctggcgagcatggtgcaggcgcaggcgcaggcgcagtacgacggcgacgcgggcatggtgctccagctcctgcaggaggccggcgggtggtacagcaagctgggcgagggggagcggctgagcggcggcgcgtcgcaggacaccggcgtcacctcggaggtgaacgtgaaccccgccgagatctcctcgacgcggcaccacataatggaccccgaggcggcctccttctggggcttctgaacttccccccacatctttttttttccgcgatcgctaaaaattggattagaattagtcactggattggaaactgggattgtaattgtgccgttgaatattgctatatgcaaaatggggcaaaaaaaaacaaaaagttgtgaacgaagtgtgggtggatatataatatatatatgcgcgcgcgcctgtgtgcacggtactatcccgcgacaaaattgtatttatgatgatagaattgtg

SEQ ID NO: 24546 - DNA, 1382 bp, Zea mays
cacagtgcctctcgctcactgactgactactgtaataccagagatcgaacaacttggtcctgcagctcaagaagagagttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctcccgagcaaggcgaagatgggcgagaaagagtggtacttcttctaccagaaggaccgcaagtacccgacggggctgagggcgaaccgggccaccgaggccggttactggaaggcgacgggcaaggacaaggaggtctacaacgccgcggaaggggtggcggtactggtcggcatgaagaagacgctcgtcttctacaggggcagggctcccaggggtgacaagacaaactgggtcatgcacgagtacaggctcgaaggcagcggcaggctccccgccggcctcgcgtccgcaaccggctcagccgccgccaacgccgcggcggccttgaaagcttctgcttataagcaggatgagtgggtagtgtgtcgtgtgttccacaagaccactgggatcaagaagaccactgctgcaccggcgtaccaggtggccatggccggcgctgagatggatcagaatcagaacaacttcccgggcatccccttccccatgccgatgcaatttcccatgctgccagacttctccttggacccggtgcccccctactaccccaacgccgctggcgcggggatgtcgatgcttcctatggcagcaggtataggtggtggcgccggtgggttccagctcaacggcgccgccctgttcggcaatccgatggccgcgccgcagcccatgagcttctaccaccagatgggcgcggcggggacagcttgcgctggcggcttcgatgtttctgcgccggagagtaggccgtcctcgatggtgtcgcagaaggacgaccaggctaatggcgctgagatctcgtcgatgatgtccgtgcccggcccagggcctgcgaccaccaccaccatagagatggatggcgtgtggaagtactgaaaacgtggagggtggagggcaaagacatgaattcgcataaattaaatatgcatgtattatctatatctgcattgcattttgtgaaatatgatgcatgcatggtttgtatattacgtaataaccagtagttggtaagctaaaaaaaagaaaaaaaaaactagagggggggcccggtaccca

SEQ ID NO: 24547 - DNA, 1666 bp, Zea mays
gcacgcggctgcatcatccgtcgttctggtgagccggcgcgcggcagacctagctagactgaccggcggccgccggcaggccgagaacgaagcgtttgtgcatgagccatggcggaccagcagcagccacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaaaggcagggctcccaggggtgacaaaaccaactgggtgatgcacgagtacaggctcgaaggcagcggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgtcatggacccggtggccccctactaccccaacccaaatgccggcgccgggatgatgccgcctatggcggccggtattggcggcgccggcgggctccagatcaacggcgccctgttcggcaatccgatgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgaacaggctaatgccgccgagatctcgtcgatgatgtctgtgaccggcccagggtccgcgaccaccaccatagagatggatggcatatggaagtacaagtactgaaaaagtggatatggagtttggagacaaatgcatgaattcgcatgaatatgcatgttatatctactatatctgcattgcattttgtgaaaatttgcatggttcctatatttctgcaataactagtcggtaagatatgtgtgtgcatgcatgtgctagtatatacatgcattgtatcattgcatgtgtggtatatgtgtgtgtcgtttggtcttagtaatccggggcatgatggtacccatacctggatttacatctgcttgggcgtgctgatgttgtgttgtaatttgtaaaaagcagattgaagttcggtacagtatattatcgtgaacctatatatattatacttgtgtgaatgatagtatgttgttacccacactacccctcc

SEQ ID NO: 24548 - DNA, 612 bp, Zea mays
ccccctcggcaactccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaa

SEQ ID NO: 24549 - DNA, 923 bp, Zea mays
gcgcactgcactaccagaacacaactcgctagctctgcatcatccgttctggtgagcgagcgagcgagagacctagctagactgaccggtcgccggcagcgcaggccgagaacgaagcgtttgtgcattgaaggagcaggagccatggcggaacagcagcagccgcaggagatggacgttgaccgtaccggtggcctcgaactgcctccagggttccgcttccacccgagcgactttgagattgtcagccactacctcacgaataaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacaacccctttgcagcggaagggctgctgctggtcggcatgaagaagacgctcgtgttctacaaaggcagggctcccaggggtgacaaaaccagctgggtgatgcacgagtacaggctcgaaggcagcggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggagcagaatcagaacaacattccggccatccccatccccattccgcttcaactgccactgtccttttccatgcatattcaatttcccaatcttccagattttgccacggacctcgttgccccctacttccccaa

SEQ ID NO: 24550 - DNA, 3975 bp, Zea mays
cggcaaagaatatggcactcggcaaagaggcaaattccggtagtgaccggtttatagaaactgaactccaagtttcttaaaaaccaagaagcgactcttctctagctaaaaccaacttttatgtttgtttaattacatcatgcctttgttggtttcatagaatttacaactattgccgccgctttttaaaatagagaaagggtatgctagtaattatgtatcaaaaagactagaaactgtttccttagattctaagttccaaacaccatagcccaactcttctttataattcagtttctagaaacacgggataggaaccagtgtactttcaaacaggccctaataattaagtctaaggtctggcatcgctcgtggtggttctggctacagtgacactatatatggatatagagaagggttcgaggattttctgaacaaattacgcatgacgagttttttttttagactggttcgatttgggtggccattaattcgtgtggattgggatgacaccatgcatcttttggatgtattaagagagatacgctatatccgattgttttttcatgcattaaattgtgggacaatcttaaagcaccggcggaatcctaggacgacggcggcgccaacagattggcgggagtggactagctagtacgtcacgatcaagactcatgcgtgcatgcatggcatgtcttctttgttgcatcacaggtgatgagatatatgcatgcatggcaccgtatgtacccatggtccccatggacaagcgcacgttgccgccacttttctagggaaagcgctagcatgccatggcatgccatgccatgccacttcatgcacccggcgcggactacggcaccacgtaggcatacatggcacatgcatggacgtactactctagctatctgtatgtagagcacgcacaatgcgtgataattcgataagaggatcatcacgcagcttgcttggctaaatcaattccttcgaaagtaagcaatagaaaagcaaaaaatatcctctgcaattgcatatgcatgcataaaatcaagcagctggctcagtaacgcgggctaaaaactgaccatggtttccaggggctggcgcgcctggtggacgcacacttgtcagtctcgggcaccgagagctatacgcacgggttctgtgcgtgacagtgtgagcgcaggctacacacacatcatcgtatcgtgtccagagcagatagatacatgagggtgtgtctacatacatacacacagccagcagagtcagccagcacaccgcgcgcgttctccatgcaccggaaacgtactgggtcgagcagtgacgctctggcgcccgcaatgatcagcagtaccagatcacgacgaccccagtcaccggcctgcttgtcccagatggatgcctacgtacgtacgcgcgtctacagcgcagcgcctgcaccgcgtgcgagacagcgtggaccccgcgccatccggcctgtcgtccgcagacttgggtcacgaagggcttgcaggcgggcgcatatagccggccgctgacgcgcgcgcatgtcgacgagagggacgacgcgcgccagccgcagcacagcagccctcctgttgccgcctcatgcagatgaggcggcgacggccggccggcctgcgtgggtggatacgagagcggcgtgcggacgcgtacgtccacaggaatcgcaggcaaaccggagggagggtctcagtctcacgccgcgcgcaggcagatcgagagacgacattccagaagccgggcacctgtctgtcgccagcagcggccgcgcgcgcgaggacaagcgcggcacagggggaaagaacaagcgtccaatggccagtagaaacagacgccaccagaaaaagaggaggcttcggcggaaagtggcttgcgcggacacgcttcccgcctatttaagccgcgctcgcgcgcgctgcggctggcacagtgcctctcgctcactgactgactgtaataccagagatcgaacaacttggtcctgcagctcaagaagagagtttttgtgcatgtatgtgtgcttcggttgggtttttctttcagtactgtcgttgtcagattatatattgagatccttttgtttgcttgatactacggttggttttgctgctgctcttcctggatctctgactgactgactgacctcagttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctccctagtacgtaaccaaagcatcattctcgatcgccttgatatccgtgcgtgcgtgcagtggatatatgcacgctgctatatatgctgcctatacctgtcctaggctagtgatcgatcgagatgtggattcaattcagtcggtcggtcgcatgcatgatgcaggcaaggcgaagatgggcgagaaagagtggtacttcttctaccagaaggaccgcaagtacccgacggggctgagggcgaaccgggccaccgaggccggttactggaaggcgacgggcaaggacaaggaggtctacaacgccgcggaaggggtggcggtactggtcggcatgaagaagacgctcgtcttctacaggggcagggctcccaggggtgacaagacaaactgggtcatgcacgagtacaggctcgaaggcagcggcaggctccccgccggcctcgcgtccgcaaccggctcagccgccgccaacgccgcggcggccttgaaagcttctgcttataaggtgcgttgcgtggcagtagcggtagtgtaacagcaccggcatgatgtggatgtatccatattgatctacatgtgctttattttgctaattaccctaatctgattccgctcctggtttgcaaaaacgaaattcggcgcagcaggatgagtgggtagtggctcgtgggttccacaagaccactgggatcaagaagaccactgctgcaccggcgtaccaggtggccatggccggcgctgagatggatcagaatcagaacaacttcccgggcatccccttccccatgccgatgcaatttcccatgctgccagacttctccttggacccggtgcccccctactaccccaacgccgctggcgcggggatgtcgatgcttcctatggcagcaggtataggtggtggcgccggtgggttccagctcaacggcgccgccctgttcggcaatccgatggccgcgccgcagcccatgagcttctaccaccagatgggcgcggcggggacagcttgcgctggcggcttcgatgtttctgcgccggagagtaggccgtcctcgatggtgtcgcagaaggacgaccaggctaatggcgctgagatctcgtcgatgatgtccgtggccggcccagggcctgcgaccaccaccaccatagagatggatggcgtgtggaagtactgaaaacgtggagggtggagggcaaagacatgaattcgcataaattaaatatgcatgtaatatctatatctgcattgcattttgtgaaatatgatgcatgcatggtttgtatattccgtaataaccagtagttggtaagctatgtgtgtgtatggatgtactagctagtacatgcaccgtatcattgcatgtgtggtatatgtctcgtttggtgttagtaatctgcttggttgtgctgatgactgatggttgtaagaagcagattcgagtttggtacaatattatcgtgaacctatatattatatatatgttaattatagtaaaaaaaaaaaaaaaaagaaagggggcgccagaccccccgttaaactatacgtgtttatattatatatatg

SEQ ID NO: 24551 - DNA, 1724 bp, Zea mays
cggacgcgtgggcgctcactgacgccctactgtaataccagagatcgaacaacttggtcctgcagctcaagaagagagttttgtgcatttgggggccgggggcaagagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcaccgccatcacggaggccgacctaaacaagattgagccatgggacctcccgagcaaggcgaagatgggcgagaaagagtggtacttcttctaccagaaggaccgcaagtacccgacggggctgagggcgaaccgggccaccgaggccggttactggaaggcgacgggcaaggacaaggaggtctacaacgccgcggaaggggtggcggtactggtcggcatgaagaagacgctcgtcttctacaggggcagggctcccaggggtgacaagacaaactgggtcatgcacgagtacaggctcgaaggcagcggcaggctccccgccggcctcgcgtccgcaaccggctcagccgccgccaacgccgcggcggccttgaaagcttctgcttataaggatgagtgggtggtatgtcgtgtgttccacaagaccactgggatcaagaagaccaccactgctgcaccggcgtaccaggtggccatggccggcgctgagatggatcagaatcagaacaacatccccttccccatgccgatgcaattttccatgctgcccgacttctccttggacccggtgcccccctactacccgtaccccaacgctggcgcggggatgccgatgcttcctatggcagcaggtataggtggtggcgccggtgggctccacctcaacggcgccgccctgttcggcaatccgatggccgcgccccagcccatgagcttctaccaccagatgggcacggggactgcttgcgctggcggcttcgatgtttctgcgccggagagtaggccgtcctcgatggtgtcgcagaaggacgaccaggctaatggcgctgagatctcgtcgatgatgtccgtggccggcccagggcctgcgaccaccaccaccatagagatggatggcgtgtggaagtactgaaaacgtggagggtggagggcaaagacatgaattcgcataaattaaatatgcatgtaatatctatatctgcattgcattttgtgaaatatgatgcatgcatggtttgtatattccgtaataaccagtagttggtaagctatgtgtgtgtatggatgtactagctagtacatgcaccgtatcattgcatgtgtggtatatgtctcgtttggtgttagtaatctgcttggttgtgctgatgactgatggttgtaagaagcagattcgagtttggtacaatattatcgtgaacctatatattatatatatgttaattatagtatgttgtttaattatatgaacttgattgccaaaattaacgttgaggggcggccccaaaaaaaaaaaaaaaaaaaaaaaaaaaaaaaaaaaaaaaaaaaaaaaaaaaaaaaaaaaaaaaaaaaaaaaaaaaaaaaaaaagggggcggcccgttttaaaagaacccaagtttacttccccgtgcttgcgaacgaaatagtttttttttagggc

SEQ ID NO: 24552 - DNA, 3302 bp, Zea mays
  misc_feature (2083)..(2083): n is a, c, g, or t
  misc_feature (2434)..(2434): n is a, c, g, or t
  misc_feature (2482)..(2482): n is a, c, g, or t
cggcacgacggcactaccagaacacaactcgctagctctgcatcatccgtcgttctggtgagcgagcgagcgagagacctagctagactgaccggcggccgccggcaggccgagaacgaagcgtttgtgcattgaaggagcaggagccatggcggaccagcagcagccacagcagcagccgcaggagatggacgttgaccgtaccggtggcctcgaactgcctccagggttccgcttccacccgagcgactttgagattgtcagccactacctcaagaataaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaaaggcagggctcccaggggtgacaaaaccaactgggtgatgcacgagtacaggctcgaaggcagcggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgccatggacccggtggccccctactaccccaacccaaatgccggcgcggggatgatgccgcctatggcattggcaggtatgggtggcgccggcgggctccagatcaacggcgctctgttcggcaatccggtgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgagcaggctaatgccgccgagatctcgtcgatgatgtctgtgaccggcccagggtccgcgaccaccaccatagagatggatggcatatggaagtacaagtactgaaaaagtggatatggagtttggagacaaatgcatgaatatgcatgttatatctactatatctgcattgcattttgtgaaaatttgcatggttcctatatttctgcaataactagtcggtaagatatgtgtgcatgcatgtgctagtatatacatgcattgtatcattgcatgtgtggtatatgtgtgtgtcgtttggtcttagtaatccggggcatgatggtacccatacctggatttacatctgcttggtcgtgctgatgttgtgttgtaatttgtaaaaagcagattgaagttcggtacagtatattatcgtgaacctatatatattatacttgtgtgaatgatagtatgttgtttaattttttgaacttgattgcgaaattaaactttaaattgtatgtatttaaattgtaatcttttttgttaaggctacttaccaaatatgtatgtgatagttgtcatcacgcctgcatacttttgcggcgccggataggaacaaaacaaatcctacggcgcgggctcaaccttatattcgctttctatcaataacagcttgtaacacgttttcctaacccactccacccccaataacccccacgttcgatccgtgcactccatatctaaaccatcaaccttaagcgtgtcggggctacgattctcatggttacgacccacacatatatagagtggttttaagggaggctggttcccgatagttgaagaagtgtgagggtgtgagatttgaagtagtttgtattnatgtcaaaaaaagaggctagcgacggtttgccactagagttatgcaagatctacaggtgtggtggatactagcgagcgtatgacctcctttattagtggattggagagcgttgtgaaggatcatgcatacggtgggcggtatggtagaggttgccggtaacacagattgccaacaatagttataatattatttatatcctaatcatttattttttgtctacaagatatatggttgtgcattataggtacatccttctagaaaagttcaattgttagcagctacaccgtttcatttgtttgtcctcctttgtttctcttttgtttccattcaaagggattctacagacagtncccatgaagtcgttggcactaacactaccggagacgcgttctttgccnagtgctcaaagctttgccgcgcacaaaatcttgggccctcggcaaagaatactttgtcgagcgccactctcagcgaaccatggcactcgacaaagacgactgtgccctgtgtaaagcactcgacatacatagacgctcgaaaaaggcggatttgccgagtgtcgagctctcgtcacaacgaggcactcgacaaagcgccatcagcagccgtctacagtttaactatgccgagtaccatgaaagttatgtctttgtcgagtgtcaccctcatacactcggctatcccatgacactcggcaaagtatatttgttttttttcttttttccccaaactttttttgtggtgtgttactacaatatatagacttatatgttcgattttggtacaagtatcaaagtgtttgctataactattggataagatataagatatgtgtgcatgcatgtgctagtatatacatggattgtatcattgcatgtgtgttatatgtgtgtgtcgtttggtcttagtaatctggggcatgcatgatggtacgcatacatggatttacatctgcttggtcgtgctgattgttgcgttgtaacttgtaagaagcagattgaagttcggtacagtatattaacgtgaacctatatataatatagatgtgtgaatgatagtatgttgtttaattttatgaacttgattgccaaattaaactttaaattgtatgcatttaaattgtaatcttttttgttaaggctacttaccaaatatgtatgtgatagttgtcacgcctacatacttttgcggcgccccggataggaacaaaacaaatcc

SEQ ID NO: 24553 - DNA, 2666 bp, Zea mays
cgtacgcgagaaaaaaatcaataacggaggcgctgctccggctggccggatccttccctcgtctgccccctcccgtgcgccctatctccccagcccccgccccgtcccagctctcactccgccgcgttctcctcctcctctcctccgccggcttcagccccacttcctgttacagcagcccttccttcgcagcgatggcggcggcggcgccgccggtggccaagaaggtcccgcggcagctcgttgagcacggcgacgtccgcgtcgacaactactactggctccgcgacgactctcgatccgacccggacgtcctcgcgcacctccgcgccgagaacgactacaccgccgccgtcatgtccgatgtcaagcaacttgaggatgaaatatatgctgaaatcagaggaagaataaaggaagatgatatagatgcgcctcttcgcaaagggcggtactactactatgaaaggacattgactggcaaggagtatgtgcaacactgtaggcgtcccgtatcgactgatgctcctattacagtccacgatgtgatgcccacaggacctgatgcccctgatgagcatattatcctggatgagaatgttaaggctgagggccacgactactacagcatcggagctttcaaggtcagtcccaacaacaagctagttgcttacgctgaagacactaaaggtgatgaaatctacacggtctatgtcattgacacggagagtggagaatatgttgggcaaccacttaaaggaattacttctgacattgagtgggctggtgacgaccacctcgtttacattacaatggatagtatacttcggccagataaagtatggctacataagttagggtctgaccaatcaagtgatgcttgtttgtatcatgagaaagatgatacattttctctcccccgcctcccttctgaaagcaagagatatttatttgttgaatctggaagcaaaaacacaagctttatattctacctggacatacccaaacagaacaaggaacttgctgttttgacacctcgtgtgtatggcattgatacaacagctagtcatcgtggaaatcatttctttattaagaggcgaagtgatgaattctacaattctgaattggttgcttgtccactggataatgtagctgagaccactatactgctaccacatagagaaagtgtgaaaatacaagacttccagctctttgacaaccatattgctgtatatgagcgtgagaatggccttcccaaagtgatcgtatatcggctacctgctattggagagtcaattggacaactccagggaggtcgagcgattgattttattgatccaacatatgctgtggaccctgaggagtctcagtttcattcatctgttctacgatttcattatagctcaatgcggactccaccctctgtttatgactatgatatggattcaggggtgtctgtgctgaagaagatccatactattttaggcggattcaatgcatcaaattatgtaacagaaagaaaatgggctgctgctgctggccgcactctgccgttgctgtcgattctatacagaaatgatcttgtgaagcttgatggctcagaccctatgctactctatggctatggctcctatgagatatgcatagatccgagttttagagggtcacgattctctctggtagataggggctttatatatgtgatagctcatatccgcggtggtggtgaaatgggccggaagtggtacgaggatgggaaactgttgaagaagaaaaacactttcactgatttcattgattgtgctgagcacttgataaaaagcaagtactgctccaggggaaagctttgcattaatggcagaagcgcaggtggcttattgatgggtgctgtcctaaatatgaggcctgacttattcagggcagctgttgctggagtgccttttgttgatgttgtcacaactatgcttgatccaactatcccactgacaacagctgaatgggaggagtggggtgatccaagaaaagaagaattctattattacatgaaatcgtattctcctgttgacaatgtgatggcgcaagagtatcccaacattcttgtcactgcaggcttaaacgatccacgcgtgatgtactctgagcctgcgaaatacgtggcgaagctgagggagctgaagagagatgacaatcttgtgctgttcaagtgcgagctgggagctggacacttctccaaatcgggaaggttcgagaaattacaggaggatgcgtttacttatgcgttcatcctaaaggcgctgggcatgactcggaagctggcatcactgtgaattcgattggtgtgaggcacctggactggatttgtatcatggcctgccctcttggttgggggatggatggattctgatggaatatgcatttagatttgaatagggacacagatgttatgcaaaagagattgtttgaaactttgaattctgatttgcatttggatatctgtcctagaataattgtgcttctattattcaatatttgcctcatttttaacctatggaccatctaaattttgctattttctcttctttcaaagtactacaatcattacatgttggtactagtattattttacaggagcatgtatgtaattttataaaaaaaaaaaaaaaaaa

SEQ ID NO: 24554 - DNA, 610 bp, Zea mays
gcagattttcctgacatgcttgtcggctcgcgagctgagcgaagagtggatgttgcactggatgcactggatgaagcagaacgggtttctgttgatgcaaaacgaaaacagactctaactgcagctgaagtttcggctttgaaaagatctatctctgataatcggcagaggctggcagatcagcttgctgaagctgcttgtcagtcttccactcgtggtattgagcttcgagctgcagcttctgccctcaaaagacttggtgatggcccccgagctcacagcctcttactgagtgcacataatcaaaggcttcaatgcaatatgcaaactatacatccatctagcacttcatacggtggggcatacactgcggcacttgcccaacaagttttttcagtcatagctcaggcactaagtgactctgtggatgtttttggtaatgagtcatgttatgcatctgaactggtaacgtgggctaccaagcaggttatgtcctttgcgctcctggtgaagaggcatgtgttgtcctcttgtgcagctgctggaggcttgagggcagctgcagaatgtgttcagatatcacttggccattgttttttgctggaagctc

SEQ ID NO: 24555 - DNA, 794 bp, Zea mays
ccgggagcattgctgcagaaatgtttgttggtagagaaagtatttgctactttactaatgatgcgcctcactgagacagtcatactgtggctctcagaggaccaggccttttgggaagagattgaacagggggctaagcctttaggccccctaggtctacaacagttctacctggacatgcaatttgtcatcatatttgggcaaggtcgttttctctctagacatgtacatcaagtcattttggacgtcattgatagagcaatggctgcattttctgctactggaatgaaccctgatagtgtccttccgggcgacgattggttcatggaggtctcccaagaagttgtcagcatcatcagtggaaggggtagagttgctaatggtgacagggaagcaaacagcccaacggcctcggtttcagcgcactccatttcttcgttcagatcccatggcagctcctagtttgcaagttggtattttttttggtaggcagatcactgtataataatcgatagtatattcttccaacctattcctccactcatttgttttttcttttctttttcaaaacttttgtgctagtattagtagagagggataattgtttaacctaggaaaataagtcttgagtcattttgttttagagagctgagtcatgcaagtgttgcatggccatattgcacgagatctgcaccgatctgtatcattctttcatcagtttttacttgccagttggcacgttgcatgtcatgggtacaagattctacgcttgaagttgtttgaaaagttttttt

SEQ ID NO: 24556 - DNA, 2764 bp, Zea mays
  misc_feature (247)..(247): n is a, c, g, or t
  misc_feature (831)..(831): n is a, c, g, or t
  misc_feature (893)..(897): n is a, c, g, or t
  misc_feature (927)..(931): n is a, c, g, or t
  misc_feature (1049)..(1054): n is a, c, g, or t
  misc_feature (1073)..(1182): n is a, c, g, or t
  misc_feature (1254)..(1259): n is a, c, g, or t
  misc_feature (1273)..(1302): n is a, c, g, or t
  misc_feature (1355)..(1382): n is a, c, g, or t
attcgtctccctccccttcgttggttcgtttgattgatttgggagcaacaactcccaccacccgcaaccgccgcaatctcccctcgccaactccgtctcggccgcaacccattcgccattgccgaggaggaggaggaggcccggtcgtctattctggatctcgaatggcgtcggccaagtcgtcgcggtcgcggcccgcgggccactcgggggtgttcccggtgggcagcgccgccgcggtggggancgggggcggcggtggcgacggcggggtgcagctcaccgacaagctcaagatcttcaaaaccgacaacttcgatcccgacgcctacgtgcagtccaagtgccagaccatgaacgagaaggaaataagacatttgtgttcttatctccaagacctaaagaaggcttcagctgaagaaatgcgtagaagtgtttacgcaaattatgctgcattcatcagaacatctaaggagatatcagaccttgaaggggaactgctgtcaattagaaatctgcttaatacacaggcagctttaattcacggtctatctgaaggagttcagatagattcattgacttcaggccctgaaggttctgcagaagacgacatatccaaggttgaagatcaggagccttcagaaattcagaaatggtctgcagatttccctgacatgcttgacgttttgctagctgagcgaagagtggatgaagcactggatgcactggatgaagcagaacgggttgctgttgatgcaaaacgaaaacagactctaactgcagctgaagttttggctttgaaaagatcaatctctgataatcgtcagaggnctggcagagctgcttgctggttttcgcttgcccatgagcccatgagggagtttctcacagannnnngcttctgccctcaaaagacttggtgatggnnnnngagctcacagcctcttactgagtgcacataatcaaaggcttcaatgcaatatgcaaactatacatccatctagtacttcatatggtggggcatacactgcggcacttgcccaacaggnnnnnncagtcatagctcaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcctcttgtgcagctgctggaggcttgagggcagctgcagaatgtgttcagatatcacttggccattgnnnnnngctggaagctcgtnnnnnnnnnnnnnnnnnnnnnnnnnnnnnncaattcaagcccagtttagtgcaagcattagatgctaacttgaggagaattgnnnnnnnnnnnnnnnnnnnnnnnnnnnntgataactggatactcacatatcccctaactggtattcgtccattaactagatcgtctgctgctaatttggcacttcagccaaagctctctagtagcgcacaccgtttcaattcaatggttcaggatttctttgaggacattgcaccactacttagcttgcaattgggccgggcaccacccgctgcgtccgcacaaattttcaattcatatgtaaacttgcttataagtgctttacctggttctatggatgatgaagctaacttagatggtttaggtaataagattgttagaatggcagagactgaagagcagcagttagctttattagctaatgcatctttactagctgaggagttgctacctagagcagctatgaagttatcgtcaataaaccagtctatggatgatttgcataaaagaggaacagataaacaaagccgtgtgcctgagcaacgtgagtggaaaagaaaactacaacgaatggtggacaggttgagagataatttttgcaggcagcatgctcttgaacttatatttacagatgaaggtgatactcatctcagtgcagaaatgtatatcagtatggacaatactgttgaagaaccagaatgggttccgtctccaattttccaggaactgtatgtaaagttaaacaggatggcaagcattgccgcagaaatgtttgttggtagagaaagatttgctactttactgatgatgcgcctcactgagacagtcatactgtggctctcagaagaccaggccttttgggaagagattgaacagggagcaaagcctttaggccccctaggtctgcaacagttctacctggacatgcaatttgtcatcatatttgggcaaggtcgttttctctctagacatgtacatcaagtcattttggatgtcattgatagagcaatggctgcattttctgctactggaatgaaccctgatagtgtccttccgggcgacgattggttcatggatgtctcccaagaagttgtcagcatgatcagtggaaggggtagagttgctaatggtgacagggaagtaaacagcccaacggcctcagtttcagcgcactccatttcttcgttcaaatcccatggcagctcctagtttgcaagtcggtggtattctttgtaggcaggtcattgtataataatcaatagtatattctttcaacctattcctccactcatttgttttttcttttctttttcagaacttttgtgctagtactagtatagatggataattgtttgacctaggaaaataaatcttgagtagtttgttttagagagctgagtcatgcttccgggacgaaatttgggtgaaatttgaaagagaactgcaccgatctgtatcattcttgggtcag

SEQ ID NO: 24557 - DNA, 1640 bp, Zea mays
  misc_feature (13)..(14): n is a, c, g, or t
tcgagggccggcnncgggggtacctcgtcgccggccaaagcgaccgccacctccccgaagctgccgcgaccgatcgagcgaagcgtcgctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcctccgcggcggcggaggtcagcgcaattcccaacgctaaggttgcgcaaccgtccgccgtcgtcttggccgagcgtaacctgctcggctccgacgccagcctcgccgtccacgcgggggagaggctgggaagaaggatcgccacggatgcgatcaccacaccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccacagtgttcgtggcatcggggatgtatgcagctgtggctatgctcagtgcacttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgctttgtattgacagtactttcgcgtcacctatcaatcagaaggcattaactttaggtgctgacctagttattcattctgcaacgaagtacattgctggacacaatgatgtgagttggtatactgaaatccatttctcattaaagctgtgtatttgcactaacaagagtattcgatacttcaatttcccaggttattggaggatgcgtcagtggcagagatgagttagtttccaaagttcgtatttaccaccatgtagttggtggtgttctaaacccggtgagtttaaattgttaaattttttgtttccatttatttattcttccttggacaggttatatgtatttacagattcccatagttacaagcttctatttttataggtagaaaatcgtgtaattttctttagtagcatatgtttaggttagaaaaataatttgctttctctgagtatcacaaaccgcatccagttctctgttacatgaactagaattctggttctggaaaggaagaaataggatatgttctgtgcactgcaatatatatctaatcattaatccggagctttatgtcacagactcacaggccaggctaccactttatgaaatattccaaattatgcttgtctcaaaaaaagtacctatatcgttcaatacaatcttccatctactactttgtcctgaacctttcgccatcttcttagcaggtaagcagaagcctggctagctggcctctggtatgtggttggctcaaggattacaggatttca

SEQ ID NO: 24558 - DNA, 2005 bp, Zea mays
cattgggaccctcgaggccggcccggcccgggccccgaggccggccgggacgcgaccgccacctccccgaagctgccgcgaccgatcgagcgaagcgtcgctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccgccgctcgccgccgcctccgcggcggcggaggtcagcgcaattcccaacgctaaggttgcgcaaccgtccgccgtcgtcttggccgagcgtaacctgctcggctccgacgccagcctcgccgtccacgcgggggagaggctgggaagaaggatcgccacggatgcgatcaccacaccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccacagtgttcgtggcatcggggatgtatgcagctgtggctatgctcagtgcacttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtatctcttttcttcacggagactcccacaaatccatttctcagatgcattgatattgagcatgtatcaaatatgtgccatagcaagggagcgttgctttgtatcgacagtacttttgcctcccctatcaatcagaaggcactgactttaggcgctgacctagttattcattctgcaacaaagtacattgctggacacaacgatgttattggaggatgcgtcagtggcagagatgagttggtttccaaagtccgtatttatcaccatgtggttggtggtgttctaaacccgaatgctgcgtaccttatccttcgaggcatgaaaacacttcatctccgtgtgcaatgtcagaataacactgctcttcggatggcccagtttttagaggaacatctaaagattgcccgtgtctactatcctggcttgcctagccaccctgaacatcacattgccaagagtcaaatgactggctttggtggtgtggttagttttgaggttgctggagactttgatgccacaaggaaattcatcgattctgttaagataccctatcatgccccttctttcggaggctgtgagagcataattgatcagcctgctatcatgtcctactgggattcaaaggagcagagggacatctatgggatcaaggacaacctgatcaggttcagcattggagtggaggattttgaggaccttaagaatgatcttgttcaggccctcgagaagatataagctccaatccatttgcattaataaagttatgaggtgatggttgtctggatcttgtagagatttgtgatgatacatgagctgttgactgcgattaagttctcttgtgcttattttattctttgaattcaataagctgtggttgctgcatcttgcatgtagtgttggacttaattttacttgtcaaattacaatagtttggtcccatgtacttgtgtccgcgcctccgcggttgtgcccctagtgtttttgtgtcatttgctgtgtagtgtgagattaaggcacgatgtccttaatcaccataataaatccatgccttaaatgtaaggatctggttggaatgataaagtgcggttgaagaaagaactatatataatttttctcagtgcacatcagattcaaaaaagcggcc

SEQ ID NO: 24559 - DNA, 802 bp, Zea mays
ggtacccccggagctcgccgacgcgaccgccacctccacctcctcgaagccgccgcgaccgaacgagcgaagcgtcccttcccgcgccgacgccgaaaccctagctcctcttacgccatggccaccgtgtcgctcactccgcaggcggtcttctccaccgagtccggcggcgccctggcctctgccaccatcctccgcttcccgcctccgcggcggcggatgtcagcgcaattcctaacgctaaggttgcgcagccgtccgccgtcgtattggccgagcgtaacctgctcggctccgacgccagcctcgccgtccacgcgggggagaggctgggaagaaggatagccacggatgctatcaccacgccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccaccgtgtttgtggcgtcagggatgtatgcagctgtggctatgctcagcgcacttgtccctgctggtgggcacattgtgaccaccacggattgctaccccaagacagggatttacatggaaaatgagctccctaagaggggaatttcgatgactggcattaggcctgctgacagggatgctctcccaaatgcgttggaccacaataatgtatctcttttcttcacggagactcctacaaatccatttctcagatgcattgatattgaacatgtatcaaatat

SEQ ID NO: 24560 - DNA, 2065 bp, Zea mays
  misc_feature (2044)..(2050): n is a, c, g, or t
acgcactctgacggtcttgccagtttgccactacaaataagccgcaccgcatttcggaagaccacgcgaccgccacctccccgaagctgccgcgaccgatcgagcgtcgctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccgccgctcgcccccacttaggcggcggcggccgccgcgcccgcggcgtggcctcctcccacgccgcggctgcatcggccgccgccgccgcctccgcggcggcggaggtcagcgcaattcccaacgctaaggttgcgcagccgtccgccgtcgtcttggccgagcgtaacctgctcggctccgacgccagcctcgccgtccacgcgggggagaggctgggaagaaggatcgccacggatgcgatcaccacgccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccaccgtgttcgtggcgtcggggatgtatgcagctgcggctatgctcagcgcacttgtcccggctggtgggcacattgtgaccaccacggattgctaccgcaagacaaggatttacatggaaaatgagctccctaagaggggaatttcgatgactgtcattaggcctgctgacatggatgctctccaaaatgccttggacaacaataatgtatctcttttcttcacggagactcctacaaatccatttctcagatgcattgatattgaacatgtatcaaatatgtgccatagcaagggagcgttgctttgtattgacagtactttcgcgtcacctatcaatcagaaggcattaactttaggtgctgacctagttattcattctgcaacgaagtacattgctggacacaatgatgttattggaggatgcgtcagtggcagagatgagttagtttccaaagttcgtatttaccaccatgtagttggtggtgttctaaacccgaatgctgcgtaccttatccttcgaggtatgaagacactgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaattcattgattctgttaaaataccctatcatgcgccttcttttggaggctgtgagagcataattgatcagcctgccatcatgtcctactgggattcaaaggagcagcgggacatctacgggatcaaggacaacctgatcaggttcagcattggtgtggaggatttcgaggatcttaagaacgatctcgtgcaggccctcgagaagatctaagcactctaatcagtttgtattgacaaaatcatgaggtgatggctgtcttggatcttgtcaagatctgtgacaatgatatgagctgatgactgcgaataagttctcttttgcttattttatccgtcaaattcaataagctgtgattgctgcatgatctagtgttgggcttagttacacttgtcaagttaaattggtctggaaccatgtatacttgtagttttgctttagagtggtgacctggctatgtgggatgaggtcacgcttcccttcaattactgtgagattcacacatttaataatcttgataataaaaatgaaaatcctcacaaggaattaacgtaagccggaaaaaaaaaaagcggccnnnnnnnggccgcgaattcgga

SEQ ID NO: 24561 - DNA, 904 bp, Zea mays
ggtacgcactctgacggtcttgccagtttgccactacaaataagcttgggtacctcgaggccggccggggcgaccgccacctccccgaagctgccgcgaccgatcgagcgaagcgtcgctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccgccgcctccgcggcggcggaggtcagcgcaattcccaacgctaaggttgcgcaaccgtccgccgtcgtcttggccgagcgtaacctgctcggctccgacgccagcctcgccgtccacgcgggggagaggctgggaagaaggatcgccacggatgcgatcaccacaccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccacagtgttcgtggcatcggggatgtatgcagctgtggctatgctcagtgcacttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtatctcttttcttcacggagactccccacaatcc

SEQ ID NO: 24562 - DNA, 1845 bp, Zea mays
aaaaaaaaacagttcgctccccccggcgcgcccggacgcgaccgccacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcctctgccaccatcctccgcttcccgccaaacttcgtccgccagctcagcaccaaggcacgacgcaactgcagcaacatcggcgtcgcgcagatcgtcgccgccgcgtggtccgactgcctcgctgctcgccgcctccgcggcggcggatgtcagcgcaattcctaacgctaaggttgcgcagccgtccgccgtcgtattggccgagcgtaacctgctcggctccgacgccagcctcgccgtccacgcgggggagaggctgggaagaaggatagccacggatgctatcaccacgccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccaccgtgtttgtggcgtcagggatgtatgcagctgtggctatgctcagcgcacttgtccctgctggtgggcacattgtgaccaccacggattgctaccgcaagacaaggatttacatggaaaatgagctccctaagaggggaatttcgatgactgtcattaggcctgctgacatggatgctctccaaaatgcgttggacaacaataatgtatctcttttcttcacggagactcctacaaatccatttctcagatgcattgatattgaacatgtatcaaatatgtgccatagcaagggagcgttgctttgtattgacagtactttcgcgtcacctatcaatcagaaggcattaactttaggtgctgacctagttattcattctgcaacgaagtacattgctggacacaatgatgttattggaggatgcgtcagtggcagagatgagttagtttccaaagttcgtatttaccaccatgtagttggtggtgttctaaacccgaatgctgcgtaccttatccttcgaggtatgaagacactgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaattcattgattctgttaaaataccctatcatgcgccttcttttggaggctgtgagagcataattgatcagcctgccatcatgtcctactgggattcaaaggagcagcgggacatctacgggatcaaggacaacctgatcaggttcagcattggtgtggaggatttcgaggatcttaagaacgatctcgtgcaggccctcgagaagatctaagcactctaatcagtttgtattgacaaaatcatgaggtgatggctgtcttggatcttgtcaagatctgtgacaatgatatatgagctgatgactgcgaataagttctcttttgcttattttattcgtcaaattcaataagctgtgattgctgcatgatctagtgttgggcttagttacacttgtcaagttaaattggtctggaaccatgtatacttgtagttttgctttagagtggtgacctgactatgtgggatgaggtc

SEQ ID NO: 24563 - DNA, 3127 bp, Zea mays
tttatatttattttcagctgtgccgatttatatcgatatccgtatcctttatctttaaaaatacgaatgcaaataaatattagatacggatcagcattcaagtccggatattgagtagactcgaataccattattcgtaccatttaaccttgctcaagggtcagcgatgaatgccgaccagcagaacaactttgatctttaacttttttaaactaaagtatattctccgaatcagttaaccgcgtgatgggaatttgaagtttgcaactaatagcagactgctcaccaacccaaataaaggtggccgcccaaatacctaccgtttggcgtttgcaaccaccggaataatgcagcgccgcgtcgtctctcatcagtgctcaaatcaaatgcatacccaaacaactactactagctagtacgccgacgatctggctggtttttttccctttggaatcaatcattgtttgcaaggacgaactgattttttttttctgatcatagtttgcacaagtggtctaccgttacaaactggtttattttttttcacaaatatcaaaacgcacactacatctacatgaaaccggaaaacgaaaaaaagaaaaagaaaaacaggaagagcaaaacctcctccaagagcaactctcccaagcaagcacctactatactactagtaactaatagctagaaaacaagtgggtcggtcggtcggtgtgtgggtgggtctactacatgacggagcaggcgttggggttctcgtcgctgaaggcggcggtgtagcggacctcggtggaggaggccctggcgagcggcgcggcggtggggtcggcgacgacgttgcggacgtagccggcgggggccttcttgtcgtaggcgcccggcgcgtaggggtgctgcaccatctcgtagggcacgtagggccagggctccacccgcttgcctgtcttgtaggcgacgcggcgcatgaccttggcggcgtccacgtagcccgtgaccgtcaccttgttctgcttggccgccacctccacggagctcacgcccttcatgccctccaccgccttcttcaccttgcgctcgcacccttcgcagtcgatgcgcaccttcatctccaccgtctgcggcgagtccagttcagctgttgggctggctgggataaagaccccgaacagaaacagaagaagatggtttatatatacctggaactgcttcctcttcttgagatgccggcgagtcctcggcaaggagcagaactcggagacgacgtcgacgatgcccatcgctcgcagcaggccttctcttcccttcccttcccttcccttcccttcacttggaccccaccccttcgtaccggaatggagaaacaaggaaagatctgctcagcgctctagtacaacaaagtgaactgcgactcttttgagaggagcagcagacagagagagctagctggtggtggtgccttcttcccacgcacccagaccgatcgataaatataggcatcttcggcaccgcccgcgtccagtgccgccccgacacgtgggtgcgcgaggccgcgtcgatctttcaaaaaaaaaaattaggacgcctcgccccgcggaggactgatctttcccaactggtgtgaacggacgggggcctctgcaggcatgtacgcgcctgtttaggacgcagtgaaatttcactcactaaaggctagtgtgaaaccttttttaaagtgatttctatttttttcaaagaaaaattaactaatttttttagtaaaataaaaaccccttgttaaaatagatttccaaactagctctaacagtatagtctatcatacaaatagttttacactatcatatagaagatcttagctatctccagcgaaagcttataaaactgttccatataacttgtacaagactgtccgtcagatagagacctactgttactactagtactacaatgcaagctcagctcgtggagtcgttgcaatgcagacggccgtcggtaggatcaggatgatgaattgaagacgacacccgggaccggggaggggaagaagaaacggcggtggttacggaggcagctgtgcttcgatgtgatgtgggccccacacgccatgtgaggcgggggtgggggccacgtgggtggggtcgggcacgtcgacaggtggtgaagcaccgaggatgacgcccgccatggctactatggcggtcaggtcgaggcccgagggtacggctgcgtgccgactacgaatgctcctgaggactcgatctaaacggctgcgaggaagctgccaaccggccaaaaaaaataataacgggggcgtgaacttgtttggctactgtcctggtctggggctcagagagtcaggcccagacagagacagcagcaccgcccatccgctgtttacgaggtttactatttgacactcgtagtatatgtactggcaactgattttatattcgaaaataaaaaactgtaccgaattgctaacgaaagtttctcaaatcaaatatctgaaatcagaaccgaacaacttcaaaaaaaaaacaatatttataagtttctgaagttagtggtgacgagcttttatatattgttttgggtatttttggagatgacgtgttcgtgtcgagatggtactggcaccgtcacacatgctatacggtttgtgacgttttctcaagtcacggaacggtgacctatcctgggacgatcaatgaagctgacatcgggtgtggactccctgaggcctcgtaattatccactggtacgtacggcccctccctcccgccaaggacttggccgtcgtacgttccccttccgcggatgcgatgcgcagggggttgccgccacgcgcgatgggcacgtcacgggtctggctcacgactaataacgagcggctgcttccttgaaccacggacgatccttcgttttcctatacacggccatgccatgccttagcgcccacgtgctactctgcttctgtcagactgtcaccgtgtgggccggggtgctctaggactcgaggcagatggtccatgcttggttgccaaacaacatctccacatgtcagtgttaagaactctttgctacttgataaagtccaaaagctacttaactcacaaacacaggagacataaag

SEQ ID NO: 24564 - DNA, 1002 bp, Zea mays
taggggcctttttttttttttttttcttgcaaggacgaactgatttttttttctgatcatagtttgcacaagtggtctaccgttacaaactagtttattttttttcacaaaaatcaaaacgcacactacatctacatgaaaccggaaaacgaaaaaaagaaaaagaaaaagggtcaggaagagcaaaacctcctccaagagcaactctcccaagcaagcacctactatactactagtaactaatagctagaaaacaagtgggtcggtcggtgtgtgggtgggtctacgtctacatgacggagcaggcgttggggttctcgtcgctgaaggcggcggtgtagcggacctcggtggaggaggccctggcgagcggcgcggcggtggggtcggcgacgacgttgcggacgtagccggcgggcgccttcttgtcgtaggcgcccggcgcgtaggggtgctgcaccatctcgtagggcacgtagggccagggctccacccgcttgcccgtcttgtaggcgacgcggcgcatgaccttggcggcgtccacgtagcccgtgaccgtcaccttgttctgcttggccgccacctccacggagctcacgcccttcatgccctccaccgccttcttcaccttgcgctcgcacccttcgcagtcgatgcgcaccttcatctccaccgtctggaactgcttcctcttcttgagatgccggcgagtcctcggcaaggagcagaactcggagacgacgtcgacgatgcccatcgctcgcagcaggccttctcttcccttcccttcccttcccttcacttggaccccaccccttcgtaccggaatggagaaacaaggaaagatctgctcagcgctctagtacaacaaagtgaactgcgactcttttgagaggagcagcagacagagagctagctggtggtggtcccttcccgggccccccccgaccgacccattgatataggcatcttcgcaccgcccgcgtccagtgccgccccgac

SEQ ID NO: 24565 - DNA, 1029 bp, Zea mays
gacaggatattttccctttggaatcaatcattgtttgcaaggacgaactgatttttttttctgatcatagtttgcacaagtggtctaccgttacaaactggtttatttttttcacaaaaatcaaaacgcacactacatctacatgaaaccggaaaacgaaaaaaaaagaaaaagaaaaacaggaagagcaaaacctccctccaagagcaactctcccaagcaagcacctactatactagtactaactaatagctagagacaagaagaacgatggagctgccacctcttgaggtcgagatccagaagtccagaaagaaaacaaggggtcggtgggtgggtctacatgacggagcaggcgttggggttctcgtcgctgaaggcggcggtgtagcggacctcggtggaggaggccctggcgagcggcgcggcggtggggtcggcgacgacgttgcggacgtagccggcgggggccttcttgtcgtaggcgcccggcgcgtaggggtgctgcaccatctcgtagggcacgtagggccagggctccacccgcttgcccgtcttgtaggcgacgcggcgcatgaccttggcggcgtccacgtagcccgtgaccgtcaccttgttctgcttggccgccacctccacggagctcacgcccttcatgccctccaccgccttcttcaccttgcgctcgcacccttcgcagtcgatgcgcaccttcatctccaccgtctggaactgcttcctcttcttgagatgccggcgagtcctcggcaaggagcagaactcggagacgacgtcgacgatgcccatcgctcgcagcaggccttctcttcccttcccttcccttcccttcacttggaccccaccccttcgtaccggaatggagaaacaaggaaagatctgctcagcgctctagtacaacaaagtgaactgcgactcttttgagaggagcagcagacagagagctagctggtggtggtgcctttcgcgccggctcccctggtctccccgccggcctcgaggtacccaatg

SEQ ID NO: 24566 - DNA, 869 bp, Zea mays
agttgcaaggacgaactgtatttttttttcctgatcatagtttgcacaagtggtctaccgttacaaactggtttatttttttcacaaatatcaaaacgcacactacatctacatgaaaccggaaaacgaaaaaaagaaaaagaaaaacaggaagagcaaaacctcctccaagagcaactctcccaagcaagcacctactatactactagtaactaatagcttgggtcggtcggtgtgtgggtgggtctacgtctacatgacggagcaggcgttggggttctcgtcgctgaaggcggcggtgtagcggacctcggtggaggaggccctggcgagcggcgcggcggtggggtcggagacgacgttgcggacgtagccggcgggggccttcttgtcgtaggcgcccggcgcgtaggggtgctgcaccatctcgtagggcacgtagggccagggctccacccgcttgcctgtcttgtaggcgacgcggcgcatgaccttggtggcgtccacgtagcccgtgaccgtcaccttgttctgcttggccgccacctccacggagctcacgcccttcatgccctccaccgccttcttcaccttgcgctcgcacccttcgcagtcgatgcgcaccttcatctccaccgtctggaactgcttcctcttcttgagatgccggcgagtcctcggcaaggagcagaactcggagacgacgtcgacgatgcccatcgctcgcaggccttctcttctcttcacttggacccctccccttcgtaccggaatgaagaaacaaggaaagatctgctcagcgctctagtacaacaaagcgaactgcgactctgagcaggagacagagagctagcaggtggtggtgcctt

SEQ ID NO: 24567 - DNA, 2437 bp, Zea mays
  misc_feature (579)..(579): n is a, c, g, or t
  misc_feature (608)..(608): n is a, c, g, or t
  misc_feature (733)..(733): n is a, c, g, or t
ggccaccagtcctaatcctcgaaaatatctcacgattctgacaaatatccgaacagccaggcgcgagccgttcaccttctcgtggggtggggggtattcctcgagccccgcccggccgggcagcgctcccgtgccatcgccattcacctccagccaggctccggaaccttatcgccaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggacggagccctcctcttcgtaancactagtcgtcagttgagtgtacttgaanttcaaattgtatttgaaaatgacaaatttctgcctagtctgccatggtcactggatgagtgttgttaaaactgggctggttcgagttcagttagatttacatgcagtttaaatatcagaaaatcncactagagaaatgtctaaattgggtcggtgttacagtaaatactaaatagtggcaagaatcgtcatgttattcaaatggtcaattccaaccaaaacagatgcatgcatgttttaagtttttgcgtttgaataccctaaggtcctgttcgtttgcacatgaatacaccagggattattctagctaatcaaaacttatatatattatagaagcaatctggacaggaattgttccagagctccattccgtaataaccgaacgtcccctaagctttctttgtgtttctaggttgtatatgacagaatgactggacggagccgaggatttggattcgtgacaatgtcttcggcccaagaagccgaagctgctgtcgagcagttcaacggttatgtgaggatactttcactcttttaagctaactgtctcttttggtatgttactgaggaaaaatatgtggcagcagtgctgataatgccagttcttaggattttcggattcggggtttgcactaaagcttgcattgctcggaaacctgacatcggaatcataccttctatccaatcattggtcatagcttctggctagctgtttgggactgaattgcttctatcgagtgcatagtgcgtgacattgcagataagactattgactaattaacctcgcctcgcaaacaggcatttcgctcggtacccctgagggtgaactgcgggccaccgccacctagagatgaatccacaccaagagcaccaaggggtggtggtggcggcggcggcggcggctttgtcgattcagctaacaaggtctacgtggggaaccttgcgtggggcgttgacaactcgactctggagaacctgttcagtgagcaagggcaagtgcttgatgctaaggtcatctacgacagggatagcggcaggtcaagggggtttggtttcgtcacctatggctccgcccaagaggtcaacaatgccatatcaaacctcgatggcatcgtaagtcctatgctattttgatcctttagcgcattgttgtacatagaggatgtgctaatctgaatgttttatcgtaatgcaggacttggatggtagacagatccgagtcacggctgcggagtcaaagccgagacgtcaattttgagattattttcttatgggggtttagaggctgatagtgtgtttcaaaacttttagtttgtagtgtctattctttcctccatatgagtaccaagaagatgataatgagagactggctgtgaaatggctgtatacaggaagacttttccccgctggaaagatgcatttatttgtttcagctgtaccacaaaattggcagttcaaatttcccttccatctactcgctttattttaaattataagagaatttagcttttctaaatactagcttttgctatgtgtacgccatatgtagatgtataggaaaaacaatgtttctgagatatttaagaaggacaacaactaatatgccagcaatcattaaatgcaagcgtttaagcaggttttttggtccatttgatttagatctagccgtagatgtaatggtattgatgtttgactagtgattgattgacaggacaataacataaaacaaatagatatagagatacaacattgtattgttatttggttgttaatagtatacatttagctacattcgatgttgtttaacactttagcacaagtggtcatgaa

SEQ ID NO: 24568 - DNA, 1316 bp, Zea mays
tcgaggccggccgggctgcggccggccgggcctccgggctatccccgccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagtcgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggtggtggtggtggtggcggcggcggcagctttgtcgattcagggaacaaggtatacgtggggaaccttgcatggggcgttgacaactcgactctggagaacctattcagtgagcaaggacaggtgctggatgctaaggtcatctacgacagggatagcggcaggtcaagggggtttggtttcgtcacctatggctctgccgaggaggtcaacaatgccatatcaaaccttgatggcatcgacttggatggtagacagatccgagtcacggttgcagaatcaaagcccaggcgtgaattttgagattttgttaaggtggtttagaggtcaatagcgtgtgttcacaagttctagtttgtagcgtctattctttcttccgtatgagtaacaagaagatgctgataatgagagactggaagtgaaactgctgtccacaggaagatatttttcccaacccttctatactcgtcgcgccttcaaacagaagtagaaatcttaacaaagttgtgccacatgcgtacataacaaacattcaagagcactttttcctgaatgttcgtgatgacacgtgtcgtgtatgaatccccgtctctgatgaggtagggtgaaaaatttcagctctagaaaggaaaacttgtattcagctcagctcaaaatgaaaaccggcattgcctaaggctggctgcaatggcagcccgccagcccctccccccttaaa

SEQ ID NO: 24569 - DNA, 1275 bp, Zea mays
gccggccgttccggggtgccatcgccattcacctccagtcagccgcccgggccgggtccccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtcgccgtcgcggtgtcgtcggagtacaagacggagggcgcggagcaggagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggacggagccgaggatttggattcgtgacaatgtcttcggccgaagaagccgaatctgctgtcgagcagttcaacggttatgcatttcaaggaagacaactgagggtgaactgcgggccaccaccacctagagatgaatccacaccaagagcaccaaggggtggtggtggcggcggcggcggcggctttgtcgattcagctaacaaggtctatgtggggaaccttgcgtggggtgttgacaactcgactctggagaacctgttcagtgagcaagggcaagtgcttgatgctaaggtcatctacgacagggatagcggcaggtcaagggggtttggtttcgtcacctatggctccgcccaagaggtcaacaatgccatatcaaacctcgatggcatcgacttggatggtagacagatccgagtcacggctgcggagtcaaagccgagacgtcaattttgagattattttcttatgggggtttagaggctgatagtgtgtttcaaaacttttagtttgtagtgtctattctttcctccatatgagtaccaagaagatgataatgagagaccggctgtgaaatggctgtatacaggaagacttttccccgctggaaagatgcatttatttgtttcagctgtaccacaaaattggcagttcaaatttcccttacatcaaaaaaaaccctggtaggtccggaccggtacagaatttagcttttctaaatactagcttttgctatgtgtacgccacaaaattggcagttcaaatttcccttccatgtactcactttatttaagaaggacaacaactaatatgcaagcaatcattaggtgc

SEQ ID NO: 24570 - DNA, 1127 bp, Zea mays
ccgcccccgtgccatcgccattcacctccagccaggctccggaaccttatcaccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggacggagccgaggatttggattcgtgacaatgtcttcggccgaagaagccgaagctgctgtcgagcagttcaacggttatgcatttcaaggaagacagctgagggtgaactgcgggccaccgccacctagagatgaatccacaccaagagcaccaaggggtggtggtggtggcggcggcggctttgtcgattcagctaacaaggtctacgtggggaaccttgcgtggggcgttgacaactcaactctggagaacctgttcagtgagcaagggcaagtgcttgatgctaaggtcatctacgacagggatagcggcaggtcaagggggtttggtttcgtcacctatggctccgcccaagaggtcaacaatgccatatcaaacctcgatggcatcgacttggatggtagacagatccgagtcacggctgcggagtcaaagccgagacgtcaattttgagattattttcttatgggggtttagaggctgatagcgtgtttcaaaacttttagtttggagtgtctattctttcctccatatgagtcccaagaagatgataatgagagccctggctgtgaaatggctgtatacaggaagacttttccccgctggaaagatgcatttatttgttccccctgtaaccacaaaattggcaaaaaaaaaaaaaaaaaaaaaaaaaaagggcggcccgcgatc

SEQ ID NO: 24571 - DNA, 2536 bp, Zea mays
  misc_feature (2247)..(2247): n is a, c, g, or t
gtgaccgataaaagtactcagcaaaaaagtcgttaccgatgtacagttcaacgagaattctttgtcgagtgtcacactcgataaagattttgctgagtattttaccgactttatcaaatgatttagacaatcgacaaagcaactggcttttttttttttttttttttgcgcaatgaacacggagagctttattgactcggaggaccggtgcgcaacgcaacgacacgtcgtcggatgcacgacggacgcaggcagcaaacatcagccagagacaaggacacggaccgcggtacgtagctagctagtaagcaaattaaggaaccagcacgggcaccacaccacaccagcgacgtgcactagtaaactgtgacgcgtcgatgaatggactggaactgtactgtactggaccatctccagttctcgctccatctagttcttgaggaggtagtcgtcgaggtcgtggaacgtcttggtggcggtctccttgatgacgtccgggtcaggcacctggtcgttggccttgtcgaactccatggcccagctgacgacggcgccgccctcgccctccgccttggccggagtcaccttcagcgtgatcttgaagttcttgtagaagtccgccagctcgccgtccaccacgctgtacgacaccaccttgttctcgtcgtccgccgtctcaagcttctccttggcgaacgtcagcatcggcaccgctacagcaaacatccgatgtatatgcaagagatactcaggtcccagtccaagagaggcgctaggcgctagccaagccaagaatggttacgtagtaccgtaccctcggtgtacttgaggaggcggacggtgccggccgacttgccgtcgccctcgacggtctcgatgctcttgtactgctcggggaagatcttggggaacagctccgtcgagtcacgcagcgccgcccacagcttgtcagccggggacttgacctccaccaccagctcaaccttggacgccattgcctctgcacagatagctagtgatgtggctgactggctgtggtctatagtgtgtctggcgatggtgagacctcgccccagaccttgtatatatacagagccagcgacatctcagaccgcgacagctcttcttcagaggtgacgagccggtgctactgatgccggccattcaaggtttccctgcgcgatccaaccacctcgatcaggctcgaattcaattgcgcccgtcggtgcagatccgtgccgcaaagaggccgtattttgatggcggtggtgtgcctgcaccgtgtgcccgtggaattcgagggcacgaggtcgccgcacagggcggagtaatgggaggtgattctttgataggagaaattagatgacgccaccaggccatgccaggtctggttggcagggggccccagcaggagggaggtccggttccggccggaacagtaacgagtctctcgtgcaggcgacaatggcaaaatgcagtactgctctgaaccgaaaatgcagagttggagacaagttcggatgggacatccatcgggtgccacccaaccccaactgcaatagcgagcggttcagggcctacccaaacattacttgtgcgcgaaaaggttgttgatgccgatttgtctcgtctgcagcccaggttgtcctctctaaaagatctaaaatgcaactcgttaattggatgtttatggtttaacttctgttgctgctttatgtgtgaattggatgaattcttctgcggattctgttgcatgtggattgaaactgacatcgttcaaatctgaaccaaaatgaagtagacaattacatcgaatttgaatgcgttgggggcctgcttactaatgccggttggggagataaaaatgactatacaaagctgcgtttagactgtcgctcagatagaactgttgtaatccacattcttggcagttcctccaagttattgacggccgtcctaagcgccctgctcggaatggctgtaggctgtagtgacatcgaagcttgtgaattgtgatgttatctctcagcagtatatgcatccagtgaggttcccaccttcatacagacatttttttccctgaagaaccatcgggaacttggtatggctaagatattgatctcgggcaggtttgcagcaaatattgcatcaagtttgtccaagtgaatgccatgcatttcaagttttcaactattgtgtcattgatctctctctttcttatgcttttgctagaaatttagtccacantgccatgaattgtgggatctaaagtgacaagtgacataaatggtctctaactgagttggttaggtggtctaaatttaacttcttgtacaagcgaatttcagcctgtagttaaagaatcccatcatctgtcctaccctacatcaaagcattagtgtggggtccacttccgatcacggtcgtttctcacatgagctatggtgatgctatgtattggtgggacggaggtttgagtgttttctttatttgcgtgagaaggtcttttttaatatagtatccgggatgtcttacc

SEQ ID NO: 24572 - DNA, 837 bp, Zea mays
cgataggttcgaagcgatgcgcatgaacacgagagctttattgactcggaggaccagtgcgcaacgcaacgacacgtcgtcggatgcacgacggccgcaggcagcaaacatcagccagagacaaggacacggaccgcggtacgtagctagctagcaagcaaattaaggaaccagcaggcaccagcaccacaccacaccagcgacgtgcactagtagactgtgacgcgtcgatgaatggactggaactgtactgtactggaccatctccagttgtcgctccatctagttcttgaggaggtagtcgtcgaggtcgtggaacgtcttggtggcggtctccttgatgacgtccgggtcaggcacctggtcgttggccttgtcgaactccatggcccagctgacgacggcgccgccctcgccctccgccttggccggagtcaccttcagcgtgatcttgaagttcttgtagaagtccgccagctcgccgtccaccacgctgtacgacaccaccttgttctcgtcgtccgccgtctcaagcttctccttggcgaacgtcagcatcggcaccgcctcggtgtacttgaggaggcggacggtgccggccgacttgccgtcgccctcgacggtctcgatgctcttgtactgctcggggaagatcttggggaacagctccgtcgagtcacgcagcgccgcccacagcttgtcagccggggacttgacctccaccaccagctcaaccttggacgccattgcctctgcacagatagctagtgatgtggctgactggctgtggtctatagtgtgtctggcgatttcgccggcggcctcggagggtgtacc

SEQ ID NO: 24573 - DNA, 890 bp, Zea mays
  misc_feature (873)..(873): n is a, c, g, or t
  misc_feature (875)..(876): n is a, c, g, or t
gccggagctcgaagggcctttttttttttttttttgcgtacaatgaacaaggagagctttattgactcggaggaccagtgcgcaacgcaacaacacgtcgtcggatgcacgacggacgcaggcagcaaacatcagccagagacaaggacacggaccgcggtacgtagctagctagcaagcaaattaaggaaccagcacgggcaccagaccacaccagcgacgtgcactagtaaactgtgacgcgtcgatgaatggactggaactgtactgtactggaccatctccagttgtcgctccatctagttcttgaggaggtagtcgtcgaggtcgtggaacgtcttggtggcggtctccttgatgacgtccgggtcgggcacctggtcgttggccttgtcgaactccatggcccagctgacgacggcgccgccctcgccctccgccttggccggagtcaccttcagcgtgatcttgaagttcttgtagaagtccgccagctcgccgtccaccacgctgtacgacaccaccttgttctcgtcgtccgccgtctcaagcttctccttggcgaacgtcagcatcggcaccgcctcggtgtacttgaggaggcggacggtgccggccgacttgccgtcgccctcgacggtctcgatgctcttgtactgctcggggaagatcttggggaacagctccgtggagtcgcgcagcgccgcccacagcttgtcagccggggacttgacctccaccaccagctcaaccttggacgccattgcctctgcacagctagctagtgatgtggctgactggctgtggtctatagtgtgtctggcgatcccggcccgcctcggggtacccaatgtggttccctttttttttttntnntaaaatatgaaaaa

SEQ ID NO: 24574 - DNA, 970 bp, Zea mays
  misc_feature (54)..(69): n is a, c, g, or t
aattcgcccttaaactgtggtaacaacggcagagtccttttttttttttttttnnnnnnnnnnnnnnnngtaccgggccccccctcgtgtttttttttttttttttttgcgcatgaacacgagagctttattgactcggaggaccagtgcgcaacgcaacgacacgtcgtcggatgcacgacggccgcaggcagcaaacatcagccagagacaaggacacggaccgcggtacgtagctagctagcaagcaaattaaggaaccagcaggcaccagcaccacaccacaccagcgacgtgcactagtagactgtgacgcgtcgatgaatggactggaactgtactgtactggaccatctccagttgtcgctccatctagttcttgaggaggtagtcgtcgaggtcgtggaacgtcttggtggcggtctccttgatgacgtccgggtcaggcacctggtcgttggccttgtcgaactccatggcccagctgacgacggcgccgccctcgccctccgccttggccggagtcaccttcagcgtgatcttgaagttcttgtagaagtccgccagctcgccgtccaccacgctgtacgacaccaccttgttctcgtcgtccgccgtctcaagcttctccttggcgaacgtcagcatcggcaccgcctcggtgtacttgaggaggcggacggtgccggccgacttgccgtcgccctcgacggtctcgatgctcttgtactgctcggggaagatcttggggaacagctccggccagtaggactcgaccttgatgttggccgccttcacgatcgtggcgatcttctcggcggtgatggcgatgccatcgtcgctgaggatgagagcggcgtaggtgcaggcaagctcgccggaggccatgggttcgtgcggcttccactcaccggacgacggatctgcggtatcagattgagagaggcggtgaggcggcagggtggattct

SEQ ID NO: 24575 - DNA, 892 bp, Zea mays
gctggagagctcgcgcggccccctttttttttttttttttgcgaatgaacacggagagctttattgactcggaggaccggtgcgcaacgcaacgacacgtcgtcggatgcacgacggacgcaggcagcaaacatcagccagagacaaggacacggaccgcggtacgtagctagctagtaagcaaattaaggaaccagcacgggcaccacaccacaccagcgacgtgcactagtaaactgtgacgcgtcgatgaatggactggaactgtactgtactggaccatctccagttctcgctccatctagttcttgaggaggtagtcgtcgaggtcgtggaacgtcttggtggcggtctccttgatgacgtccgggtcaggcacctggtcgttggccttgtcgaactccatggcccagctgacgacggcgccgccctcgccctccgccttggccggagtcaccttcagcgtgatcttgaagttcttgtagaagtccgccagctcgccgtccaccacgctgtacgacaccaccttgttctcgtcgtccgccgtctcaagcttctccttggcgaacgtcagcatcggcaccgcctcggtgtacttgaggaggcggacggtgccggccgacttgccgtcgccctcgacggtctcgatgctcttgtactgctcggggaagatcttggggaacagctccgtcgagtcacgcagcgccgcccacagcttgtcagccggggacttgacctccaccaccagctcaaccttggacgccattgcctctgcacagatagctagtgatgtggctgactggctgtggtctatagtggtctggcgatcccggccggcctcgaggtacccattgttttttttttttttttttttttggatagaccggccggc

SEQ ID NO: 24576 - DNA, 949 bp, Zea mays
aattcggcacgaggcaaacccccgcggccccgcccgctcggggccgcagcgattcggccaagtccccaacccctctcccgctgcatcaccaccacctctcttcgctctccgcttcgatctcgatcgccctcgcaattcctccgtaaagcgcccctgccctgggcgagctatagcgcgcgcgcgcgcccagatctgcgcggtctcgccggcgatggcgtgcatcaagagcgcgcagcgggcggcgctgacggcgttggcgccggacgcgccgtacctcgccgcgggcaccatgaccggcgccgtcgacttgagcttctccgcctccgccaacatcgagatcttccgcctcgacttccagtccgactccccggacctcccgctcctcgccgccgcgccctccccggaccgcttcaaccgcctctcctggtcgcgcccgggcgccgtcgagggcgactccttttcgcttggactcctcgccggtggcctcagcgacggctccgtcgccgtgtggaacccgctgagcttgatcagctccgaggggaaagcggaggacgccatggtcgcgcgtctggagaagcacaccggaccggtttgtggactggagttcagtgagcttacaccgaatcggctcgcttctggggctgagcagggggagctttgcatctgggatctcaagaaccccgttgagccaattgtgtaccctccactcaagagtgttgggtcccatgctcaagctgaaatctcttgtttatcctggaatcccaagtttcaacatatagttgcctcaacttcgagtaatgggatgacagttgtttgggatttaaggaaccagaaaccactgactagtttttcagattcaaatcggaggaaatgctctgttctccagtggaatccagatatgtccacccagttgattgttgcatcagatgatgacagttctccctcactg

SEQ ID NO: 24577 - DNA, 1222 bp, Zea mays
  misc_feature (1205)..(1205): n is a, c, g, or t
cattgggacctcgaccccgcgggcggggcgccgcgccacgccccggccggcatgggccaccaatggcgacccccaccgccaccgcactcacctgctcctgccgcccttcgtcgccctcctcatcatccgccgccttccgccggctgaacatcttcgcccccgtctcgggcgcccattctcctcctcgacgccgcctccgtctcgcgccattgcacgtcgtcgacgactccaagaacccccccgaggagaggtctgagacggataagatggtcgacggcatggacttcggggagctctgcagcgacttcgagtgcataagcagcccctacgtggagtcgacggcgaggcaggtcgcgcgggacatcctggagctccgcgaggacaaccgcgcattcaactgctacgcggtctccgtcaagtacaaggacccactcaggacatttgttgggcgtgagaagtacaggaggccgttgtggatcaccaaggcgttggaaaaccctgtagtgacagtccaggaaatgtcaatgcagtcgacgagcaacctgaccatcagatgggcgttgagagggaagcctaagaacccgttgttcgcgagcgtcggaggagacgtcatcgtccgcgtcgagtcacggttcgtcctgaaccagataagcgggcaggtgctggagcaggccgagtcctgggacctctccgcctcgtccctccctgcccaggcctacttctggctgtcccgaagggtctactccgccgtggagtccgggaaggacgcgatcgaagccgccaagagcgcggcgtcgtctgggctgacgaccaagggagaccagaatctcgaggcctatccggatccttctgctgatcctacaaagttctttcagaggccggatgatgggttcagccaagacgtgtaccagatcggccttctcctggccgtgatctacttcattgtacagtttctgaaggcgaccctgtgaccggctgcagcctgtcgaagaatgtagcctgtgtgcagtatacatgtatgtaactatgcctagcaacattataaaatacgggcatatatcatcctgccatctgacctgcgacagatttgtgacctttcaccactgctgtcggtgatattagtttggcacgcaagttgccaatttacaggtgttaaacttgaaaatatattaaatattaatattaaattaaaaaaatataaaaangaaaaaaaaaaaaaaaa

SEQ ID NO: 24578 - DNA, 1237 bp, Zea mays
gcacgaggttctttttggaagttttggatatcagttcttccttgacttctaactatctgcaactgcccaatgttggtgtcaggtactcttgacaacaagtgactgggacgagtgcaacttttggctcgcggcattgaaacggatgatcaagacaaggcagaatttcagaatgtaaaccttgtggcctttttttgcagccagttctgtacacaccttttttctgctgcttgccagagatgatagctgtagcagttcagagagtttgcctgcacaggggtgttatcatgctgctttgttctcggctcttgattctgcctaagcgctttggtacctcagtgctgttaaacattttgataatagttttttgttttcgacatctgctataaggtgacctgcggctgggttgttcgttatgaatgttaattgtaagaggacccttagtctgttatagctggtggatcccctgtttcaattcttcctcttagatttcgtcagtttggacattccaaaactctagatggttaatacaagtgacagtggcttgtttttttttttggtaatgccaacagaaatcaataaacttctggaaaaaaaaaaaaaaaaaagcttctcgtgccgttttttttttttttttttgagcaaaactcccaaaaaataagttatgcagcgaggaacaaagcgatcgccccaatcacatctcataatactaactaacaatgtttatttaagagcgagaaaggtattaattatgagattgtggttgcatcaacatttgacatcacaatcacaaagaaaacgaggactctgaccctatccagctatcgcgccaagagagaaacggcgtaccatggaaactagggaaccgaagtatttgaagctattattttccgggagacgaacgggaaatctacgcagaaattgcactcacccgctcaccggtcgtaccgcctcctccacctccccccttctccctccgcgctcctccagttgttgcgcagaacagctacccatttggaggctaaccggccagcagtccctgctcctgctcgtgcggcgagcgcgtgacgactggcgaccatagccccgcttctgtcgaggaacggaaggcgccggaataacgggagacggtggggcaccgacgccggagcgctctccggcggcggggcggcggcgccagttggtgcgcttgagcctcccgatcgtaatctgacggtcagagcaactccaatagttatgt

SEQ ID NO: 24579 - DNA, 3015 bp, Zea mays
aagacaacagaacaattgctgggtactgtagggagagatattagtgagctacctgcaagtgctaatggaactttgaccttcactggtaccggaaaataccaggtgtcattgcagcatcctcatttgatgggaagatcggcatatacaacctaaaggtctttgggaatttatgcggctggcgatgctgttggtgccccagcgcgtcaaagggctccggttccaaaatggttgaaatgctccactggtgcatcttttggctttggtggtaaacttgtttctttccatccggtggcacccacccaaggtgcaccgtgcagccgcggccgaggtgcatgtgcacaatttggtgattgagcaaagtctggtgagccgatcagctgagtttgaagctgctattctgaatggcgacaaaagttcgctgcgtgctctgtgtgaaaaaaaatcacaagaatctttatctgacgaggagagagaaacctggggcttcttgagggttatgtttgaggacggggattttgcaaggacaaaattgcttgctcatcttggcttcgaaccacctcaggcaccgcctgcaagttcaactgatgaattgagccaaacattggcagatacacttaatattgatcatgctgcagtaaccgataatgcggatgcccagtttcttattgataatggggatgattttttcaacaatcctcgaccttcagaggctagcttggctgaagaatcagtttctacaaatggtcaacagatagaacaggaagtttctggagattctgtgccatcagatccatcaattgacaaaagcattcaacatgcgttggtggttggagactacaaaggggcagttaaccagtgtcttgcttctaatcgtatggctgatgctttggttatagcccatgccggtggttctgctctctgggaaagcacaagaaatcattatctcaagaacagtatctcaccctacttaaaggttgtctctgctatggtgggcaatgatttaatgagttttgtgagtacctggccactaagttcatggaaggaaactcttgctctgctttgcacatttgcacagaaagaggagtggcatattttgtgtgacacacttgcgtctaggcttctgaatggcggtgatacactagctgcgaccctctgttatatttgtgctggaaatattgacaaagctgttgaaatatggtccccccccgcgtccgcccacgcgggcgggaagacttatgttgatcttctccaggatttgatggaaaaaaccattgcgcttgcccttgctacgggccagaagagatttagcgcgtcactgtctaagcttattgagaactacgctgaattgctggctagtcaaggtcttcttaaaactgcaatggagtatttaaaactgttgggatcagatgaacactcgcatgagctggcaattttgagagatcgaattgcatgttctacagaaggtcacttcaaacagaatgacaatgttagttctgtttctgtttctgaaagcacgggcactccttccccctatgtcacaaatcaaccttataccaccccagaccattctcagaatgtttaccagcaggtacctcaaccatacaatgtgccaagcaatacatattcagaagcttacccacaacaaggtacaggagcctatggatacaacaatgcatatcaacctcagcaaccagccaatatgtttgttccacctagcacacctcccaacactcagcaacagccaggcccttcacatgtaccagtgcctcagcaaacagtaaagacatttactcctgcgaacccagctggtctaaaaaacccgggacaatatcagcaacctaataccttaggttcccagctttacacgggcgctacgaatcaaccgtattcttctggaccatctgctccttatccaagcggacctccaacaacatttcatcagcctgtagcacctgttcaatatcagagtgctgctccaccagtatcttcttttggtccaaccacccctgtaccaggaacagtccctaaccagatgtttccccattctgctgctactaactcgacttccaggtttatgccatcgaacaatcaaagctttgctccaaggccaggtttaagtcctgtgcagccctcaagtccaacacaggtgcaggcacagccagctcctcctgcacctcccgcgactgtgcagacagctgatacgacaaaagtgtctgctgagctgagacctgttattggtacactaaccagactattcgacgagacgaccaaagccttgggaggatcacaagctactcaagcaaaaaaacgtgaaattgaggacaattcgaggaaaataggggcattattttcaaaactaaatagtggtgacatatctccaaacgtttcatcaaaactcattcagctgtgcagtgcgattgatgctagcgattttgtcaccgcgatgcacctccaggtactcttaacgacaagcgactgggacgagtgcaacttctggcttgcggcattgaagcggatgatcaagacaaggcagaatttcagaatgtaaaccttgtgtggccttctcctgcacccagttatgtacacacctttttccgctgcttgccagaaatggttgcggttcagagggttctccagcacagcggtgttatcatgcagctttgctctcggcccttgattctgcctgcgagttggtgaaatcgccctgatacttccgtgctcttatatacatttcgataatagttttggttttctgacatctactgtaaggtgacctgttgctgggttgttggttatctgaatattaattgtaagaggccacttagtctgttatagctggtggatcgcctttatcaaacaatttttttttttttttgcactgagaattctgtcagttcggacattcgaagaactctagatggttaatacgagtgacagtggcttgtttttttattggtactgtcaaaaagaaatcaataaacctgtggatttttgaggtcaaaaaaaaaaaaaaaa

SEQ ID NO: 24580 - DNA, 628 bp, Zea mays
ccaaacgtttcatcaaaactcattcagctgtgcagtgcgattgatgctagcgattttgtcaccgcgatgcacctccaggtacttttaacgacaagcgactgggacgagtgcaacttttggcttgcggcattgaagcggatgatcaagacaaggcagaatttcagaatgtaaaccttgtgtggccttttcctgcacccagttatgtacacaccttttcccgctgcttgccagaaatgatagcgtttgcggttcagaggattttccagcacagcggttgttatcatgcagcttttgctttgggcctttgattctgcctgcgagttggtgaaatcgccctgatacttccgtgcttttatatacatttcgataatagttttggttttctgacatctactgtaaggtgacctgttgctgggttgttggttatataaatattaattgtaaaaggccacttagtctgttatagctggtggatcgcctttatcaaacaaaatttttttttttttgcactgagaattctgtcagttcggacattcgaagaactttagatggttaatacgagtgacagtggcttgttttttaaaaaaaaaaaaaaaaaaaaaaaaaaagcgaaaaaaaaaaaaaaaaa

SEQ ID NO: 24581 - DNA, 870 bp, Zea mays
  misc_feature (720)..(720): n is a, c, g, or t
  misc_feature (735)..(735): n is a, c, g, or t
  misc_feature (758)..(758): n is a, c, g, or t
  misc_feature (771)..(771): n is a, c, g, or t
ccggccgccgcagcgtccaatccccgcgcgtcttcacgccgcgccacgccgtccgggccatgggccaccaatggcgaccccccaccgccaccgcactcacctgctcctgccgcccttcgtcgccctcctcatcatccgccgccttccgccggctgaacatcttcgcccccgtctcgggcgcccattctcctcctcgacgccgcctccgtctcgcgccattgcacgtcgtcgacgactccaagaacccccccgaggagaggtctgagacggataagatggtcgacggcatggacttcggggagctctgcagcgacttcgagtgcataagcagcccctacgtggagtcgacggcgaggcaggtcgcgcgggacatcctggagctccgcgaggacaaccgcgcattcaactgctacgccgtctccgtcaagtacaaggacccactcaggacatttgttgggcgtgagaagtacaggaggccgttgtggatcaccaaggcgttggaaaaccctgtagtgacagtccaggaaatgccaatgcagtcgacgagcaacctgaccatcagatgggcgttgagagggaagcctaagaacccgttgttcgcgagcgtcggaggagacgtcatcgtccgcgtcgagtcacggttcgtcctgaaccagataagcggccaggtgctggagcaggccgagtcctgggacctctccgcctcgtccctccctgccncaggctacttctggnctgtcccgaaggtctactcccgncgtggagtccggnaaggacgcgatcgaagcgcaagaacggcggcgtcgtctggctgacgaccaggggagacagatctcagggctatccgatccttctgctgatcctacaagt

SEQ ID NO: 24582 - DNA, 3741 bp, Zea mays
ttcggcacgagctgaggtgcatgtgcacaatttggtgattgagcaaagtctggtgagccgatcagctgagtttgaagatgctattctgaatggtgacaaaaccccgcggccgccgccgcgtggagaaaaatcacaagaatctttatctgatgaggagagagaaacatggggcttcttgatgattatgtttgaggacggggattttgtaaggacaaaattgcttgctcatcttggcttcgaaccacctcaggcaccacctgcaagttcacctgatgaattgagccaaacattggcagatacacttaatcttgatcacgccacaataaccgattatgcagatgcccaatttcttactgataacggggatgattttttcaacaatcctcaaccttcagaggctagtttggctgaagatttagtttctacaaatggtcaacagacagagcaggaaatgtctggagatgttgtgccgtcagatccatcaattgacaaaagtattcagcatgcattggtggttggagactacaaaggggcggttaaccagtgtctttctgctaatcgtatagctgatgctttggttatagcccatgccggtggttctgctctctgggaaagcacaagaaatcattatcttaaaaacagtatctcaccttacttaaaggttgtctccgctatggtgggcaatgatttaatgagttttgtaagtacctggccactaagttcatggaaggaaactcttgctctgctctgcacgtttgcacagaaagaggagtggcatgttttgtgtgacacgcttgcgtctagacttctaaatatcggagatacactagctgcaaccctctgttatatttgtgctggaaatattgataaagctgttgaaatatggtcccgcaccttgaaatctgaagatggtgggaagatttatgttgatcttctccaggatttgatggaaaaaaccattactcttgcccttgctacgggccacaagagatttagctcatcactgtctaagcttgttgagaactacgctgaattgctggctagtcaaggtcttcttaaaactgcaatggagtatttaaaactgttgggatcagatgaacattcaaatgagctggcaattttgagagatcgaattgcatgttctatggaagagaatgataatgctaggagttatgtttctgaaagcaccgccactccttccctttatggcacaaatcaatcttatacagccccagaccattctcagaatgtttaccaggtacctcagccatacaatgtaccaagtaatacatattcagaagcttacccacaacaacctactggcgcctatggatacaacaacacatatcaacctcaacaaccaacccatatgtttgttccacctagcgcccctgccagctctcagcaacagccaggcccttcgcctgtaccagtgcctcagcaaacagtgaaggcatttactcctgcgaacccagctggtctaaaaaatccgggacaatatcagcaacctaataccctaggttcccagctttacacgggcactgcaaatcaacagtatccttctggaccatctgcttcttatccaagcggacctccaacaacatttcatcagcctgtatcacctgttcaatatcagcctgttgctccaccagtatcttcttttggtccgagcgctcctgtaccagcaacagtccctaaccagatgtttccccattctgctgctgctaactcaacttcaaggttcatgccatcgaacaatcaaagctttgctccgaggccaggtctaagtcccgcacagccctcaagtccaacacaggtgcaggcacagccagctcctcctgcaccgcccccgactgtgcagacagctgatacgacaaaagtgtctgctgagttgagacctgttattggtacactaactagactattcgatgagacgtccaaagctctgggaggatcacaagctactcaagcaaaaaagcgtgaaattgaggacaattcaaggaaaataggggcattgttttcaaaactaaatagtgatgacatatctccaaacgtttcatcaaaactcaggcagttgtgcagtgcaattgatgctagcgattttgccactgcgatgcacctccaggtactcttgacaacaagtgactgggacgagtgcaacttctggctcgcggcattgaagcggatgatcaagacaaggcagaatttcagaatgtaaaccttgtggcctttttctgcagccagttctgtacacacctttttctgctgcttgccagagatgatagctgtagcagttcagagagtttgcctgcacaggggtgttatcatgctgctttgttctcggctcttgattctgcctaagcgctttggtacctcagtgctgttaaacattttgataatagttttttgttttcgacatctgctataaggtgacctgcggctgggttgttcgttatgaatgttaattgtaagaggacacttagtctgttatagctggtggatcacctgtttcaattcttcctcttagatttcgtcagtttggacattccaagaactctagatggttaatacaagtgacagtggcttgtttttttttttgtggtaatgccaacagaaatcaataaacttctggaatcctgaggtctgtgtttcttgctggaactcccagtcccggtctcgcgcggcggcccgggccgctctgatctttatcgttgtataaatgtaagtccgcggccgttttactgatatggatgggttattcagttccgcggcaggtgcagcttgccgaactggcgaaatcgaatcgtgcgtgttggagtctggtaatcatctcagcagccattgaccactcccacccccacatcgcagccgttgactttcagcggcgggagtagatgaccgttaaaacttgcgaatccggccgggttcgggaatgattgcgaatgtgctccggtcagcttccgacagtacgaggcacttctcttctcggccgccacgcgtccaccactgcccgtttctccacggccggcctcggcgtggcgtgcgcgcgtcggtcatcgatttgctccccatcccttttccacgatccacccggagaggcccaggcaccctaaactaatcctctcccatcactcacatgtgggtccaaatctagattgggtccacatgtcaatgacccatttgtaattaccttctgggaagtacctgcagaggatctcattactgttccaaggccaattagtgtgctagttgttctattttctttactgatgatcactgctgctccactgctcctaatccacttccaatcataaaagccacccaaaaaaaaaaggctgtgggctgtagctacacgagctagcgtgtgatataggcacgtagcatgtgcgctgccagttcgatggcacgccaacttggcctattcagtttcagtctgtcattcttggttaatgcacttgtgttagattaatgccagccaattccatccctgcccgttggggataccgatgccattatgcacgacaggtgtatgaatgtatccggtgaccacaagacccaccaccactgctgactgctgagtgcaagtgctgctgcctgtcagacactgcggtacatacagttagtttccggccgttcccgtacgcagcacatcgatcgatctgattgctacgctggacagtcagctgaaccaacgccaaaagggggaaaaaaaagaagaagaagaagagaagagaatctgca

SEQ ID NO: 24583 - DNA, 974 bp, Zea mays
ctggccgggataaagctttgctccaggccaggtttaagtcctgtgcagccctcaagtccaacacaggtgcaggcacagccagctcctcctgcacctcccgcgactgtgcagacagctgatacgacaaaagtgtctgctgagctgagacctgttattggtacactaaccagactattcgacgagacgaccaaagccttgggaggatcacaagctactcaagcaaaaaaacgtgaaattgaggacaattcgaggaaaataggggcattattttcaaaactaaatagtggtgacatatctccaaacgtttcatcaaaactcattcagctgtgcagtgcgattgatgctagcgattttgtcaccgcgatgcacctccaggtactcttaacgacaagcgactgggacgagtgcaacttctggcttgcggcattgaagcggatgatcaagacaaggcagaatttcagaatgtaaaccttgtgtggccttctcctgcacccagttatgtacacaccttttcccgctgcttgccagaaatgatagcgtttgcggttcagaggattctccagcacagcggttgttatcatgcagcttttgctctgggcctttgattctgcctgcgagttggtgaaatcgccctgatacttccgtgctcttatatacatttcgataatagttttggttttctgacatctactgtaaggtgacctgttgctgggttgttggttatctgaatattaattgtaagaggccacttagtctgttatagctggtggatcgcctttatcaaacaatattttttttttttttttgcactgagaattctgtcagttcggacattcgaagaactctagatggttaatacgagtgacagtggcttgtttttttattggtactgtcaaaaagaaatcaataaacctgtggatttttgaggtcaaaaaaaaaaaaaaaaaaaaaaaaaaaaaactcgaggggggggc

SEQ ID NO: 24584 - DNA, 2269 bp, Zea mays
catataagattaaatgatttaaactaaaaatttatatattatcacaattcaagtcaaatgaatatagtagttttacttttatgttctagaatattataaaatatttaatataactagtcaaagttgatagcgattgacttaggacgccgctttttttttttggtcttttggacggaggaagcagtagttaaataatataataataaccgaatgaaatgaaagttgctggtagatcaactctcgactggtattacatgaatgcaggtgtacgatgtgcgtatgccattcagacattcacagtcggcgatgttcctgtccgagcatacatggatcaatcatagtatagctatataggctatagctagtacgtagtagtgtagtgcgcaattcagagctcgtcgtggctggagccgtcctcgtcgacgacggcgtggaccttggggttgggcgaggtcttgacggggtaggatgcctccatggcgatgccgcagtgtccctccttggcggccacgtcgcgcgccatgcggatgtaccccttctcgccccactcggggccccacgagttcttgaccagccagtacttggtgccgtccgcggtgaccccgtagccgaccgccgcgacgccgtggtccagctccgtcccgcacctgccggagaagaccccctcggagtagaactggaagtgcgagccgctggcctcgatggcgacggacacgggctggtgcgccaccgccttcttgagcgccgactcgtcgttggccggcacgtcctcgtagccgtcgatggtgacgaccggggccggcgacttcttgcaggacgcctggcgcgctctgtacgggtacgcgtcctccgccgccaccccgccgtgcttggcgatgtactggaacgcgtagtccatgaggcccccgttgcagccggcgttggccttggtgtcgcagtccaccagctgctgctccgacagcgacgtcaggttcttggtcttgatcgcgttgatgccctccacggcggcgatcgtcgagaacgcccagcagctacctgcgtggacgacattggtgttggcattatatatatattcttgtccacaagcatctctatatgtagtatatatgtacatgcatacatatatacatacacctaccgcactggccctggtccttgacgtcggtgacggcgcccttctgcctccagtcgacggaggccgggacgtcgcgcgcgtcggcgtacatgaacgacgccgacgccgaggagccctgcctgtcgccgcggaacatgcggtggtgcgcgaccctggagcccgcgtagtggcgtcggaactcgtcggcggtcatgtcgccgaagcggttgaggcggagcttgtagggctcgtcccggcggttgaactcgtggatgaggcgcacgttggccttgaagacgttgaagcggcgcgccttgtcgcccaggtcccgcgccagcgcgtggcggccgcgccagcgctcgtacagcgcccacagcgcctcctccgacgccaggtcctccgcgccgaagtcgaccgcggccgccggcgccggcgccgcggccagcagcagcgcggcggccgccagcaggacggacgccgcgagcaccagcggcagcgctctcgccatctctgctagcttcgctcgcgccgctaggcagatgtaggtactggccgggcttcttcttctagctcggggatgtggagcggtacggtatactaagctgctgatgctatgatcagtgatggctggctggctgtgtttgtgatgatgaggtgttgtaccgcccgggccgaccggggaggtccttatatagtagcgcgagatggagacgcgttgctgcatggaagcagcaacaacgcaaggacgacggacggacgaggatgacgttgcttgcgggcaacagcttcgcgctgggcgctgtggtgattgatgaattgaacgacacatacatacatgagtaacacaacaaccgtaccaggaatgcaggcgatgaaccgtccgtaagctagggacgactgcagttagttgcgttgcgggtggcggtgctggacggctggagattaaacgcatggccgatggaaatggggggccgaagaggggattggcgaggcgtccacgccacggccatcgggccatgtacaaaaccattcacggtttcaccagccattcagccaataactgcagtggtctcgacacaattccaggcaggcagtggtctggggctcggctgctcatctagtcgctgcaccggccgaatggaatcattggtctgc

SEQ ID NO: 24585 - DNA, 1581 bp, Zea mays
gggtaccgggccccccctctagtttggacggaggaagcagtagttaaataatataataataaccgaatgaaatgaaagttgctggtagatcaactctcgactggtattacatgaatgcaggtgtacgatgtgcgtatgccattcagacattcacagtcggcgatgttcctgtccgagcatacatggatcaatcatagtatagctatataggctatagctagtacgtagtagtgtagtgcgcaattcagagctcgtcgtggctggagccgtcctcgtcgacgacggcgtggaccttggggttgggcgaggtcttgacggggtaggatgcctccatggcgatgccgcagtgtccctccttggcggccacgtcgcgcgccatgcggatgtaccccttctcgccccactcggggccccacgagttcttgaccagccagtacttggtgccgtccgcggtgaccccgtagccgaccgccgcgacgccgtggtccagctccgtcccgcacctgccggagaagaccccctcggagtagaactggaagtgcgagccactggcctcgatggcgacggacacgggctggtgcgccaccgccttcttgagcgccgactcgtcgttggccggcacgtcctcgtagccgtcgatggtgacgaccggggccggcgacttcttgcaggacgcctggcgcgctctgtacgggtacgcgtcctccgccgccaccccgccgtgcttggcgatgtactggaacgcgtagtccatgaggcccccgttgcagccggcgttggccttggtgtcgcagtccaccagctgctgctccgacagcgacgtcaggttcttggtcttgatcgcgttgatgccctccacggcggcgatcgtcgagaacgcccagcagctaccgcactggccctggtccttgacgtcggtgacagcgcccttctgcctccagtcgacggaggccgggacgtcgcgcgcgtcggcgtacatgaacgacgacgccgacgccgaggagccctgcctgtcgccgcggaacatgcggtggtgcgcgaccctggagcccgcgtagtggcgtcggaactcgtcggcggtcatgtcgccgaagcggttgaggcggagcttgtagggctcgtcccggcggttgaactcgtggatgaggcgcacgttggccttgaagacgttgaagcggcgcgccttgtcgcccaggtcccgcgccagcgcgtggcggccgcgccagcgctcgtacagcgcccacagcgcctcctccgacgccaggtcctccgcgccgaagtcgaccgcggccgccggcgccggcgcgcggccagcagcagcgcgcggccgccagcaggacggacgccgcgagcaccagcggcagcgctctcgccatatctctgcttcgttcgcgccggccgctaggcagctataggtactggccgggccgggcttcttctgatcttctagcactcggatgtggagcggtacggtatactaagctgctgatgctatgatcaatgatggctggctggctggctgtctttgtggttgtgatgaaaggtgtttccggcccgccgccggccggcgggagcggccgc

SEQ ID NO: 24586 - DNA, 1591 bp, Zea mays
  misc_feature (15)..(16): n is a, c, g, or t
gggggcccctttttnntttttttttttaaattttttttttttttttttttttttttttttttttttttttttttttttttttttttttttttttttctttttttttttttttttccgtttgaaatgaaagttgctggtagatcaactctcgactggtattacatgaatgcaggtgtaagatgtgcgtatgccattcagacattcacagtcggcgatgttcctgtccgagcatacatggatcaatcatagtatagctatataggctatagctagtacgtagtagtgtagtgcgcaattcagagctcgtcgtggctggagccgtcctcgtcgacgacggcgtggaccttggggttgggcgaggtcttgacggggtaggatgcctccatggcgatgccgcagtgtccctccttggcggccacgtcgcgcgccatgcggatgtaccccttctcgccccactcggggccccacgagttcttgaccagccagtacttggtgccgtccgcggtgaccccgtagccgaccgccgcgacgccgtggtccagctccgtcccgcacctgccggagaagaccccctcggagtagaactggaagtgcgagccactggcctcgatggcgacggacacgggctggtgcgccaccgccttcttgagcgccgactcgtcgttggccggcacgtcctcgtagccgtcgatggtgacgaccggggccggcgacttcttgcaggacgcctggcgcgctctgtacgggtacgcgtcctccgccgccaccccgccgtgcttggcgatgtactggaacgcgtagtccatgaggcccccgttgcagccggcgttggccttggtgtcgcagtccaccagctgctgctccgacagcgacgtcaggttcttggtcttgatcgcgttgatgccctccacggcggcgatcgtcgagaacgcccagcagctaccgcactggccctggtccttgacgtcggtgacggcgcccttctgcctccagtcgacggaggccgggacgtcgcgcgcgtcggcgtacatgaacgacgccgacgccgaggagccctgcctgtcgccgcggaacatgcggtggtgcgcgaccctggagcccgcgtagtggcgtcggaactcgtcggcggtcatgtcgccgaagcggttgaggcggagcttgtagggctcgtcccggcggttgaactcgtggatgaggcgcacgttggccttgaagacgttgaagcggcgcgccttgtcgcccaggtcccgcgccaccgcgtggcggccgcgccagcgctcgtacagcgcccacagcgcctcctccgacgccaggtcctccgcgccgaagtcgaccgcggccgccggcgccggcgccgcggccagcagcagcgcggcggccgccagcaggacggacgccgcgagcaccagcggcagcgctctcgccatctctgcttcgctcgcgccgctaggcaggtactggccgcgcgggcttcttcttctagctcggatgtggagcggtacggtatactaagctgctgatgctatgatcagtgatggctggctctggctggctctggctggctgtctttgtgtttgtgatgaggtgttgt

SEQ ID NO: 24587 - DNA, 1894 bp, Zea mays
  misc_feature (8)..(8): n is a, c, g, or t
  misc_feature (11)..(11): n is a, c, g, or t
  misc_feature (14)..(14): n is a, c, g, or t
  misc_feature (687)..(687): n is a, c, g, or t
  misc_feature (1658)..(1658): n is a, c, g, or t
  misc_feature (1820)..(1820): n is a, c, g, or t
ccggccgnggnaanaattcaaaaaaaaaaaaaaaaaaaaaaaaaaaaaaagccgccctcgcttctgtagtttgttcctcgcgagatctcgtgcgccgtccgtcctaccacgctgccctctgccgccaccgccaccgccaccatcaccacctgcgccggcgctcctctaggacgcagttcgcctccgaccccgactccagattttacatgcttctctagtagtccattggagtaattaacatcgattacacagtcatggaagagcaccaagtcaagccatcggatctgccacccactagtttgcacaaccaggattcagccgcaactcctgttaccagtgctgaccctgctcgtcctgctgcttcaaatgattctcccagtcaggttgccagtgcagctcctgctgctgtttctgcacctaccgctgctcctgcagaagatgctgcagggcgtgaggcgtcagcatctgtgttctctgcgtctggtttatcctcctgggctaagaacctaaaaattcctcagccttcaccaggtcaagaatcacctacaggaaagaatacctttgcccgtttaacaagtggccttggactgcgtttgtctccaaaagcggcacagcaagatgagggtgctgaaggaagcacctccccaacaacaggacagcctgggtgtttttggttctttaacgaanaggcattgtggatttcctctaagaatgctgtaaaggcagtgcaagtcaaggctcgccacatggtctcgcagaataaaagacgataccaggaaaaggaggatttgattccgacatgacatatattactgagaacataattgctatgggttttcctgctggtgatttgagttcagggctttttggatattttgagggtttctaccgcaaccacatggaggaagtcatcaggttctttgaaatgcaccataaggggaagtataaggtgtacaatctttgttctgaaaggctatatgatgcatctctttttgaaggaaaggtggcctgctttccttttgatgatcataactgccccccgatacaacttgtcatatcattctgccatagtgcctactcatggttgaaggaggatatagaaaatgtggtggttgtccattgcaaagctggtaaggcaaggacaggattgatgatctcgagtcttctactatttctaaagttctttcctactgctgaggagtccattgaatactataaccagaaaagatgtgtagatggaaaagggctgattctaccaagtcagattagatatgtgaagtattttgagcgcatcttaacttacttcaatggtgaaaatcagccacccaggaggtgtatgcttagggggtttcgtcttcatagatgcccctattggattaggccatcaattacagtctctaaccacaatggtgttcttttttctacaaagaagcatccaagaacaaaagaactaatgccagaagatttctggtttagtgcaccaaagaaggggattatggtttttgcattgccgggagaacctggcttagccgaggtagctggtgatttcaagatccagtttcatgatcgacagggagatttttactgctggctaaacacaacaatgatggagaacagggtaacctttgaacccaactgatcttgatgattttgacaangagaaaactgccctcaccaggataccagattgaggttgtccaggtagataacgatggcacgcaaccagcaaaaccaaaaccaggcgcaggaccagcagcagataaatctcatgctgatacctcggctagcacggttgcaaaagaaaatagaacagcgacagnagaatccaacaagggaacaggaagcaataatgatagagatgaagtctacactgacagcgcaggggaggatggat

SEQ ID NO: 24588 - DNA, 3040 bp, Zea mays
ctgcagatactggaagagcaactctaatggatatgttggtaaaatgtagagaaaaaaatgtggttagatgtgaagtagctaaatttaggaaatttatctagagaggtgttggagagaagtttttgggttaactacctaaattattgatttaaggagtcttttatgtaattgctgaagttgttgtaagactgtctttaatggatcgagtaaaatagggatacaatattttagataatattgtttaacactgtttgtagagtaaaattaaaaataggtaataagataagagtagtatgggactctgggttgctgctagcaggttttctcaactcaccatatgtcccctacttccccttgggttgggttagcaatcctagccgggggccatgtttgctccaccgttgccgcttggcccggcccggcggatgcagattgtgtggtgcgaggcccacacctctgtcgcgtagccgctcagggtccacccggtggccattgggtacctcgaggccgctcgcctgtcgcctcgcacaccggatctcgtcgccgccctcgcttctgtagtttgttcctcgcgagatctcgtgcgccgtccgtcctaccacgctgccctctgccgccaccgccaccgccaccatcaccacctgcgccggcgctcctctaggacgcagttcgcctccgaccccgactccagattttacatgcttctctagtagtccattggagtaattaacatcgattacacagtcatggaagagcaccaagtcaagccatcggatctgccacccactagtttgcacaaccaggattcagccgcaactcctgttaccagtgctgaccctgctcgtcctgctgcttcaaatgattctcccagtcaggttgccagtgcagctcctgctgctgtttctgcacctaccgctgctcctgcagaagatgctgcagggcgtgaggcgtcagcatctgtgttctctgcgtctggtttatcctcctgggctaagaacctaaaaattcctcagccttcaccaggtcaagaatcacctacaggaaagaatacctttgcccgtttaacaagtggccttggactgcgtttgtctccaaaagcggcacagcaagatgagggtgctgaaggaagcacctccccaacaacaggacagcctgggtgtttttggttctttaacgaaaggcattgtggattcctctaagaatgctgtaaaggcagtgcaagtcaaggctcgccacatggtctcgcagaataaaagacgataccaggaaggaggatttgatttagacatgacatatattactgagaacataattgctatgggttttcctgctggtgatttgagttcagggctttttggatattttgagggtttctaccgcaaccacatggaggaagtcatcaggttctttgaaatgcaccataaggggaagtataaggtgtacaatctttgttctgaaaggctatatgatgcatctctttttgaaggaaaggtggcctgctttccttttgatgatcataactgccccccgatacaacttgtcatatcattctgccatagtgcctactcatggttgaaggaggatatagaaaatgtggtggttgtccattgcaaagctggtaaggcaaggacaggattgatgatctcgagtcttctactatttctaaagttctttcctactgctgaggagtccattgaatactataaccagaaaagatgtgtagatggaaaaggcctggggctccccgggcccggccgggaggtgaagtattttgagcgcatcttaacttacttcaatggtgaaaatcagccacccaggaggtgtatgcttagggggtttcgtcttcatagatgcccctattggattaggccatcaattacagtctctaaccacaatggtgttcttttttctacaaagaagcatccaagaacaaaagaactaatgccagaagatttctggtttagtgcaccaaagaaggggattatggtttttgcattgccgggagaacctggcttagccgaggtagctggtgatttcaagatccagtttcatgatcgacagggagatttttactgctggctaaacacaacaatgatggagaacagggtaaccttgaacccaactgatcttgatgattttgacaagagaaaactgccctcacctggattccagattgaggttgtcctggtagattacgatggctcgcaaccagcaaaaccaaaaccaggcgctggacctgctgctgataaatctcatgctgattcctcggctagcacggttgcaaaagaaaatagtgctgcacctgaagaatccaacaagggaactggaagcaataatgatagagatgaagtcttctctgacagcgacggggaggatggatcttctaacggaaggaaggagaagactgccggcggtggtcaaagcagtgtaaatgctgctaaaccatcccagacaggcaacatggaggaggcggcggcatctgctgctgctagcagactggacaaagtggctataagcagcgaacagggaaccacaaaggcacctgatggtacatctctcaaaactgaagtcagcagcaaggccagctccaccacagcaccacctcctccagctgctgactcttccagcatgagcgaattcaaggcgattgccgcagatgcctcggtgttctcgttcggagatgaagatgattatgaaagtgagtaatgattctatgggtgggtacggtgttgagtttccgctgtacagtttggtgcttctaggaccccccatcatagaatgccaaagtccagagatgttaattcattcttgcatttcgtctccactgtagcagtgtcatcggtctgatgttgtacccagatgatgaaacttgttgtaactcaaccaggtcttgaacctctcctgtttgtttacagaaatgccttgtacacgaactcacttaaacagcgcaactactttttattattgatagttaaaagtgtgggaaaaaaaaaaaaaaaaaaaaaaaaaaaaaaagaaaaaaaaaaaaaaaaaagcggcc

SEQ ID NO: 24589 - DNA, 4462 bp, Zea mays
agaacatggccagacaatggtgtcagacgagggtagagggggcggtttcgttgctgagttcagatcttttctactcgccgcaaaaccctgctttgctcgctgatttaaatataatagggttgcacgctatgcagatctcaagaagctgcgtatgtgtgtgtctatgcatgtttctgcaaccatgaagccaaagatccatacagtgacgaatctagccgaaaatattgtcggggtcatcaagagcagctttgctatattatacaaatttttatgaactttaatagagtttttctaaaggatttataaaatttatcggggtcggctgaccccgataaaccccctaaattcgcccctggatccatataataatagagagtaaggaggacaccgttaaagacaaatcccatttattcaggtccattcccaggttccccagagatcgattttttttttttggcatatcgatccatctgaaccagagggatcagatggtgtttaatattcttgcttgaatggcactagtagtatatacacgaacacgacaaacacaagtccacaggccatgcatgcacgcacgcacgctcggaagcgcaagcgcgtcagtgcttgcggtggtggttgttggcggcttcggggccgtcgcggtcggcggcctgcttgaggtggtgcgtgggcgtcggcgtctgcatgagcgcgagcgcgcgctcgaactgcgcccagcgctgctccagcgtgccgttgtagccgacggacatgcggacgaggcccggggagatgcccgcgcgcgcgcggtcctcgggcggcatctcgctgctggtgctgctgccggagcaggacatgagcgtctcgtagtagccgaggctgacggccatgaggccgaactgggtggtgttctggaggtggtgcatgaggcggttggcgcgctcctcggtgcccatgtcgaggcacagcatgccgccgcagccgtagcccgggttgcccatggcggccaggcgcgcgtggtgcgggtggcccgggaggcccgggtacagcacgcgcaggcccagcccctgcatccgctcggcgaacgccagcgcgcggcgcgagtgctcctgcatccgcagcggcaggtgcggcagccgctccgacagctcgaacgccaccttggcgttcatcgtggggcccagcagcatcagcgccccctcctgcaggtccatcatcgcgttcaccaggctcgccggcccgcagatcgcgcctgcatgcaatgcaagcgtttagcacatcaaggacagagacagacgaatgatatgagatgagcacatgagcaccaccacatacttctatgcaggcactactgtactagtgcgatgcgtggcaggtttgttcgtttgcgcttgcgctgacgggggcgggcttggcttggctacgatctcgtgcacgcgccaaggcgtgatggaggcctggccagacgacaacaggcgggcgcggtcacgtcctgacgccatgcggttcgtcgtacgtggcagggtcaggagccaggacaaaagccacgcggtgcagtgcactactcctacgttgcacaccccagcagcaacgcattattgaaggagcgggggtgcagtgcaatgcgacgaaagaaaagttgcaaggaaaaaaaaaaaggcgcggcagacaaaatgattagacggtgagcggccaaacacggggatcggcagaggatgggtcgccggccatgctggaggccccgccgcgcccgtcctggccttggccagacctgacctgccacacatggagcgtgccaggcacagacgatggggtgggtcacaccacgtcacgttcccgcggccaaggggattctagctacgtgactaggcgagaccaaccgcgcccgcgtgactctgtaccttgtcgcttggggccttgatcgttgtcatcgtcgtcgccttcgcatccagtctccacatgtagggagcgcaatgcacgtcagttacaagtacagggtgtgttctgcctattttttttgcctataaaaatatgtaggcggtcacgtaactccggtctattactacaccactattttgtgtattcaaaaacattcaaataaacaaaaaccgcagcaaattgtgttagtcgagagcgcagatcagcttagcgatctgagcccagcaaaaaccctgacaatggaacttttgactagacaatgtaaaggcgcacgtgcttcctccgttaccaaattgatccacggctactggggatagcgatgccgcggtggacacatgtgtcatgtcgtaatcactcatgtacggtctgccgatttatcctattaccccggtatttattattatattatagcaataatctgtttgaccggtacggtaatttagggcttgttcgtttgtgtcagattatacttgaaattgttccagctaatcaaagtttatataaattagagaagcaatccggtcaggaagcgttccgacccaccaatccggcacaaaccaataagaccttattttgacatttttttcatgtacaatccccccctcccccgctccaaagattccatgtgaccaaggccctagcttttgaggccccagcttcactggaacacagtcacgtaaccgtaccatgcatgcctagctatcggttttctatctgcaatttgcaagtgctttacaataaccacgcatgcctcccactaatgcagctaggtaggagtagccgagtaggttttccaaccacacagaccgtcagcgaggcgcgtttctaattttatcgttgcatgcacacgccacgccgagtcgccgacgacgcggggacagggtcggaggatataaataggataggacgtgtccttaccggcgatgatgtcggcgccgccgctgatgaacttggagacgctgtggacgacgacgtcggcgccgaggcgcgcgggcgacaccaccacgggggtgaaggtgttgtccaccacgagcttggcgccggcctcgtgcgccacccgcgccagcatggggatgtcggcgacggcgagcgtcgggttggacatggtctccacgtacaccacccgcgtctcgccggggaccaccgcggcgcgcacggcggcctcgtcgtcggcgtccacgaaggtggcgcgcaccccggaggcgcgcggcaggaaccgggccagcagcgcgtgtgtcccgccgtacaggcaccgcgacgccaccacgtgcccgccggcgcccaccagctgcatcagcacggacgagatggcggacatcccggacgccgtgcagtagcccgcctccgtgccctccagcgccgccatctgccgccccagcgccagcaccgtcgggttgaagtgccggctgtagatgtacatgtcgccgcggtcggggcccagctcgcccgcgaacagccgccgcatcgtgtccggctccatcaccgtgaacgtcgccgacgcctcgatggacatgttcacgccgccgtgctcgccgaactcgtgccgcgccgcggccagcgccgccgccgggtccgcctcccgccgccgcgccttgggcttctcgccggtggcgctgccgttgttgctgccatcgccgaacccgtcgttgccgaacgggcgcttcagggtggccagctcggaggcggcggacagagtctgggccattgggacggggaccgtgcgttgtacaagggcaggaagtcgggcgggcctgggaatggttttcagagcggtgcggggaagggaacatgaggtgatgggcaatttataggcgatgccaggatcttctgtggctgggagactctcgatgctgtggacggctgtgagccgccggccgcgggcgcgctggaacgggcggtggatggaggagggggtatgaatcgggcccattccacggtcaggtgaccaggctacagattgtaacgttgggatgatatcttcatgctaactgtagcgtctatacgttatggtactgttaggcagcaattcattgagttttaaaagatgcagggggcaaaatcaggttttggttattgcactgtatgtgtatatccagccaaatcagattcaattaaaattaataccagtcgcaccatttagattgtaagatattttagttctttctccaaaaattataacttttgctatgcacttataatactccctcctttccgaatcaagaattatatgaacccactaattccttaaaactactattattttagtacaaagatagtacattatatcaaaaaatcaaattgttttataatttaaaatagagagagtaagtgtaatgaatattgtgcgatgcgacatataaggctttgcttaaaacacatagaaatagaaataatagttagtcagctaataaattattagttgagttaagccaactaatgaactgttggttagttgtgagttagctaaaaaaatagctaagatattagctgagagtgtttggaacctcaacaactaattataataactaattattgtttttag

SEQ ID NO: 24590 - DNA, 2004 bp, Zea mays
  misc_feature (36)..(37): n is a, c, g, or t
  misc_feature (60)..(61): n is a, c, g, or t
cggccgcccttttttttttttttttttttttttttnnttttttttttttttttttttttnntttttttttttttttttttttttttttttttttttttttttttttgccgccctttggtggtcgtttttaaagacaaatcccatttattcaggtccattcccaggttccccagagatcaagccgcttgcactggcatatcgatccatctgaaccagagggatcagatggtgtttaatattcttgcttgaatggcactagtagtatatacacgaacacgacacacacaagtccacacaggccatgcacgctcggaagcgcaagcgcgtcagtgcttgcggtggtggttgttggcggcttcggggccgtcgcggtcggcggcggcggccttgagatggtgcgtgggcgtcggcgtctgcatgagcgcgagcgcgcgctcgaactgcgcccagcgctgctccagcgtgccgttgtagccgacggacatgcggacgaggcccggggagatgcccgcgcgcgcgcggtcctcgggcggcatctcgctgctggtgctgctgccggagcaggacatgagcgtctcgtagtagccgaggctgacggccatgaggccgaactgggtggtgttctggaggtggtgcatgaggcggttggcgcgctcctcggtgcccatgtcgaggcacagcatgccgccgcagccgtagcccgggttgcccatggcggccaggcgcgcgtggtgcgggtggcccgggaggcccgggtacagcacgcgcaggcccagcccctgcatccgctcggcgaacgccagcgcgcggcgcgagtgctcctgcatccgcagcggcaggtgcggcagccgctccgacagctcgaacgccaccttggcgttcatcgtggggcccagcagcatcagcgccccctcctgcaggtccatcatcgcgttcaccaggctcgccggcccgcagatcgcgccggcgatgatgtcggcgccgccgctgatgaacttggagacgctgtggacgacgacgtcggcgccgaggcgcgcgggcgacaccaccacgggggtgaaggtgttgtccaccacgagcttggcgccggcctcgtgcgccacccgcgccagcatggggatgtcggcgacggccagcgtcgggttggacatggtctccacgtacaccacccgcgtctcgccggggaccaccgcggcgcgcacggcggcctcgtcgtcggcgtccacgaaggtggcgcgcaccccggaggcgcgcggcaggaaccgggccagcagcgcgtgtgtcccgccgtacaggcaccgcgacgccaccacgtggccgccggcgcccaccagctgcatcagcacggacgagatggcggacatcccggacgccgtgcagtagcccgcctccgtgccctccagcgccgccatctgccgccccagcgccagcaccgtcgggttgaagtgccggctgtagatgtacatgtctccgcggtcggggcccagctcgcccgcgaacagccgccgcatcgtgtccggctccatcaccgtgaacgtcgccgacgcctcgatggacatgttcacgccgccgtgctcgccgaactcgtgccgcgccgcggccatcgccgccgccgggtccgcctcccgccgccgcgccttgggcttctcgccggtcgcgctgccgttgttgctgccatcgccgaacccgtcgttgccgaacgggcgcttcagggtggccagctccgaggcggcggacagagtctgggccattgggacggggaccgtgcgtgcgttgtacaagggcaggaggtcgggcctgcctgggaatggttttcagagcggtgcgggtccgggctccagggttcccggccggcctcgaggcgatgccaggatcttctgtggctgggagactctcgatgctgtggacggctgtgagccgccggccgcgggcgcgctggaacggacggtggatggaggagggggtatgaatcgggcccattccacggtcagaggtaccgagctc

SEQ ID NO: 24591 - DNA, 4851 bp, Zea mays
ctgcagatttttaaagtgaactgttgggatttggggagattgccatctaatcgtaccatttttttattcggttgacgatacacgaggatctcctaaccaaaaacaattgccatcaaaagatatgggggatatatgcgacccatatgactcaacaaaggctggattaaagctcaagggagctcccatgtgctaagctaagccagcgacaaagcatcacatcaagcgcacaaaaaattcttgaacacaaacacaactattaatgttaaaaatcgaggcaagtttcaccttcgaccttcgtgaaaaaaagacgtcaaattcatagtctaagttttcacacctgtttgctttggccacggatctagatgaagatttgcctatcttttgattagttagatctcgttgtgatcttccttgatcacccattctcagcgagtcaatgccattgaaaactttgttgatagaatgagggtttggttttttatgctatatgagtgaaaaaaataaaaattgttattaatcttttaacataattttagggaaaaatctgttaaatttctcggtgccagaatgacatagagatttaccctactctacttctctttcatctctaataatctctatcaactttgacgagtgatagacgagacgatgagactttgttagcatatagagatagaggagatatcgcccacaagtatggtgctggacaaggtagggataaaggacgaaggcaaagaggacaaggctataggtcgagtggatgaggactagggctagacactataggagaggagatggagaaccatggcactaagcagaaaggacatggggctaccttaggggatgtatggaaagaccgagaaaaggataagatttcatgtccaacatcgagaaaatttgacatatttattctcaaggaacccgttgacacataagtagcttaaatttattcaaccagaaattaaacatatagttgttacaacatctccaagaggggctctatatgtggcttattttaaaatataggactcgagatcataaagcgccctccaatagtgttccaatttcacaaaaattcatgaaacagttacagagctcgtctatcgggtcctaaatgtagtacccgatatattagagacctatcctcatcttctcttaatatccaactatttatttcttaataccgtaatttactgctaaatagcattatttaagttttaactgtcgaggtaaaagtttcttttgaagactaagcaacactctaaatatagtcccgttttgattattagtgctctattttagagctcttggttggagatgctgcttagtacagtggtgtaagttgccatttcttacgtcccacctggcagctggtgccccagtgcatttccaccacgatacgaaagatgccgtcgacagctacggactgagcgtgtgacaggtggggccggagagatcttggcgatctgggtcctccgcgatcgcgagggtgacgcatcccgtcgccgtccgctgacccggaccgtccgatgccccggatggaggttctgtttgccggaccggacgccatcgtgcgcgtgcctttgagcagagttttgccgggcaaacctgtgccatgccaccacccacccaccaacccaatgctcggtacgtgcacccaacttgttttcaacaccatgggatgggatgggactcaagtgaactgattttgtataggtgattttctatccttgttctccgaaaagaaaatagaatgtcatgtatcacgatacgacatttcggtaccgtcagtcgtttcttttgttttcaagatcaaaaaatcagactgcacagcaacaaaaataaaatacagtacttggtagttatactgaaatattggtacattattaatagtgagtaaatccagtgcttccctgtcatctcatgcgtgtgccctaccagcttggactcgtgatctggtagcatatctgcaattaaaaccaaatcactgtcatctcacggaactcggctgcattatcgctatcatttattatacggccacttgactcgatttggttcggcaaaagagagggagagagagagggaggagaaagcgtggagagagattctctcccgacaagcaaatccggaggaaggaaagcattcccgcgggcccaccaccctcccaaccccgctggggccccacccttcgtctcctcctcgttcgtgttcatctattctcttgtgctgcgtttctcttcccttctctctctgctccgggttcagagcagagctcagcgccctgtctccctccctccctccattcctcctcctccgctctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacggtcagcggctcctgctcctcagctcctcgcttgctcccctctcgtccggtcccttccgttccgtctggccactccattcctcccctctgctggtctcgacgacccttctcggcggcccgtgtactctgatccgggattatggctatgcataggaattgcatggcatgatcaagcttcatccattcgtcgtctgtcagttgcttatcagtactgttgaagaaaaaacgaaattaaatttccgcagcatgaactaattaaggcccgggtttcgttcctttcctcgtttggttcagttaccgccgtcgacagcggcaagaaggcaatggagcatctccggctgatggagcaaggcggccagctggattcatgtgccgctgatgctaatgtgagtactaccagtaccacacctatacccagtctcatgtactcgccgcccaatcgtaggccaccgtacatgtctgcagatgccgagctgtctcttagaaatggagaaaggtttcctttagtgtactgatttagttctagtgcgttagtattaccaaggaaaaaaaacatagaccgtgttctcatgacgtgatgagatctttgactgcaagtgcaagtgcaagcagaaatgaaactgagataagaatggtttttgcagcggataaccattgacatcgtgctcacggactactgcatgccggagatgactggctacgacctgctcaaggccatcaaggtagttaatctccctccttattcttgacttgaaaaatataacaatcctgccattctctccgctgaaagaaattatactacttggacaaactggcaggcgctgagctcccctaacccgatcccggtggtggtgatgtcgtcggagaacgagccccagaggatcagcaggggtgccgcgcacgaaccaatgaaacccccccaaaaaaaaacccttctcttctcgccgtattaattcatatcgctgcctggcgcaaaggcaaagcagattcctgccgttggttacatttttacattttacatcgagcgaaagccgcttttcctctctggctatatgttctgtgccggcgggattcagatttgcgcgccttttcccatccccaaaggcgaaagggtttggtagattttgcattgcacatcagcactactaacaggcgcgcccaccaccaccaccacctctgacctctctcaaacttttttggttgatggatggggtcataaagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggagcagcagcagaaagctgcggtcggatcaggtcgccgcgcctgcccacagatcgcaaccgacgacgggattaaccatggtactgttattcatcgtttcttgctgttcctccttcagaagatcagccagagcttataatttcaatggatgccccccccccccaggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgcgatgcggtattattagtgtaaccactaaggctccaggctttcagttcaattcccccctgtaatccagtcctggcatgaggagccaccagttcttgctcgccgctccctatatttccatttcacttttcaccagcttttttgtggttattattatttatttttttggctagattattgttcttgcatttgggggcgtcgtatcgtttgcttggttgatggaagcgacaagaagtgggcgcgataaggtgatggtgattatatatagtgtaaatgcacggtatgagtgggtcagggtatctaatgtccctgttaatcaagataccggcttgatctgccgatgcaactgccagagacgccagttcttatggcgggtggggtggacgcagacgcccacctgctctgctgttaacctcagtacccgcggtcacgctgtgcgtcagtgacacaaacaaaactgcataagttgaccgccatatgacgccacattgatcttaggggaaagcaaaaatattgtg

SEQ ID NO: 24592 - DNA, 1225 bp, Zea mays
cattgggtacctcgaggcctgccggtcccttctctctctgctccgggttcagagcagagctcagcgccctgtctccctccctccctccattcctcctcctccgctctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacgttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggagcagcagcagaaagctgcggtcggatcaggtcgccgcgcctgcccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgccatgcggtattattagtgtaaccactaaggctccaggctttcagttcaattccccccctgtaatccagtcctggcatgaggagccaccagttcttgctcgccgctccctatatttccatttcacttttcaccagcttttttgtggttattattatttatttttttggct

SEQ ID NO: 24593 - DNA, 1466 bp, Zea mays
atgctataaccctaggcctcttggtatttaattcccgcttgggcacctcgaggccggccgcggccgccgttcgctgctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaatgagacaaaggctacagttaagttccagctgaagaaggtgctttgcatgggtgttgctgttggcaactgcggcatggatgagaagcagatcttccagaatgtgcaaatgagtgtcaacttcctcgtgtcgctcttgaaaaagaattggcagaatgtgagatgcttgtacctgaagagcactatgggaaaggtgtaccggctgttctaaattttccaattaggcttagaatttccaggagactcgagtgcttggacacttgccattttccctaccatccatttttttgagcaactatggattatctagttacaaacttggtcttgtacttgatgttttgttcttgataccgaacctatgacattgttaccttatttcaaaaataaaaacaaaaaaaaaagttgttatgttactgtttttttattgagcttaacctctgtacatttatctgtgtagatgtttcttgaatcttgatccctattttcccaagatttcttaaatatgtttttttttcatttttgttattcaaactgtatattagtatatcctcttagtatggtgcagacaattaatgttcttgtggaacgtaatctaattttcttccagagggtagctgccaattaatagggtatgctagtttggaataggccacagtggcctgggtacaaagcatgatgataatatagttccatgtttgtacatagtttgtaaatgtagtcttttattttgttctttttttgaagcctctgatctgggaacactacacactcacgtgtacaggtagacctacaactgcacatagataaggtgcattaaggatctgtgctcatcttttgaatcgtgttttactgcaggcatgcaa

SEQ ID NO: 24594 - DNA, 1050 bp, Zea mays
  misc_feature (8)..(13): n is a, c, g, or t
  misc_feature (27)..(45): n is a, c, g, or t
caggtccnnnnnngatcatacaaattnnnnnnnnnnnnnnnnnnngtgaaattaacaatggaccattggtttaggtacatgtcctgtggaccccacttgtccaacaatttgcctaaaaaacacaaacttttggatagatcaacagtgaggtcctccaatgtacaccattttacaaagtgaaaagccaaacaacaatgggataggcttaaaaaatgccaggaagtcctgcacatgattagacacacccctcagcttcatttgggtgctgaagcaagctatcaccattgtggacttccgctaacttgtgattgctctgaccaaaggatttgcatggattagatgaattatcagagctccatgtgtctggaactgacaggaagtactttgccatgaacttcctaaacctttttttgtattccttgggggaaattacagttggtgaaacattcttgggtactaccagagaagtcttcacccatgtctccaattgtttgtcccaagtatattgcctcagataatcaatgatgccaaacacaagttcatgcttctctttgtccactccgacaagtagagaatagtccatgacattcaccgaagtgaggaaagacgtgtcattccagattgcacgctgcaaaagatgctttgttcttccaccaatatagattggagaaaaacccatgtcctcaacataattttggtccaggtaaacagtatcgtgatcatttgagtcagtgacgcgtcgcgaaaaagtaacacctttgagatcataaattcgtgaaatattgtggccaaagagaagattttccatcaccatcaagtcgatctttacctctttgccatgtctaatctgcttaacctgatatattcctaatatcttggcaaggcaagtttggcttccagtgtccagagaatggtaaacatgcctaaagtaatcaggtgcaaatttaataaatgaatcgaactctgttttcttgatttgctttatgatgaacctgtcatctgttgtctttgcaaaataggccttgctctttccacccttgagcattccac

SEQ ID NO: 24595 - DNA, 1459 bp, Zea mays
  misc_feature (1450)..(1450): n is a, c, g, or t
  misc_feature (1452)..(1452): n is a, c, g, or t
  misc_feature (1456)..(1456): n is a, c, g, or t
gcacatagaacaagtgcaaacagtagacacatcaacaggcctgtactgcctgatgtagaacatcattaagaggtaagatatctgaaaaaataaaaaggcataagtatgtataaaaatggttttagagcataaatgcatattgaacaaactaagtaacttattcttacccattctgagtaacaatgtaactcggtttacgaaagaaaatagcttgcaatatgttctataccaggagatctgaaaaaggttgtacattgtgcagaaccaaaaaaagtgcatctgggcagcaatacagaaactggacatccatcaaacacaaaatatgtattgtgttgcgtgcaacaaacaaggtcaggggagcagacatttatacgaaaccttttacatatcccatcaatacaatgggggggtacacagtacaacataatactcaaattgacctaatttcaatagaggtaggaaatgcctatcttggtcttggacagttagtcataagtgaagaatagactgcttcagtctcacaagtggtaggtccaaaaaaatgatcatatgaattcttaatttcactataataattgtgaaatcaacaatgaacatttgtataggtacacgtcatgtggacctcacttgcccaacaatttgcctaaaaaccgcaaggtcctcctatgtacaccattttacaaagtgaaatatagccaaacaacaacatgatagggttcaacaaaattgccaggaaatcttgcacatgattaggcacacccctcaacttcatttgggtgctctgacaggttatcaccaatctggacttccgccaacttgcgattgctctgaccaagggatttgcatggcttagacggattatcaagactccatgtgtctggaactgacagaaagtacttcgccatgaacttcctaaacctttttttgtattccttgggggaaattacagttggtaaaacatttttgggtactaccagagaagtcttcacccatgtctccagttgtttgtcctaagtatattgcctcagataatcaatgatgccaaacacaagttcatgcttctctttgtccactcccacaagtagagaatagtccataacattcaccgactgcaagtacaataattatgttcacaaatgttatcattcaaaaacttggctgccagtaattgtgtccaatatgtgctttatacttacagtgaggaaagacgtgtcattccagattgcacgctgcaaaagatgctttgttcttccaccaatatagattggagaaaagctcatgtcctcaacataattttgatctaggtaaacagtatcatgatcgtttgagtcagtgacgcgtcgcgaaaaaatagcacctttgaggtcataaattcgtgaaatattgtggccaaagagaagattttccataaccatcaagtcaatctttacctctttgccatgcttaattngnttancct

SEQ ID NO: 24596 - DNA, 3084 bp, Zea mays
  misc_feature (1958)..(1958): n is a, c, g, or t
aagtgaagaatagacagcttctgtctcacttgtgttgggtccaaaaaatgatcatacaaattcttaatttcactataataattgtgaaattaacaatgaacatttgtataggtacatgtcctgtggaccccacttgtccaacaatttgcctaaaaaacacaaacttttggatagatcaacagtgaggtcctccaatgtacaccattttacaaagtgaaaagccaaacaacaatgggataggcttaaaaaatgccaggaagtcctgcacgtgattagacacacccctcagcttcatttgggtgctgaagcaggctatcaccattgtggacttccgctaacttgtgattgctctgaccaaaggatttgcatggattagatgaattatcagagctccatgtgtctggaactgacaggaagtactttgccatgaacttcctaaacctttttttgtattccttgggggaaattacagttggtgaaacattcttgggtactaccagagaagtcttcacccatgtttccaattgtttgtcccaagtatattgcctcagataatcaatgatgccaaacacaagttcatgcttctctttgtccactccgacaagtagagaatagtccatgacattcaccgaagtgaggaaacacgtgaacatgtccacaatattgctacgcattgaaaaacatcactgccagtaattgtggcaaatatgtgctctatacttacagtgaggaaagacgtgtcattccatattgcacgctgcaaaagatgctttgttcttccaccaatatagattggagaaaaacccatgtcctcaacataattttggtccaggtaaacagtatcatgatcatttgagtcagtgacgtgtcgcgaaaaagtaacacctttgagatcataaattcgtgaaatattgtggccaaagagaagattttccatcaccatcaagtcgatctttacctctttgccatgtctaatctgcttaacctgaaacaggcactccacatgaaaaaaagcaggaaaaagaattgaaatcaaactcgagctcttgatataattacctgatatattcctaatatcttggcaaggcaagtttggcttccagtgtccagagaatggtaaacatgcctaaagtaatcaggtgcaaatttaataaatgaatcgaactctgttttcttgatttgctttatgatgaacctgtcatctgttgtctttgcaaaataggccttgctctttccaccttgagcattccacttcttgcagcggcttaaggaagtaatatatgcaagctcggatgggcaacacttttttcggagtgcaaagaattgattgtcatatacaccagtgactgaatatttgcctttcagagttattttcccgttcacagtcatttctggatgcatcgaggacaataaagaagagctatcataaccagaaaagtcatcagatgaaaatgatgaaaatgaagacagagatgacaagcttgcttcagaatctgtagatgaccatggtgatgaggtgaaagaattttcagacagaaaactataggatttctccattgctttagcatgctctcccttggagtaatccattccattctcaaattttaaatctatcaaatggcggcgttcgtcagatatggcaagagcacgagctattatgctggatatctcatcttccattatgcacagaatattaccaccaggacctaccgcgaaatgcggagagtccgcatcatcatgttgttcaaacaagggaggaaggtaatgtggcaaataattgttaatgagttcgaatttttccaaatatccaatttgaatgtcattcctgtaagccaattgtgactcagaaattgaattccaaatccacctttccctgtcatcccaataaggatatttgaactgttggagagtgctacaacgctcctgttccatagattggggttctgctactgtaaganttgacctggaccttcttatcattggatatttcgaagcaaggatcatttccggtttttgttgtgccatctacctttatttgaccatgagcaatggaagatttctcagctttactacttccattgcaaggaagttctgagtgcccagcttcctggctttcatcaagtaaggatgctgcagcatcccctaattgatggtcaagtttgttacttgcaggttctgtggtactggctacccccaaagctgccgtagtttcatcatatgtaaattcatcaattttcttatcaacaccgaatttatcaccacagatcccatcaacagtatcagcaggattcttgtaattagaaacactttctacagatttacaatagaataattgatgtagacggcggtcccaaatgtaaagctcaagtagaaggtcctgatagtaccaatttatattcaacagttcatgcacagaagaggttggtaccccattttgatcagtggccttgtccacagaactctgcaggacaatgcatttaaaattcgataaaaataatagatagaacaaataccaaggtcaatagaatgcatatactcacctcaaactgggccttttcttttatcaacaactcttctagttcagtgaagtccttaacagggaatgcaaggccacaatggattgctaacgttattgcatcaggatgttcattcttcaagttctgtagaaatcttgcaaccccagagaaaagcgccatacctttagcatgaaccttaaaagatggagtataagcgtcaggcaccattgtacattaacttaagtaaatgaacagaacagtcaaaaagaaccatacattcctcctttgtccttcaaaccaatcctgtctgatggggttgacgaactggagagtaggttgtggtttgcaggtagtgtagatctcaacagatgagtaccgaaacatagcaactttagagcccagcctgaaattagcaagagaggaagttattcatcaccaaactacaaaaaaagatagtttccacggaattgttatactaaaacctaatgactagcaagaagtttaccccaaaaaacgcaagcaatccctgttgaccagatgtccacatatagataaccttcttgctgca

SEQ ID NO: 24597 - DNA, 1423 bp, Zea mays
  misc_feature (168)..(168): n is a, c, g, or t
  misc_feature (172)..(172): n is a, c, g, or t
  misc_feature (187)..(187): n is a, c, g, or t
  misc_feature (198)..(198): n is a, c, g, or t
  misc_feature (263)..(263): n is a, c, g, or t
caggaatttgccacggttagccacccctaacttcattggtgcgtgggcaggtattccccatttgacctccggccactgggattgctttgaccagggatttgcatgcttagacggatatcagaactccatgtgtctggactgacagaaagtacttcgccatgactttcntaanccttttttgtatccntgggggaatanccagttggtaaaccattttgggtactaccagagaagtcttcacccatgtctccagttgtttgtcntaagtatattgcctcagataatcaatgatgccaaacacaagttcatgcttctctttgtccactcccacaagtagagaatagtccataacattcaccgaagtgaggaaagacgtgtcattccagattgcacgctgcaaaagatgctttgttcttccaccaatatagattggagaaaagctcatgtcctcaacataattttgatctaggtaaacagtatcatgatcgtttgagtcagtgatgcgtcgcgaaaaaatagcacctttgaggtcataaattcgtgaaatattgtggccaaagagaagattttccataaccatcaagtcaatctttacctctttgccatgcttaatttgcttaacttgatagattcctaattttttggcgagacaagtttggcttccagtgtccagagaatggtaaacatgcttaaagtaatcaggtgcaaatttaataaatgactcaaactctgttttattgatttgcttaatgatgaacctgtcatctgttgtctttgcaaaataggccttgctctttccaccttgagcattccacttcttgcagcggcttaaagaagtaatatatgcaagctcggatgggcaacacttttttcggagtgcaaagaattgattgtcatatacaacagtaactgaatatttgtctttgagagttactttcccattcacagtcatttctggatgcattggggacaataaagatgagctatcataaccagaaaagtcatcagatgaaaatgaagacagagacgataagcttgcttcagaacttgtagatgaccatggtgatgagctgaaagaactttcagacagaaaactaaaagatttctctattgctttagcatactctcccttggaataatccattccgttctcaaattttaaatctatcaaatggtggcgctcatcagatatggcaagagcataagctattatgctggatatctcatcttccattatgcacaaaatattaccacctggacatatcgcgaattgatttgaaagagcttaagaacacctttgccaaaataatcagatccaccattcctcaattccaaggcctcatatccgatcctgagggcagcgatggtggccatgtcgtcatcatcgtcagcagtcctggccacccggccgaactcgagggtc

SEQ ID NO: 24598 - DNA, 1003 bp, Zea mays
  misc_feature (63)..(63): n is a, c, g, or t
ctccctccgagatggagggagcatgatgtgcttattctcaactatgtctgggtgacgaagcanccgaaggagcttgatctcccgcagtatgcgtgtggcgtccgagacatgctcaaacacatcgttgatcttcttgatagcaacccgctcaccggtgcgggtatctacagctgcagcaactaccccgtagctgcctttaccaatgacttcttggatctggtactggcttgcctctccgtactcggtgaagaactgcgggtccactcagtcgctcaccttcctgtggctctcgacggggagcggcatcttgcgcttgggcacgcggatggcgcggaggccgaggagatccgggtcatcgacgatctcgagatccggcgagccgccgtccgcctccccctcgccgtcgccggcgatggacgactggttggaggtggagccgctccggcggtggaaccagcggcggaagccgtggacgatcgcgccccctccgcccatgctcctagccctacgcgcctgacagcattggccgcccgcccgcccgcctacctctagtagctatctatataccagcaccagtccaccggctgtccaagcaagctcctcctctcttcccgtgtcccgtccctcctctactcccttgccgccgtcagttactgttcctactcgcggtcgcggatggatggactggacacttgcttccccgaccgacgtgctgatcccgtccaagtccaaggcgggatgctgagtcgtcggcgccgtggcccgtgggggctgatggcaagcagattgacggatgcaaagcggaaaacgatgggtggtgatgggaaaggagcgggatcttgttataccaagttgggattggatggacgattttccttttctcccctctatatcgcctcctgataatgcgctgaatgagtgttcactgttccgacttcagactgatggaaatagctgccccgaatttggcatagctgctctgcttaaaaagaagatttttttt

SEQ ID NO: 24599 - DNA, 2393 bp, Zea mays
atcttaagacaaacgccgctttttttttttttttgttccgatcggagaaagtactcataattttctagacaggcaaaatgtgtactgacaacgatatcctcctcctcgtacactgctgacacttcgtacggcacaagccgttgtagaactcaaacataccctagactccattggaagaaaacacctcatggtcgacaggctgaccacacttcatcgtccattctgcttcctccatggacgaactagtgctacatcttagttgaactagctgtgggtgtacacaagatccaaacagtgtgtcgtcggcattacagtgcaccagacagaaatcttgtgtcgagattgctgtcgccatggacagtcctgccttaggagtgcatcctggagaccttttcagacaatccatcgacggtgccttccatctcctcaggtattccatcatcctctggctctgggtgtttatttctgacaacgacgcacttggaagcgcttatgcttgcactcttcaggtagctccgagagcttaagcttgtgggtttcacatcatccatgtcagcatcctctgaccttggagggctcacggtagtgcgggcaacagaatctgcgcttctctcctggtcattaatttgttgttcagtattgccatccttggatacaaccactctttcccttggtaaggaagcatgctttctttgcagtggggaacctctttctcctttgctgtaatgctcctcaagatgagcgaactgcagtttgaagcggtcgactccgcttggatagaggaagctaatctgttctccgcctttcatgtactcctccagcatctgtggatgatactccaaaatctctcgatagatcagttctctaacatcatctttggccagcttctttctttcaaattcaaactcaagtttagaaatcgggtgtcttgatggctcacgttccacattagcaagggatgcaaagtatggatcagctagagcctcttctgcactaggccggtctttaggatcaaatgcaagcaaacgctctagaagacgaagagccaaaggatcagcatgtcgaaatttatgagtaaagggcacgggatattttttccgcatgcagctcaaatatctcctggccttctcatttcgaatccgggataaggtctcagatgatggagtcccaagaagatctgttataatatctaattggtgtacaacattcttcccaggaaatagtggccttccagtgagaagttcagcaaatatgcacccaatgctccaaatatcaattgcaggagtgtatttggagaaaaaggaaccacatagttcaggtgcccggtaccaccttgttgccacataatctgtccaaaatatagctgaaggggcatcattgaatgatgcacgggcaagtccaaagtcacatattttcagtttgcagtccgagttagccagtatattcttgggctttagatcacgatggaatacattagcggcatgtatgtacttgagagctcgaagaagttggtacaggaaaaactggtgatgttcaggggtgaggtcatcattcgccctgatcacttgatggagatccgactccatgagctcaaaaacaacatagatgtcttggaactccctccgagaaggagggagcatgatgtgcttaatctcgactatgtctgggtgacgaagcaaccggaggagcttgatctcccgcagtatgcgtgtggcatccgagacgtgctcaaacacatcattgatcttcttgatagcaacccgctcaccggtgcgggtgtccacagctgcagcaactactccgtagctccctttaccaatgacttcttggatctggtactggcttgcctctccgtactctgtgaagaactccatttctactgagttcttcctgtggctctcgacgggcagcggcatcttgcgcttgggcacgcggatggcgcggaggccgaggagatccgggtcctcgatgacctcgagatcggatgagccgtcgtccgcttccccctcgccggcgagggacggctggttggagttggaggtggagccttcgctccggcggtggaaccagcggcggaagccgtgcacgatcgcgccccctccgcccatgctcctagccctgcgcgcccgacggcattggctgcccgcccgcccgcttaactatatacacaccacccgtccacccgctccaagcaagctcctcctctccactcctcccttcggttttctgtccttactcgcggacgcttgcttcccttccccgacgtgctactcccacccgggccaagtccaagggggggaagcccccgagtcgtcggcgccgtggggatggggactggattgacggactggaggacggaaaacgatgcgggcccctcggcttgtagttgcccg

SEQ ID NO: 24600 - DNA, 3244 bp, Zea mays
  misc_feature (1658)..(1658): n is a, c, g, or t
ggcatgggtactcagattttccaaaccagtaaattttagagaaatttttagtaagctatcaaactgtactcaccaatttccaaaccagagaatctaagttaatgaacacatttaaatgcctccaattataaaataaaataggacaaatcagattaaacgcagtgctttactgggatcgtgcgtagaagtacaggtacatttcgtctggtcgaaagctggtaaacagtcgtggactcttgcagttccatacacaaaactgatcttctcggctaagcgacacatgacatttaaactaaggtcgcactgacagaatctaattataaattggagcctaactataaattggagtatccatgatcattagtctgtgagatatgtacgtgtgcataagttcggggtcttttttttttttttttttgtgttttaatgaatcactttatccaaaatgaaggggtgcatcatgggtccattcatcaaatttagtgggatgactctattccacatattaatactaaacaactaactatgagaatgaggtggtgatggattaactcacttcattccacaaaccaaacaaaaaagtgagtgagaagatgatggactatatcattcctcaaaccaaacactccattaatgagctcagctatcggctgccctcagcagctgcagcagagacaggaacaagttgatgacgtcgaggtagagtgaaacagctgcccatatgtattgatcatatgtgtggcgcttgatgatattgtctgtgtcatagatgatatagccacagaagataagagatgccaatccaccatatatcatcacagagatcttgcccagtgggaaaaagatctgcgctcaggcaatctccattagtatggtgcataattaattcagcataagcaaataagtattcgatgatgcattcaaaatccaccacagtaaaaatatatcttaataaataataaagatatataagtacttaaagggaatccaggtagagccatccaacctggattagtgaaaacaccatgagcaccatgatagcagcaattaggaaggggccgaggaagttgaagtcatggcccctcttcgcagcccagaaagtgtaagcagttaagctgttcaccaccaccgctgtaagaatggcagcctccaaaatgatttttcctgctcacattgataacagacaatcaactccttcatagagaacaaaatactagttgacaccaactatacatgctcaaaacggtgacattagtaaagcacattgcaatcacacatggcagaattccagtcagtacatgaagttaattgccacaaatggagctgatcccattgcatacttctgcaatatgtcatagaagcattcaaggtttaggaccttatgcaaatgtactaagtgtcccatggaattcatctaaagctagtttctaaacagatgttgttgggtctgccaaaaagttcgtaacaatgtcaacatggagtttcaatgccacgcccacaaaagagctagaggcagaaacaagcgcaggatatgtaactctaatacaaaaaagatcaaacaagccccaacttctaagttctaccggatgatgtgagctcaaaaaaatacaaaacagtaaaagggagaaacccaatgatggttttgctcgttggttttnttgtcaagaaaagcaaaaagaataaatgtttcactaacggagtaccggacaacctttcaacaaggcctcaacaagatgaattaacggtcataaaacccacagatggagcaatgtaccaaatgcatttgtgttggatgggcagattacagagatgcttacacctaaagtcaagagattaatccacaaacacatgtagatatcataacaataatgggcaagaccaactagtaacatgtttgttcaaaatttgtgcaggttaatctaaagcatatccgactaaagacattagaacatgcaatctaaatacagatttatagacggggagacttcagatgaattacacttatgcagggttttttggcacatcacattctttaggctgaaatcggtgtcgacactgttgaagaactccagcagctcaactatatgtttgtggagatggaaataatagaacagaccttaatgttaaggcgattggtttactgtcgattggttgccaaaatttaccaaattttagtgcaacaaatgtggttaaaggggtatttaaagaagtggaatcctaatgcaaacagaaacgcccattcgttagaatcaccaaccaactcaaaaaccattttaagatgctcaatcagacaaacagtataaaatcactcacgctaccacacctaacgatgacttagagcgagcaaattaccgctagtgaaagcgcatgtcatgccgacggcgaagctgatggcgacggtgaagaggccgagcagcagcagattgatcggatgcttctggtggtagtagtgcagagggcacagcactgcgcgcaaaaggttgcacaccaatttcagctcacggggagaaaaaaaatcccgcaaaagacgggagacccgggcttaccgatgaagggcaggacgatgaggaagatgtagagcgcgatcccggcgttggaggagacgaaaaaattggagacggcgggcacctttgacgacgaaggccgagacggctgccgtcatggcgagctggaccgtgaggatgacgtagatcttgcggacgaacgcccaccgcagttcgggactctccgtcatccccgggtacagcagcgaggacccgccggcctcgaggtccgggtccgccttcctgtacccgaacatggcgtctagtttctctctcgctcggctcgctagggtttgggaggccgaccggccggcggagacgacgacgcgggcggggcgacaactggcccctgggccgcaaaagagaggacgaagactgaaaagcaaacgaacagttggttcgcgcactgggaatgctcggattggatgggcaagggaccaaacgaccttcgcgatgcgcgtgccttcgaagcgaaggcatagttctatatgggccgagtggagtgcgtgaatcgggcccatcactgctccttcccggatccatggtcctcattgattttgtctcacaaaaagcgggtgcggcgagcccgcctcggtctcaagatctgccttacatttttttttgataaacatttatgaaaatagaaaaatattggagttgttgtttttattagttgaattgtattttcaaaaaataaggca

SEQ ID NO: 24601 - DNA, 1238 bp, Zea mays
ggccgcttttttttttttttttttataaaatcataaagacttattgcaaataattgaccaagacacagatgtactgttactgcaccgcttatgatttttatccaagctcggttgttaagcaactgagctattgaccgcgcgtccgcgctcttaaaactctattgggtatccgtttttttttttttttttttttggaccaaggtaacaccgagccaccgacagagtatagttataaattggagtatccatgaccattacagagtttgtgatatacacaaatgtatgtgagaacaagatccaagtgaaagcttgacgagctcagctatcggctgccctcagcagctgcagcagagacaggaacaggttgatgacgtcgaggtagagtgaaacagcagcccatatgtattcatcgtaggtgtagcgcttgatgacattgtccgtgtcatagatgatgtatccacagaagataagcgatgccaacccaccgtatatcatcacagatatcttacccagcgggaaaaagatctggattagtgaaaacaccatgagcaccatgatagcagcaaataggaagggaccgaggaagttgaagtcatggcccctctttgcagcccagaaagtgtacgcagttaagctgatcaccaccactgctgtaagaatggcagcctccaaaatgatttttccgctagtgaaagcgcatgtcatgccgacggcaaagctgatggcgacggtgaagaggccgagcagcagcagattgaccggatgcttctggtggtagtagcgcagagggcacagcacgaggaaaggcaggatgatgaggaagatgtagagtgcgaccccggcgttggaggagacgaagaagttggagacggcgggcaccttgacgacgaaggcggagaccgcggccgtcatggcgagctggacggctaggatgacgtagatcttgcggacgaacgcccaccgcagctcggggctctccgtcattcccgggtacagcagcgaggacccgccggcctcgaggtccgggtcagccttcctgtagccgaacatggccgctagtttctctctcgctcgcctcgctagggtttcgcaggaaggccggcggagcggagacgacggcgcgggcgaccgacaactgggcaaagagaggacgaagacgaaaagcaaacgaatagttggttcgctgccccggctcggactacctggatgggtggatggacacgcctccgcaatcctcc

SEQ ID NO: 24602 - DNA, 1614 bp, Zea mays
tgttttgtaggtataatataagaaaaccaaacgtttatctttctagctacacgttggctttgaatgtctagatgcgtcattgtacacgtggcatgggtactcagattttccaaaacagtaaattttagagaaatttttagtaagctatcaaactgtactcaccaatttccaaaccagagaatctaagttaatgaacacatttaaatgcctccaattataaaataaaataggacaaatcagattaaacgcagtgctttactgggatcgtgcgtagaagtacaggtacatttcgtctggtcgaaagctggtaaacagtcgtggactcttgcagttccatacacaaaactgatcttctcggctaagcgacacatgacatttaaactaaggtcgcactgacagaatctaattataaattggagcctaactataaattggagtatccatgatcattagtctgtgagatatgtacgtgtgaataagatcgaagtaaattcttgtcccttgtttgttttaatgaatcactttatccaaaatgaaggggtgcatcatgggtccattcatcaaatttagtgggatgactctattccacatattaatactaaacaactaactatgagaatgaggtggtgatggattaactcacttcattccacaaaccaaacaaaaaagtgagtgagaagatgatggactatatcattcctcaaaccaaacactccattaatgagctcagctatcggctgccctcagcagctgcagcagagacaggaacaagttgatgacgtcgaggtagagtgaaacagctgcccatatgtattgatcatatgtgtggcgcttgatgatattgtctgtgtcatagatgatatagccacagaagataagagatgccaatccaccatatatcatcacagagatcttgcccagtgggaaaaagatctggattagtgaaaacaccatgagcaccatgatagcagcaattaggaaggggccgagaaagttgaagtcatggcccctcttcgcagcccagaaagtgtaagcagttaagctgttcaccaccaccgctgtaagaatggcagcctccaaaatgatttttccgctagtgaaagcgcatgtcatgccgacggcgaagctgatggcgacggtgaagaggccgagcagcagcagattgatcggatgcttctggtggtagtagtgcagagggcacagcacgatgaagggcaggacgatgaggaagatgtagagcgcgatcccggcgttggaggagacgaaaaaattggagacggcgggcaccttgacgacgaaggccgagacggctgccgtcatggcgagctggaccgtgaggatgacgtagatcttgcggacgaacgcccaccgcagttcgggactctccgtcatccccgggtacagcagcgaggacccgccggcctcgaggtccgggtccgccttcctgtacccgaacatggcgtctagtttctctctcgctcggctcgctagggtttgggaggccgaccggccggcggagacgacgacgcgggcgggcgacaactggccctgggccgcaaaagagagacggacgaaaagcaaacagaacagttcgaacagttggccggcctcgag

SEQ ID NO: 24603 - DNA, 1250 bp, Zea mays
accgcccccccccccgcgtacaatcttttttttttttttttttttttttttttttatgaccaagacatgtacagatgtactgttactgcaccgcttatgatttttatccaagctcggttgttaagcagctgagctattgaccgcgctcttaaaactctcttgggtatccgttaaagccagacataccatttgaaccaaggtaacaccgacagagtatagttataaattggagtatacatgaccattacagagtttgtgatatacacaaatgtatgtgagaacaagatccaagtgaaagcttgacgagctcagctatcggctgccctcagcagctgcagcagagacaggaacaggttgatgacgtcgaggtagagtgaaacagcagcccatatgtattcatcgtaggtgtagcgcttgatgacattgtccgtgtcatagatgatgtatccacagaagataagcgatgccaacccaccgtatatcatcacagatatcttacccagcgggaaaaagatctggattagcgaaaacaccatgagcaccatgatagcagcaaataggaagggaccgaggaagttgaagtcatggcccctctttgcagcccagaaagtgtacgcagttaagctgatacctgcccgggcctaagctcggcagcccccaaaatgatttttccgctagtgaaagcgcatgtcatgccgacggcaaagctgatggcgacggtgaagaggccgagcagcagcagattgaccggatgcttctggtggtagtagcgcagagggcacagcactgcgcgcaaaaggttgcaaccaatttcagctcacggggaaaaaatcccccaaaagacgggagagccgggcttaccgaggaaaggcaggatgatgaggaagatgtagagtgcgaccccggcgttggaggagacgaagaagttggagacggcgggcaccttgacgacgaaggcggagaccgcggccgtcatggcgagctggacggctaggatgacgtagatcttgcggacgaacgcccaccgcagctcggggctctccgtcatccccgggtacagcagcgaggacccgccggcctcgaggtccgggccagccttcctgtagccgaacatggccgctagtttctctctcgctcgcctcgctagggtttcgcaggccggccggcggagcggagacgacggcgcgggcgaccgacagctgggcaaagagaggacgaagacgaaaggcgtccgcggacgcgtcgtcgac

SEQ ID NO: 24604 - DNA, 1256 bp, Zea mays
gatgaatcgctttatctaaaatgaagttgtgcatcatgggtccattccttaaatttagtgggatgactttattccacatattagtactaaacaactaattataaagaatgaggtggtggtggattaactcactccattccacaaaccaaacaaaaaagtgaggagtgagaagatgatggactatatcatttctcaaaccaaacactccattaatgagctcagctatcggctgccctcagcagctgcagcagagacaggaacaagttgatgacgtcgaggtagagtgaaacagctgcccatatgtattgatcgtatgtgtggcgcttgatgatattgtctgtgtcatagatgatatagccacagaagataagagatgccaatccaccatatatcatcacagagatcttgcccagtgggaaaaagatctggattagtgaaaacaccatgagcaccatgatagcagcaattaggaaggggccgaggaagttgaagtcatggcccctcttcgcagcccagaaagtgtaagcagttaagctgttcaccaccaccgctgtaagaatggcagcctccaaaatgatttttccgctagtgaaagcgcatgtcatgccgacggcgaagctgatggcgacggtgaagaggccgagcagcagcagattgaccggatgcttctggtggtagtagtgcagagggcacagcacgatgaagggcaggacgatgaggaagatgtagagcgcgatcccggcgttggaggagacgaagaagttggagacggcgggcaccttgacgacgaaggccgagacggctgccgtcatggcgagctggaccgtgaggatgacgtagatcttgcggacgaacgcccaccgcagttcggggctctccgtcatccccgggtacagcagcgaggacccgccggcctcgaggtccgggtccgccttcctgtacccgaacatggcgtctagtttctctctcgctcgcctcgctagggtttgggaggccggccggccggccggcggagacgacgacgcgggcgggcgagcgacaagtggccctgtggggctcggatgagaggctgccgctggcattgtgctattcggcggcgcgctccagcagagcaagcgcagagaagagggccctacgagtggcggccttggcttgcccgactggcaggcgccagcgctttcacgccacgggcccgtccgtgggagtggactggtgtctggacggagcggcgcccgaggcctgcggttcacaagcgc

SEQ ID NO: 24605 - DNA, 845 bp, Zea mays
  misc_feature (114)..(114): n is a, c, g, or t
  misc_feature (173)..(173): n is a, c, g, or t
  misc_feature (231)..(231): n is a, c, g, or t
gtatcgctgccctcagcagctgcagcagagacaggaccaagttgatgacgtcgaggtagaagtgaaacagctgcccataatgtattgatcgtatgtgtggcgcttgatgatatngtctgtgtcatagatgatatagccacagaagataagagatgccaatccacccatatatncatcacagaaatcttgcccagtgggaaaaagatctggattagtgaaaacaccatgagncaccatgatagcagcaattaggaaggggccgaggaagttgaagtcatggcccctcttcgcagcccagaaagtgtaagcagttaagctgttcaccaccaccgctgtaagaatggcagcctccaaaatgatttttccgctagtgaaagcgcacgtcatgcccacggcgaagctgatggcgacggtgaagaggccgagcagcagcagattgaccggatgcttctggtggtagtagtgcagagggcacagcacgatgaagggcaggacgatgaggaagatgtagagcgcgatcccggcgttggaggagacgaagaagttggagacggcgggcaccttgacgacgaaggccgagacggctgccgtcatggcgagctggaccgtgaggatggcgtagatcttgcggacgaacgcccaccgcagttcgggactctccgtcatccccgggtacagcagcgaggacccgccggcctcgaggtccgggtccgccttcctgtacccgaacatggcgtagcgtagatctagtttctctctcgctcgcctcgctagtgtttgagaggccggcaagccggcggagacgacgacgcgggcgggcgagcgagcgacaactggccctcccg

SEQ ID NO: 24606 - DNA, 1270 bp, Zea mays
  misc_feature (1259)..(1259): n is a, c, g, or t
agcacataaatatctccgacatcttactaataatagtatacaaatatattttgcataaaacggaattagcttaattgatatatgcctttttttcttttgtttgaatggaattcaattccaatgatccaaacggggcgttagtgtcataactgacccgtaacggacgtgaaattgagcatcctctgtgctatgacaaaattaaaatcccatgacgtgaagctattacaaatcaagatcattccaacactgggtttattttccctcagtcacagtcacagaagaacgaagctcctgtgtatcagcagctgggatacacacacacacaccactcgtgcaggtcagtaaaagttccatccaggcagcttttggcaccgcaagcgtctggaagcagtaggtgcaaattaaaccgtcatctgtcccttcttcagtggtagagcttgtccagatcgtctttgaatttggcctttatttgctccctcttcagtttaagcgctgcggtcaccagcccggactccggcgtccacggttcaggcaacagcacgatcttcgctggcacctcgaatttctcgagcctcgctgcttttgcggcctttgatagcgattgctgaacctccttaattgctcggtcgttttggcaaagctctgcaaagccttcatagtttatcccggaattctgagcccacttctccaaggcctggtgcgctggaacaaccagggcaacacagtagttatgaaatggatcggcataaaccatgatgttctccacatagttgcttgttgctagagccgattcaaccttgccaagagacacatattctccatgctgaagctttactatatcttttttcctgtcaataatctcaaggcacccatcaggatggaactgaccaatatcaccagtgtagaaccagcgtatgcccctctcatcaaccttgtatacttcgttcgtctttgcttcattgttgaaataaccttttgttatactgtgtccgccaaccacgacctctcctctcggcatcggagaatcagaaatcttgtaaccaccttcttcccatgagacaagcttcacatagcagcaaggaagtggtggaccaacacgacccacacttgtatcatcccattcagtgaaagctgctccagcacaagtttcagtcaatccatagccttgacccactgggacacctagacatatattcataaatctttgtgtgtcacttgacagaggtgcaccaccacaaagaacaaatcttagacgtctnccgagcattgc

SEQ ID NO: 24607 - DNA, 1116 bp, Zea mays
  misc_feature (3)..(3): n is a, c, g, or t
  misc_feature (8)..(9): n is a, c, g, or t
  misc_feature (12)..(12): n is a, c, g, or t
  misc_feature (15)..(17): n is a, c, g, or t
  misc_feature (20)..(21): n is a, c, g, or t
  misc_feature (23)..(25): n is a, c, g, or t
  misc_feature (27)..(27): n is a, c, g, or t
  misc_feature (38)..(40): n is a, c, g, or t
  misc_feature (42)..(42): n is a, c, g, or t
  misc_feature (45)..(45): n is a, c, g, or t
  misc_feature (50)..(51): n is a, c, g, or t
  misc_feature (57)..(58): n is a, c, g, or t
  misc_feature (64)..(64): n is a, c, g, or t
  misc_feature (68)..(68): n is a, c, g, or t
  misc_feature (73)..(74): n is a, c, g, or t
  misc_feature (77)..(77): n is a, c, g, or t
  misc_feature (84)..(84): n is a, c, g, or t
  misc_feature (88)..(88): n is a, c, g, or t
  misc_feature (95)..(96): n is a, c, g, or t
  misc_feature (99)..(99): n is a, c, g, or t
  misc_feature (106)..(106): n is a, c, g, or t
  misc_feature (141)..(141): n is a, c, g, or t
  misc_feature (158)..(158): n is a, c, g, or t
  misc_feature (170)..(170): n is a, c, g, or t
atntctannccntgnnnccnncnnncncccagtaaaannncncangatgnnagaagnntcacgnggtnaaagnngtntcagccncganagggttnntcntcaatanagataatatgcttaaggaatgtgcaatttaaaggntgattgcaggtattttnttaagttgtttngaatcacatatcagagttgaaacctgtgtctcgtttagtgaatgcaccaatgcatcctcaccaagagatgcatatattgttacaaccgtcaaatttggtcggaagcatccctgagcagcaatgatccactcagctcgggtatcagagaagatagcagcatgactatctaggtcgtggcccatcttgacaagtccagaagcaaaattacatgcgcggttaaatgcctcggcgtacgtatcccattcgtattcaccaaggtgcagtttctcaaacttcctaccatcagaagattccacaaattccctcttgattagcttcctcgtgccaagacacctccgtcgagagtattttttgctggccatctcgaacagagctgacatcgtggtggcgccttcccatgggacttcaactaaggaggaaaacctactgttccgcatggcaaatccttcctctccacccacattagctcgcaccgccctctgctttgttttcttgccaaacatcatggagagcaagacgggagtaactacagccagaagcagagcgacgacgactccattcacaccatactctttcaacagcggtacgtcacttgttgcgattctttttagaaaggacaggttggaattgtcatcactaacttctcccatggttttctactatgtctggagcatcggacgtaacttgacaaacttggcgggaaggaggggggcagcagaaacggctccgactactccgcgacgacgcctcgtggtcgtggctgtgttgtccggctcggctctgcgggctacgcctcgccgaggaggaggggatcggtcgccggatctgaggtggcgacgtcgtgagccggtgaggaggcgtgtgaggggctgagtccgtgtcgaatcgcgcaggaagaagcagcctggaaggcgaattgagggtcccgtgttccgttcccggccgg

SEQ ID NO: 24608 - DNA, 2897 bp, Zea mays
cagaaaaataacaatccgtcaagtacaacttcaaggaagaattgttgtgttcaaaaaaaaaaaaaaaaaaaaaaaaaaaaaaaaaaaaaaaaagggcggccgccctttttttttttttttttttttttttttaggggatgtgcccagggcctatttattgtgtgtctatataaaaaaaacatcatttacaatatgcttagtgtcataactgacccgtaacggacgtgaaattgagcatcctctgtgctataacaaaattaaaatcccatgacgtgaagctattacaaatcaagatcattccaacactgggtttatttttcctcagtcatcacagaagaacgaagctcctgtagtcctgtgtatcggcagctgggagacacacacacacacacacaccactcgtgcaggtcagtaaaagttccatccaggcagcttttggcaccgcaagcgtctggaagcggtaggtgcaaattaaaccgtcctctgtcgcttcttcagtggtagagcttgtccagatcgtctttgaatttggcctttatttgctccctcttcagtttaagcgctgcggtcaccagcccggactccggcgtccacggttcaggcaacagcacgatcttcgctggcacctcgaatttctcgagcctcgctgcttttgcggcctttgatagcgattgctgaacctccttaattgctcggtcgttttggcaaagctctgcaaagccttcatagtttatcccggaattctgagcccacttctccaaggcctggtgcgctggaacaaccagggcaacacagtagttatgaaatggatcggcataaaccatgatgttctccacatagttgcttgttgctagagccgattcaaccttgccaagagacacatattctccatgctgaagctttactatatcttttttcctgtcaataatctcaaggcacccatcaggatggaactgaccaatatcaccagtgtagaaccagcgtatgcccctctcatcaaccttgtatacttcgttcgtctttgcttcattgttgaaataaccttttgttatactgtgtccaccaaccacgacctctcctctcggcatcggagaatcagaaatcttgtaaccaccttcttcccatgagacaagcttcacatagcagcaaggaagtggtggaccaacacgacccacacttgtatcatcccattcagtgaaagctgctccagcacaagtttcagtcaatccatagccttgacccactgggacacctagacatatattcataaatctttgtgtgtcacttgacagaggtgcaccaccacaaagaacaaatcttagacgtcctccaagcattgcccgtattggtttataaataatgtgatcccataacatcctctctggtgcccaagatccaaaccaactcccttcaattgctgcaatatttcgcttatatgaaaaatcaaacagcttttttgtcaggccacccttctcaccaactttcttaaatactgcatctctgatacgatccaaaattgcaggaactgaaatcataagagtaggattcagtacagaaacatctccttttgttcccttcttaatcttgttccccggcccgccccgaggcacccctggaccatatccaatggcactgccagaagctaacatgacagtctcccctgctagttcaaagacatgagccaatggaagataagccagataaacatcattcatgccaaggtttgggactattgtcatgactgctgcagttgtggccaccatgttgccatgtgtgatcattacacccttgggaagaccagtacttccgcttgtatacatgataactgcagtatcagagcctgaaggtaaccttgcatcaacatgagatgtcttgccaagctcctctacttcagtgaaagacaatgttgtcaaatgcttcacttggttcagtgtctcagcctcgacaggttcatcctcaatatagataatacgcctaagactctgcaatttagagctgattgcaggtatcttcttaagttgcttcgaatcacatatcagagttgaaacctgtgtctcatttagtgaatgcaccaatgcatcctcaccaagagatgcatatattgttacaaccgttaaattttgtcggaagcatccctgagcagcaatgatccactcagctcttgtatcagagaagatagcagcatgactatctaggtcgtggcccatcttgataagtccagaagaaaaattacatgcgcgattaaatgcctcagtgtaggtatcccattcatattcaccaaggtgcagtttctcaaacttcctaccatcagaagattccataaattccctcttaattagcttcctcgtgccaagacacctccgtcgagagtactttttgctggccatctcgaacagagctgacattgtcgtggcgccctcccatgggacttcaactaaggaggaaaacctgttgttccgcattgcaaatccctcctctccacccacatcagctcgcaccgccctttgctttgtcttcttaccaaacatcatggaaagcaggacaggagtaactacagccagaagcagggcgacaacaactccgttcacaccatactctttcaacagcggcacgtcacttgtagcgattctttttagaaaggacatgttggaattatcatcactaacttctcccatggttttctactatatctggagcatcaacagtagcttgacaaatttgactgttagcacgttatggaagtaacaacggtgatgcacttgaattgctgcgcctcgccgcgccgagggggaggggggtcgatcggtcgggggccgttggccagatctgcggttgcgacgacgcgaggaggcgtgaaggtggtgggcactggccactggggcttccgctccgcgtcg

SEQ ID NO: 24609 - DNA, 2971 bp, Zea mays
caatcagagcacagggagccattttattaaagtctgaccacagatcaaaactgtggtaaaaacatcaaaactgtggtaaaaacatgtatccatacccggctctggtatctattggattagatatccaacaaatatctaaatccacaggtcaaattgcgaacgactatggccatctcagagaacgccccgacaattgccggctgcccggcttcaaccatcgtgaggcatcaaaaccgatagcggcaactcttatcgaccggtccatccagattcaactgatttcgagctagggttcatgcaagttaagtgaagctatacaaatcaagatcgttccaaccaacactttggcttatttttcatcacacaagaagcagctcctgctgtaccgacgccgacacacatccacacacacacacacaccactcgtggtctcgtgcaggtcagtaggttccattccgcatccaggcagcgttttggcagcgcaagctcctgaacgcgtgggtgcaagccccgcttttcttcagtggtagagcttgtccagatcgtctttgaatttggcctttatctgctccctcttcagcttaagcgccgccgtcaccagcccggactccggcgtccacggctcaggcagcagctcgatcttcgccggcacctcgaatctctccagcctcgctgctttcgcggccttcgatagtgattgctgaacctccttaaccgcctggccattttggcaaagctcttcaaagccttcacagtttatcccagaattttgagcccacttctccagggcctggcgtactggaacaaccagggcaacacagtagttatggaacggatcggcgtagaccatgatgctctccacataactacttgttgctagagccgattcaaccttgccaagagacacatattctccgtgctgaagctttactatatcttttttcctgtcaataatctcaaggcacccgtcaggatggaactggccaatatcaccagtgtagaaccagcgtatacccctctcgtcaaccttgtatacttcattcgtctttgcttcattgctgaaatagccttttgttatactgtgtccgccaaccacgacctctcctctcggcatcggataatcagaaatcttgtaaccaccttcttcccatgaaacaagcttcacatagcagcaaggaagtggtggaccaacacgacccacacttgtgtcatcccattcagtgaaagctgctccagcacaggtttcagtcaaaccatagccttgacccactgggacacctagacatatattcatgaatctttgtgtgtcacctgataaaggtgcaccaccacaaagaacaaatcttacacgtcctccaagcattgcccgtattggtttataaataatggtatcccatatcatcctctccggtgcccaggatccaaaccaactcccctcaattgatgcaagattccgcttatatgcaaaatcaaacagcttttttgtcaggccacccttctcaccaactttcttaaacactgcatctctgatacgatccaaaattgcaggaactgaaattataagagtaggattcagtacagaaacatctccttttgtccccttcttaatcttgttcgatgtatcagtcatagtcaatgttgaaccatatccaatggcagtaccagaagctagcatgacagtctctcctgctagttcaaagacatgagccaatggaaggtaagccagataaacatcattcatgccaagttttgggactattgtcatgactgctgcagttgtggccaccatgttgccatgtgtgatcattacacccttgggaagaccagtacttccgcttgtatacatgataactgcagtatcagagcttgaaggtaaccttgcatcaacactagatgtcttgcctaactcctctacttcagtgaaagacaatgttgtcagatgcttcacttggttcagtgtctcagcctcgacaggttcatcctcaatatagataatatgcctaagactctgcaatttagagctgattgcaggtattttcttaagttgcttcgaatcacatatcagagttgaaacctgtgtctcgtttagtgaatgcaccaatgcatcctcaccaagagatgcatatattgttacaaccgtcaaattttgtcggaagcatccctgagcagcaatgatccactcagctcttgtatcagagaagatagcagcatgactatctaggtcgtggcccatcttgacaagtccagaagcaaaattacatgcgcggttaaatgcctcggcgtaggtatcccattcgtattcaccaaggtgcagtttctcaaacttcctaccatcagaagattccacaaattccctcttgattagcttcctcgtgccaagacacctccgtcgagagtattttttgctggccatctcgaacagagctgacatcgtggtggcgccttcccatgggacttcaactaaggaggaaaacctactgttccgcatagcaaatccttcctctccacccacattagctcgcaccgccctctgctttgttttcttgccaaacatcatggagagcaagacgggagtaactacagccagaagcagagcgacgacgactccattcacaccatactctttcaacagcggtacgtcacttgttgcgattctttttagaaaggacaggttggaattgtcatcactaacttctcccatggttttctactatgtctggagcatcggacgtaacttgacaaacttggcgggaaggaggggggcagcagaaacggctccgactactccgcgacgacgcctcgtggtcgtggctgtgttgtccggctcggctctgcgggctacgcctcgccgaggaggaggagatcggtcgccggatctgaggtggcgacgtcgtgagtcggtgaggaggcgtgtgagggactgaggggctgagtccgtgtcgaatcgcgcaggaagaagcagcctgaaatt

SEQ ID NO: 24610 - DNA, 4180 bp, Zea mays
  misc_feature (1586)..(1586): n is a, c, g, or t
ccacccatattttgagaacaatgtaggagagattgatcctccataaaactctctatccccccgctcatgtaaaactttgatcgtgtatcttcctcaatacggtgctatgtcagtgtatatttagtcgtcgtatccataaaaaaacttttatgaaacctctactaagttcggtcttgttgcatgaatgaactttatctgaagtgtgcatatcgttgcatctgcatgcatgctcccaagtcccacatacgtacgtggggcatgatgggaatgagactatcatgcatggttccaatgttagagcacgcatacatgcatactccagattctccagtcctatacccagtcctacacaggaataagatttgcaagcatcgttatttgcagtcaaatggatggattggttggacgcagtcagatggatggacgcgcgatattatgtttggttagacgtcaaaaaaaaagaatagaaagagattgccaagtgtttggttggacctacaagaaaggatagaaatagttagtcatattttctttagtgtttagatacaagtcacatgagaacaaggtgaacaccaaagctacttttagtgatgacgtggtctaaaaaatcgaggggatcgcctccgcctcatcctactttaacctcaaaactaaccaacctcgtccgtcttcccattacaaatcaatagatgtcgttttagagtaccattaggtgatgtgcccagggcctatttattgtgtctatataaaaaaacatcatttacaatatgcttagtgtcataactgacccgtaacggacgtgaaattgagcatcctctgtgctatgacaaaattaaaatcccatgacgtgaagctattacaaatcaagatcattccaacactgggtttattttccctcagtcacagtcacagaagaacgaagctcctgtgtatcagcagctgggatacacacacacacaccactcgtgcaggtcagtaaaagttccatccaggcagcttttggcaccgcaagcgtctggaagcagtaggtgcaaattaaaccgtcctctgtcgcttcttcagtggtagagcttgtccagatcgcctttgaatttggcctttatttgctccctcttcagtttaagcgctgcggtcaccagcccggactccggcgtccacggttcaggcaacagcacgatcttcgctggcacctcgaatttctcgagcctcgctgcttttgcggcctttgatagcgattgctgaacctccttaattgctcggtcgttttggcccacataggctctaatccaaagccgttgcatacttcatcccaaaacctagcatgagtaacatgtccaccatggggaaaaaaaaggtttcaaggcacatgactgttgcctagctcgctattggtacgagaaaaggcaaagcagaacacgctgcaacctttcagatgcaaaattgtgcctctgaaaaccaaagaggtactcttcctttgacacacggcctttgaactctgttagtatagttttttagtcatgtaagacgccatcaactgagttatgtctaacctttgatagcgattgctgaacctccttaattgctcngtcgttttggcaaagctctccaaagccttcatagttcatcccggaattctgagcccacttctccaaggcctggtgcgctggaacaaccagggcaacacagtagttatgaaatggatcggcataaaccatgatgttctccacatagttgcttgttgctagagccgattcaacctgcaaagagagacggtaaatcactcgttcaacaaaatattcacagtaggaattttttttaaaaaaaactaacaaacaaaccttgccaagagacacatattctccatgctgaagctttactatatcttttttcctgtcaataatctcaaggcacccatcaggatggaactgaccaatatcaccagtgtagaaccagcgtatgcccctctcatcaacctgtaggtcatatgaaatggaaataaagtcaaccctctaaggctataatgttctggacctctgatagaatcttaccttgtatacttcgttcgtctttgcttcattgttgaaataaccttttgttatactgtgtccaccaaccgcgacctctcctctcggcattggagaatcagaaatcttgtaaccaccttcttcccatgagacaagctacattggttcaacgaaaaaaaataacatatttcagataattaaggcctggacatgctggtaagaagagtctttcagggaagtggaagtgtccagtgtacttgttagggaatcaaaatcagataaatagttgggggcaagtatgtaacaggaaagtttgagcattccattgaaagaaactaaaattcttagctatgtggttgataaagtgcatccagaaaaagtgccaagcatgacactctcagacacttaaatctatcactcattccttttaatgcaggtttcatctgctacatctgccacatgaatatcaaatatatttgttaacagatccagcaaacatcaaattcgtgaacacaaaccttcacatagcaacaaggaagtggtggaccaacacgacccacacttgtatcatcccattcagtgaaagctgctccagcacaagtttcagtcaatccatagccttgacccactgggacactgcagcaacaattaagtagcatattaaggacaagaaacaaaggaaacaacttgccttgtcaggaaagttcataggctacacatgcgattgaatgtagaaaattccactgattagtactcttcagtttatcacctttgaatcagcaaggaaattcagaataataataactctacatatttaagaatgaactaatacaactgataatgactgaatcaggataacatggacctggacccaatatgagcatgtcaaatttgtcatttgtgtacattcaacaagaaatcaggggtttctcagtcgggaccgttgtcgtggccttctattaagataataccttaccctccctggccgagtttttttttaattcaacaagaacactggtcaagagcttttaaaagcaaactatgattgcaaattcatagtctaacaatccctagtcaaatgtatgggaatgaatttacagctgctacgaaccaagtaactatgtttaagagtttcatgtataacaactagttgaagattctgagcctagtggaatataggatctcaatgatatactgttccataactaagaatcatattataccatacattcgatcagctaagatacagcacaagttgtcagtcaatccatagccttgacccactgggacacctagacatatattcataaatctttgtgtgtcacttgacagaggtgcaccaccacaaagaacaaatcttagacgtcctccaagcattgcccgtattggtttataaataatgtgatcccataacatcctctctggtgcccaagatccaaaccaactcccttcaattgctgcaatatttcgcttatatgaaaaatcaaacagcttttttgtcaggccacccttctcaccaactttcttaaatactgcatctctgatacgatccaaaattgcaggaactgaaatcataagagtaggattcagtacagaaacatctccttttgttcccttcttaatcttgttcgatgtatcagtcatagtcaatgctgaaccatatccaatggcactgccagaagctaacatgacagtctcccctgctagttcaaagacatgagccaatggaagataagccagataaacatcattcatgccaaggtttgggactattgtcatgactgctgcagttgtggccaccatgttgccatgtgtgatcattacacccttgggaagaccagtacttccgcttgtatacatgataactgcagtatcagagcctgaaggtaaccttgcatcaacatgagatgtcttgccaagctcctctacttcagtgaaagacaatgttgtcaaatgcttcacttggttcagtgtctcagcctcgacaggttcatcctcaatatagataatacgcctaagactctgcagtttagagctgattgcaggtatcttcttaagttgcttcgaatcacatatcagagttgaaacctgtgtctcatttagtgaatgcacccaatgcatcctcaccaagagaatgcatataccggccggcctcg

SEQ ID NO: 24611 - DNA, 1975 bp, Zea mays
tacaagactctacagtgactcggtcttgtttcgctgtcttgttccgcgctccccaacccccctcccaaccccaaccccgtcccaacccccactacggccttccccccatggctcccctggcctcccttcctctcccgcccagtactgccgtcaccgctcgcttcctcgccgcccccgccatccgcgtgatcagcccatcgcggcccgcgctgccgctcctctcatccgcctccgcaggcggcttccctcacgcctctcgcgctccctgcagtgccgcccgcgagcaccgccgcggcaccgtgcgggaatgctctcgagctgatgctgctggagcagctccattatcaaagacactgttagacctcaaggattcctgctggagatttttaaggccacatacaatccgaggaactgctttaggatccatagcattggttgcgagagccttgatagagaattcccatctgataaactggtggttgatattcaaagcattctatggacttggggcattgatatttggcaatggttacatagttgggattaatcagatctatgatgttgctattgacaaggtaaacaagccatatttacccattgctgctggtgatctctcaattcagtcagcatggttgttggtgatattatttgcagctgcaggtttttcaattgttatatcaaactttggacctttcattacctctctatactgccttggcctatttcttggcactatatattctgttcctccattcagactgaagagatatccggttgctgcttttcttatcattgcaacggttcgtggtttccttctcaactttggcgtgtactatgctactagggctgcactaggtcttacattccaatggagctcccctgttgctttcattacatgcttcgtgacactatttgctttggtcattgctataaccaaagatctccctgatgttgaaggagatcgcaagtatcaaatatcaactttggcaacaaagcttggtgtcagaaatattgcattccttggatctggtttattattagcaaactatattgctgctattgctgtagcttttaccatgcctcaggctttcaggtgcactgtaatggttcctgtgcatgctgtccttgctggtggtttaattttccagacatgggttctggagcaagcgaagtacagaaaggatgctatttcgcagtactatcggttcatctggaatctcttctatgctgaatatatcttcttcccgttaatatagagaggtgagtttcctgattagcattcagcatccatgaccctttgcttctgacatttgtctgcacaaaaaaatgtcagatcttgtagttcatcttgatcttgggctacagcctaattcatggtgaaaagagggagaagttggcaaagtgaggtctgtcgtgcatattttcaacggaaacaatggagtagcaatattgctatgctagggttctgaagttgtaggagcttttctaagcttttacgatgttgaaggcgttgttggagctgtggaagctgttttccttttttttccttttgtatcaacagtgtcgcgttctgtacggtcttacttggaagtgctttgacctttgagcacatgggttgaagcttgagatctggtcccgaacaggtggcggtggaacggccaagacaagcttgtttcatgccactcgaggtcgaggctaaaccactacggcgtgctcttccatgaaacgcagaaaactagggaaatgactatatatatggtgcaatacgttgtatattttctgagtttcagctcgtatatatagtaggaacctcaacttttaccccatcgattggaagactgaaacttcttgcatgcgtatgtatgcctgtgggtatgtaaaaaccttggcccgcacaaagctacatgttacagaactttcagctaaaaaaaaaaaaaaaaaaaacgcccgggggggccccctggttttcctgcag

SEQ ID NO: 24612 - DNA, 1817 bp, Zea mays
aaaccccgtcccaacccccactacggccttccccccatggctcccctggcctcccttcctctcccgcccagtactgccgtcaccgctcgcttcctcgccgcccccgccatccgcgtgatcagcccatcgcggcccgcgctgccgctcctctcatccgcctccgcaggcggcttccctcacgcctctcgcgctccctgcagtgccgcccgcgagcaccgccgcggcaccgtgcgggaatgctctcgagctgatgctgctggagcagctccattatcaaagacactgttagacctcaaggattcctgctggagatttttaaggccacatacaatccgaggaactgctttaggatccatagcattggttgcgagagccttgatagagaattcccatctgataaactggtggttgatattcaaagcattctatggacttggggcattgatatttggcaatggttacatagttgggattaatcagatctatgatgttgctattgacaagataaacaagccatatttacccattgctgctggtgatctctcaattcagtcagcatggttgttggtgatattatttgcagctgcaggtttttcaattgttatatcaaactttggacctttcattacctctctatactgccttggcctatttcttggcactatatattctgttcctccattcagactgaagagatatccggttgctgcttttcttatcattgcaacggttcgtggtttccttctcaactttggcgtgtactatgctactagggctgcactaggtcttacattccaatggagctcccctgttgctttcattacatgcttcgtgacactatttgctttggtcattgctataaccaaagatctccctgatgttgaaggagatcgcaagtatcaaatatcaactttggcaacaaagcttggtgtcagaaatattgcattccttggatctggtttattattagcaaactatattgctgctattgctgtagcttttaccatgcctcaggctttcaggtgcactgtaatggttcctgtgcatgctgtccttgctggtggtttaattttccagacatgggttctggagcaagcgaagtacagaaaggatgctatttcgcagtactatcggttcatctggaatctcttctatgctgaatatatcttcttcccgttaatatagagagatcttgtagttcatcttgatcttgggctacagcctaattcatggtgaaaagagggagaagttggcaaagtgaggtctgtcgtgcatattttcaacggaaacaatggagtagcaatattgctatgctagggttctgaagttgtaggagcttttctaagcttttacgatgttgaaggcgttgttggagctgtggaagctgttttccttttttttccttttgtatcaacagtgtcgcgttctgtacggtcttacttggaagtgctttgacctttgagcacatgggttgaagcttgagatctggtcccgaacaggtggcggtggaacggccaagacaagcttgtttcatgccactcgaggtcgaggctaaaccactacggcgtgctcttccatgaaacgcagaaaactagggaaatgactatatatatggtgcaatacgttgtatattttctgagtttcagctcgtatatatagtaggaacctcaacttttaccccatcgattggaagactgaaacttcttgcatgcgtatgtatgcctgtgggtatgtaaaaaccttggcccgcacaaaaaaaaaaaaaaaaaaactttcagctcgatggatcggtgaaaaaactgtcctattttgcgacc

SEQ ID NO: 24613 - DNA, 2396 bp, Zea mays
  misc_feature (230)..(230): n is a, c, g, or t
gtgcgcatgtgacctgaagatgaagcatttcctcttatgcgtttgtctagtttaggttgcattgagtggacggcgttaaatttatgaaataaaataaaaacgacttcgttttcctatttgcattccctcgtgatgtgcgtgagtgaaagaaacatgtaagaaaagcgacacaatgcacgctacgctactcctgccgtggcacgagctccctcaacctctcagccattgcntcgtccactacggcgtactcctcttcttcagttcttcctaccaccaagaaaaacaccggtacacactggccactgctatatatacccccaacctccttcccgccattatccaccacaagcaggtagcattcagcgccataaagaacttggatttctctgctgactgcttcagcttgataacaataacaattcattgctcgtctcgagcgcagatggatcgcgagagcgcgatgcagggcagcagtggtggcaaccccggtgctgccacgcaggaggagtggctctaccctggcggctggcagccggagcaagctgtcgtggacggcgcgttcctcatggagctgctggaggacgcgccggtggcggaccagccgccagaggacgtcgaccggctaagccgcgtcatccggtccctggaggctgagatcgatggaggtgggcagccgccctcggcggtggcagacgcaggcacggcggagcaggtcctgggagacgtccatataggcgcgctggaggactaccgcctgctgccgtaccttggtagcatccccagcccctgcgtggccgaggcgccgttggagctctggacggaggtgccggcggcggtggggcatggtatgggcggttggtacctggacggcgacggcgtcatggtcgggtacgagttcagagagcagtgcttttacggctacaacgagagcccacacgttgagcaagtgtacagccccttgtgggaatgaatgatcaaatgtgaaaccacatataactatatgaattcaagcctgaatgaatgaccaaatctgtgaaaacgaaacgaatctaaatatatgaattgaagcttaaaatgtttcgaaaaaaaaaaaaaaaatctgctttcattttatcaaaaggtattgtgaacttgacgatctttcttcaattcattatcttactaaaggcttaaccacaaggcgatgtctacacctaattttgcactcgcagttttatactgctccacattatcagtaaccttactttcttttttattcgtttacacgctctcgaaaacaaattgatgttataggatttttttatgacagaagtgttaaattgaaattattcggtccttaaatataaagtatgaaagcattaagatttgctctatcccatgtgtccttaccttttaaatcttatctatacatcattttgtgcagaatgagcagtcggcaaaccaatagcaatatagcatgctgaaatctagccttcgtctccagctcgacggggaagaactgggagcatcagtccccttcacgctcatgcgaatacgtttgccggtttgcgtgagtcgtgaatatggcggcaggattcacatcggtgacaattccaatggaactcccccctctgtctcgaagcagatgagcagacgtgtggtgagggagggatgaaagtggaagagaaaggaagcattattgctttccaataaaaaagcagcgcagaggcggcggagcccaggagacgagcaggggacctgacctccaaccctatagtaatgctatgtataaagtcacaatatggaacaagaaatttattttggtcaaaataaatttgtctattgtgtaaaaatttggcatatttttttgaaacatcaaatttgtcgttaataataaaatcgataaatttaagtccaaatatatcaccggatacaatccaaatttgtcattggataattattgtgcgtgccacaaatttgtcgtgtacctacgcaagctccttgatgtatacaacttatcaaacacatctacgaaataaaatgggagttactttatcatttgtcttgagataaaattgacaactaagattaactctcatgatataactgaagcttttaatttagccatcattgtagtggcaaattattttgatcttttgttagagttaattaatacataattgtacgtgcaagttttttataaatttattatctatgctatatacaaattagtatatgtatgtatatatcctacgatattttttcacattttttcaccctacagtattggtgaattgtctagccccttctatgccataattatagttccgtccctgactcctggagtctctatatgataatatgacataaatagttgggatgtttctgctccaaaaaaacaaccggacgcgagcgct

SEQ ID NO: 24614 - DNA, 2202 bp, Zea mays
  misc_feature (1879)..(1985): n is a, c, g, or t
  misc_feature (2054)..(2058): n is a, c, g, or t
  misc_feature (2075)..(2079): n is a, c, g, or t
  misc_feature (2083)..(2087): n is a, c, g, or t
  misc_feature (2101)..(2105): n is a, c, g, or t
  misc_feature (2109)..(2115): n is a, c, g, or t
  misc_feature (2132)..(2176): n is a, c, g, or t
tacgggggccccctcggacccggcccgggacttcaggttcttcccccgatcttccccgctcagcttcgcgtaattgcatttaagcccctttggcactcattgccgtccccctcggctccatttcttggaggtgaccgcagctctccggcggaaggcggcgcagatggcttccgcggcgacacagtgcttcagctactcctcgttgccggccacgtgggctctgcggcagcggggcggcggtgccagcgtgctccggctctcttcccggcggaccttctcggtctccgcggcggccgggttcgacaaccagaaccgcgagtatgtgatcgtcgggggagggaacgctgcgggttacgccgccaggacgttcgtggagcatggcatggctgacggccgcctttgcatcgtctccaaggagccagttccaccatacgagcggccagccttgaccaaaggctatctttttcctccggacaagaaaccggctcgcctacctggtttccatacatgcgttggatctggtggacagcgacagactgctgaatggtacaaggagaatggtatagaggtgctgtatgaggatccagttgtagcatttgatggcaaaacgcaaaccttaaagacttcatcggggaaagttctgaaatacggctcacttattatttctactggatgtgaagcatcgagattacctgagaaaattggagggaaattacctggagttcactacatacgggatgttgctgatgctgatgctctagtatcctcattgggaagtgcaaagaaggtggtggttattggtgggggctatattggcatggaggtagctgcagcagcttgtggctggaatcttgacacaacgattatattcccagaggaccacattatgccaagattatttacgccctcgcttgctaagaagtatgaggaactgtatcagcaaaatggtgtcaaattcataaagggagctcttatcgaaaaacttggagctggctctgatggaagggtgtcttctgcagtacttaaggatggatctgtagttgaagctgatacagtaattgttggtataggagcaaaaccagttgtcagcccgtttgaagctgttggagttaaccctaaagttggtggaatagaggttgattccttgttcagaactagtgtacctggcatctttgcaattggagatgtagcagcgttccccctgaagatgtacaatagaattgctcgagtggaacatgtggatcatgctcggaagtccgcacaccactgtatagagacgctcctaacatcccagacaaaagcgtatgactaccttccatacttctactcgagggtttttgagtacgagggaagttcgaggaaagtctggtggcagttttatggcgacaatgtcggcgaagcagtcgaagtagggaactttgatccaaaggttgcgactttctggatcgactctgatagccggctgaagggtgttttcctcgagagtggaacctcagaggaattctcgcttcttccgcagctcgccaaatctcagcctgttgttgacaagtcaaagctccaggccgcgacttctgttgaagatgcattagagattgcaagaagctcactccggtccagcgccacggtttagatctcagaatctagtactttcttgaacccgaggctgtgcgctgctcgagcggttcatagcgtcgagaccacgtcagcaataacgcacaattacatagaatctattcccactggggttgtaacattcttcagtgcacctgggtcggccatttccagcttgaaataaacctggttgccctttgaggggttgatgaggatgatagattgaagcctttatgctacttttttaaaaaaaaaaaaaaaaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttacccgtgaatgcaacgtcaaaccccttcaaaagggccaccaaaattcaattcacgggccgtcnnnnnaaaaccccgggacgggnnnnncccnnnnntaccccaatttaannnnnttgnnnnnnntccccttttcgcaagtnnnnnnnnnnnnnnnnnnnnnnnnnnnnnnnnnnnnnnnnnnnnntttccccaccctgaaggggaaagggg

SEQ ID NO: 24615 - DNA, 2143 bp, Zea mays
  misc_feature (2103)..(2103): n is a, c, g, or t
  misc_feature (2140)..(2142): n is a, c, g, or t
cattgggtacctcgaggccggccgggactgccgtcccccgcggccgcccggcctcctcggtgtcttccccagtccccactccaccccgccgcagggctgggatggtctgtcgtcttgtcgcgtccgtgatccgtcccttggcctctcgcagcggacagcggccctccgccccctccaaatagcaccgaaacccctcgcgtttaaactattccctgatccaacccctcctcaaactctgacgatgcctccttccgtccgtcctctataagggcgccgccgaggagagagaacgatgacttcagctctccggcggaaggcggcgcagatggcttccgcggcgacacagtgcttcagctactcctcgttgccggccacgtgggctctgcggcagcggggcggcggtgccagcgtgctccggctctcttcccggcggaccttctcggtctccgcggcggccgggttcgacaaccagaaccgcgagtatgtgatcgtcgggggagggaacgctgcgggttacgccgccaggacgttcgtggagcatggcatggctgacggccgcctttgcatcgtctccaaggagccagttccaccatacgagcggccagccttgaccaaaggctatctttttcctccggacaagaaaccggctcgcctacctggtttccatacatgcgttggatctggtggacagcgacagactgctgaatggtacaaggagaatggtatagaggtgctgtatgaggatccagttgtagcatttgatggcaaaacgcaaaccttaaagacttcatcggggaaagttctgaaatacggctcacttattatttctactggatgtgaagcatcgagattacctgagaaaattggagggaaattacctggagttcactacatacgggatgttgctgatgctgatgctctagtatcctcattgggaagtgcaaagaaggtggtggttattggtgggggctatattggcatggaggtagctgcagcagcttgtggctggaatcttgacacaactattatattcccagaggaccacattatgccaagattatttacaccctcgcttgctaagaagtatgaggaactgtatcagcaaaatggtgtcaaattcataaagggagctcttatcgaaaaacttggagctggctctgatggaagggtgtcttctgcagtacttaaggatggatctgtagttgaagctgatacagtaattgttggtataggagcaaaaccagttgtcagcccgtttgaagctgttggagttaaccctaaagttggtggaatagaggttgattccttgttcagaactagtgtacctggcatctttgcaattggagatgtagcagcgttccccctgaagatgtacaatagaattgctcgagtggaacatgtggatcatgctcggaagtctgcgcaccactgtgtagagacgctcctaacatcccagacaaaagcgtatgactaccttccatacttctactcgagggtttttgagtacgagggaagttcgaggaaagtctggtggcagttttatggcgacaatgtcggcgaagcagtcgaagtagggaactttgatccaaaggttgcgactttctggatcgactctgatagccggctgaagggtgttttcctcgagagtggaacctcagaggaattctcgcttcttccgcagctcgccaaatctcagcctgttgttgacaagtcaaagctccaggccgcgacttctgttgaagatgcattagagattgcaagaagctcactccggtccagtgccatggtttagctctcagaatctagtactttcttgaacccgaggctgtgcgctgctcgagcggttcatagcgtcgagaccacgtcagcaataacgcacaattacatagaatctattcccactggggttgtaacattcttcagtgcacctgcgtcggctatttccagcttgaaataaacctggttgccctttgaggggttgatgaggatgatagattgaagcctttatgctacttttttcttgatggtcttctgatcactcatgcattcatgtttactgctcgacatatagttcgttgaacagtcgctcctttccccaattantacaacacgtgttttcccctaaaaaaaaaaaaaattnnng

SEQ ID NO: 24616 - DNA, 1642 bp, Zea mays
ttaatcgtggaccgtgggagctatcccgcaaccacacgtcgaggacgtggaccttatggtttacatggtcgaatcttccggccggccgtacatactaaatatagcggtcaacaatataattaagaacgaagtagtaaattgtattcatggtcatggtgttcaaccaggaggcaagccgctcgcagccacgtgcgcggagcagttcgatgtgaagcacgacgtacctgcacgtccccacctcaccgccaccgcggcaccgcgccacatgcctcagacacgacgtcacgtcgtgcacttgcggcgggcgccgtcgacaggctgggtggacgtgctcccacctctcgtcgccacagctttttcacgtgtttttcgtgccgacgacccatacactcctcggatgcgtgttctctttcttcaatcaactcccagctatattcgagccagccccctcggccttcccccagaaacccaagcaaccaacgtccaaggcaaaaacaaatttccatcaaccctcctcctcctccattctccagaacagcagcagccagcaggtcatcgccagtgatggcggcggcggcaccttctggaggcacaggaaagaacacagctgcgactgcgacgacaccgagccggttcgcggcggcgtgcggcgcgctgagccagtacgtcaaggcggcggaggccgagaggacgcgcgcgcggccgccggtgcgccggcccctgccgctcatgccgggcgccgacgtcgaccaggacgagccggaaacggcggcgcagctgatcatcgtgtacggagggcgggcgctggtgctcgacgacgtcgcggcggacaaggcggcggacctgctgcgcctcgccgcggcggcggcggcgcgaggaggcacagagcagccgctctgctcgctcgccgacctacccgtggcccggaaggcgtcgctgcagcggttcatggagaagcgcaaggacagggtcgccgcccgcgcggagccgtaccgccggcgccgacccgtcggtgaccgacgcaacgatctcgcgctcgagctgtgatttgaggatgtctcggcggtaactactagaggacgctgtgctcaagaagcagccgaacgatctctgatgcttcgtacagtcagatcatattaatttgttataactagataggtatagctggattgttcttatgtgttgtgcagcaaaacagaagaaaaaacttggagatgaaaagacatggtttcgcattaaaaaaaaaacaccactaaaaatggttctttttatttgtcttgagattctgtgacaaagagatatctataataacgtagtcttgagatttgcagttttaagctacctacaatcctaaactcttagactataaatacaattaaaagatgatttgtatgaaaagtcgtaaggagtcggtctcatattttttcatctaacccatagaaattcctcaacagatcttatattaaatagagttatatatatgtccttataggttaaaggagtaggatgaggttagagagatgagtgtgtgttaatggcggtaggtgtacatgataagaaaaagagggctaaacaaaatcctgcaccatttacatggtgtatacgaccataagtgtacggtgacaaataccatgcttctgca

SEQ ID NO: 24617 - DNA, 869 bp, Zea mays
  misc_feature (858)..(860): n is a, c, g, or t
  misc_feature (863)..(865): n is a, c, g, or t
ccgggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcgggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgtttggatggcagcgtggccatcagcagcatgcagtcgtcgtcgtagcagagatgtcctagctacgtgtgtgtcatcaggctggcacataataaagaagtagatcatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtccaatataaaaaagcctaaaccnnnccnnnaaaa

SEQ ID NO: 24618 - DNA, 942 bp, Zea mays
ctcgaggccggccgggatacacccctcctcgagcccggccggggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccattaaaaaaaaaaaaaaaaaggccccccaaaaaactgccctgcgccgctcccactgct

SEQ ID NO: 24619 - DNA, 983 bp, Zea mays
gttcagactccagacctcaagtgcgatggccgacttgtcacacccattaaccaatctgaggctcccatccatcgagcagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatcccctccaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccaccccactagtgatcacttcgtctagtgtccctcccgtcgtcgtcgtcgtgtacctcgtacgtgacatgccgtagcacgtactacgctagcagagcagcacctcaatgtccttgggcttgctttgctggctctctgttttcgtctctcgtgttgcttttaatctggtacaggtttctaaattataataatgaatagttttttgtccaaaaaaaaaaaaaaaaaaaccgccgaggggggaaaaaaaaaaaaaaaaaaaaaaaaaaaaaaaaaaaaaaaaaaaaaaaaaa

SEQ ID NO: 24620 - DNA, 965 bp, Zea mays
gcccgcccggctcagagtatggcctccatcacagctagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgttgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccactagtcatcacttcgtctagtccctccgttcgctgtcgtcgtcgtcgtcgtcatcgtcgtcgtcgtgtacctcgtacgtgacatgccgtagcacgtacgctagcagagcagcacctcaatgtccttgggtttgctttgctggctctctgttttcgtcttgtgttgcttttaatctggcacaggtttctaaattataataatgaatactttttgttcattatatataaaaatacggcccctggccacatatacaaaccgccccaatattattcttacaacaaaaaaaaaaaaaaaggcccccaagggccct

SEQ ID NO: 24621 - DNA, 3819 bp, Zea mays
acccaccccacccaaccttttccaaaacccccccgcgtcccgcgacgccgcccactcggtcactcccccatctcaattctcccacccggccgccggcaccacacgcgcgctccgggagccacaacgaccgatggcgagggcgcgcctccctctcctcctcctcctcctcgtggcgttcctcgccggcacaggctccacggcggcccgacacgccgcgcccgcacccgcgtccgcgccccgggcgtcgccgtccatctccgcggcgcccgagtacggggcgccgctcccgcgcctcccgaaccagcaccagcgcccctccgcgcttgcgccgtcgcaggcgctggcgccggacataatgcccgtgctgccgtctccggccgaggacggcgccgcgccgccgcccgacgcggacgagcccaccatcccgtccagccccagcccgcccaacccggacgcgctggagcccgcgtgggcgctggcgccgttcggctccgcgcccgccgtcgccgcgcagtcccccgccgccgcgccggccccggcgtcggcgctcgtgctgctggccgtgccgtggctgctgctggtggtggtggtgtagcggttcggtctagcggcgtgcgcgacctgcctgccgtggaccacgccggcctctccacacagctgctgctcctcgtggatcatgtcatgtgcatgtctcggcggcaggcgtgcagggtgcacggaaaaaggtggtcctcgcgggttggtcggcctcggccgggctggctggctctgcagctcgccttgccgccactactctctgcgtcctcgtgaagaactgctgcttctgctgctacatctcatcagcttttacttctctatatctcctgtaaatcttagcttacttttcgggtggggttacggccggcgatttcgctatagactttttttgttttgtttttaacttttgttcagcggagattattatttgggtgattcttgcagtaaaactggacgggtggttccgtattcgtgctaaaaaaaaaatcagctacgaagcactgtgcttactaccttgcgtgaagctcgaatttggtcctcaattacatgctcccctcatacttgcctgctgctgattccataagccctatccagccaatcatggctacatcactggtagtctaggaatatatatatttttttactgctagctttctgaacatgagcattcacctggaaaagtgtgcgatgattgtttcctttctagtaccactgatcagttcatgaatgaacagaaagctctgaaaaagaaagggggcaggcacgataattcaccagaaagaactccacaccggccgaaattctatacccacgtacgtacgtaccacgctttctttgctccatcccatgattgtcagcgtaaagtctctggcattgccacttcgccaaggaattagcttccaagacatgaccagctgctgctgtgctgcgggcatgtgatctagctagcagccccctggctatggcggcgcccaacaaaagaactcgccggattaattgaagaagatgaaacgagatggacacttgtgacgtgcgctcgtgagggtgggtaggcgcgcggacaagctgctccttggtgggccgggcatccaatgataggaagaagacaccccgcgcgacgaagatgggatcgcccggccgcccatttcgtcgtcaggctacacgaccttcttcgatcacgtgcagtgtccattccatcatcgagatcagtctgacgatcgatctccacgattaccaggcaattatgcatggataaatgggacaagggtaaatctggcttggtttttagttaaccagttaccgggaggagtattagtaccaggctaccacctgtgtgtttggttgtggaacagctaggacgggatcgtcccttgacgtcctctctcgtccctccaaatttgagggacaacaggggacaacacaggatagtactgtcccaacccttgatccagaaccaaacaacctaatttgagggatcgtcccatcccatcccgtcctgtcattgcaaccaaacgcacccagctttcactgtggatgtgcgagctcgtggactggaccggagaggctgctgaatctgaatctgaagctgagctccttccacagcggtccgtccagccagcacgagcaagaagctagacgagatgagcaaccctgcctgtctcgtgcgtcgtgagctgtctgcctgccagtgtcagctacgagccatgagaagattctcctgctcctgcttctgccttctgcgctctgctccagggtagggtaggctgtcggaggaggaagacgccaacggattaagtaggcagtcacgtgcccttcgtctgctaatcggggtccctcggctcaacctcctccagtcctcctattcctaaatctcacgtaacggcgcggcgacagagactgctttctcccattgatttgctttcttactccgtgtcgtgtcttgggaccgagagaatcggttcctcggctcgtggcaaagcgccaagtgagaaaaaggcaatctggcgtggagggccacctcctacacatcgcaggggccctaatttctaataaacctcaaatttaggcccaaaatccagcttattattatagtccataactggcacagccaacagttggactcccttaatccctttccatcctggtgggctgggccaaagtttccgtagcttttcttcgccggcctttcctcttctgagctgtcaattctcaacgatcacaaataaccggcctcggccttccaatgctcggcccgcgccgcagccgccgcctaagctcgacgcgccgcggcggtggatgcgacgccacacccccggccttctcgccgccaatctcctccgcgcctcgtcgctcctcagacccccgtccgtcctcgccgcccgcgcggccttgctccaccatgcgccggacgacgcccaccgcctgctcgacgaaacgccgcgcgggagggcggccgccatcgtacgtgccctcacgtccgcaccgtcttcctcctccggtgacacggcctgcatcgcgtgcctccactgcgcggccctcaagtcaggcgccgtgctggacccgccagtgcgcacgtccctgctcgcggcgtacgccagggccggccgcggcgcgggagcgggagccggagcaggcgccgccctggcgctcttccgcgaggccgttgcgcccgacgtgatcctgtggaacgcggccgtcggcgccctgacgacgagctgccggtacgacgacgccgcggctctgttccggcggatggcgcgcgagctcggggagtttgactccaccaccgtggtcgtcatgctgtcgggggcgtcccgcgcgggtaaccttcggcgtggaatggagctccatggcatggcggccaagagttgtctcggcgctcattgtctcggcgcgtggaacgctctcgttgacatgtatgcaaagtgtggtgagtttaggtccgcagaggttgtgtttcatagcatgccgtgcagggacaccacctcatggaactctgtcataagtgggagcatttttaacgggctcgctgaggtgtcagcgtgctacttcagggaaatgagttgctccatcttccagccagatgaggtgagcctctcttctgtcctctcagcctgctctcgtctggatgatctcttctcctttggggagtctgtgcatagctgtgcagtcaaactcggttatgaggacaccgcgtcttgctcagtagcgaattctctcgtgacgttctactctgagtttggaatgccagaggctgcgaagaaggtcttcgccagcaatttg

SEQ ID NO: 24622 - DNA, 1818 bp, Zea mays
caaggtattagaaagcgcatgaaaccaccattgagagcaattttgtttcatctccatctattcctatcgattatttagatgcatcatttaaatcacacgttagtctataaaattatgtcatgaaactctttatttagggcgcgtttgaatcacaacctcccagacagttgcctgccaggcatcgaatcctggctctcaggcgttcgaaatcggtggcctaggatgatgcccgggttagacagccccaacgaggactaaaccaaacatggcctcagagaacatattttattttcatttcatctcatttttattgagaggacaacattaaaagtagtgtaacgaaagtacagctaaggactagtttggaaactacatttttctatgagatttctattttttcaagggaaaatgaactaatttttctttgtaaaaatgaaaatcctttgaaaaaatatggtttctaaactagtcctaagaataaacttatggataggataattcctcccaacaaaattgacttgaatttgagtcagactccacagtccgcacgggattccttccgtggcggacggacagttggtttttcctttttcatgcgctctccaacttcccacccaaacaaccacgccgccacctcgggctcggcgccggacgcttccccgccccggcgcccatgtcgaccccgtaccacggcatccctctccgcgcgctcctcctcgcggtgcccctgatttccatcttcatcgtctttcacctcctctaccgtcccgctcccctgccctcgacgttccggacctacgccgatggggcggcgtcgcaccgtgcggaggagctgagttgccctccgctctcctccaacttaccgcccccggcgccgaagccggaggagacattggagccgacgtccctgcgccacgtagtgttcgggatcgcctcctcccggcgcacgctgccgctccggctccccctgctccggctctggctgcgcgcccccgcgcgcgccttcctcttcctcgacgcgccggcgccggcgccggacgcccgcgacctcccgccgggcctcgctctccgcgtctccgccgacgcatcccgcttcccctacacgcacccgcgcggcctttcctcggccgtccgcgtcgcgcgcatcgccggggagctcgtctccgggctcaagcagggggagggggaggatgtgcggtggctcgtgctcgccgatgacgacaccgccttcgtcctcccgaacctgctccacacgctccgcaggtacgaccaccgcgagcactggtacctcggcgcgcgctccgagtccgcggcgcagaacgcgtggcacgccttcgccatggcatacggcggcggcggcatcgccgtcaggtggccgctcgcgcgccgcctcgcgcgcgtggtcgactcctgcgtcctgaggtacccgcacctctacggcagcgacgccaggatctacgcctgcctcgccgagctcggcgtcgagctcacccacgagccaggcttccaccaggtgcctgcttcttcttcgtactctctcccatacccataccatatgctgttgttctgttctgtcatcatgaaatgttcgattacattgatatcagcagtgactaccttaaagatgaatgttttgatgctctttgagtaaaattgggtcaagagctaggggattgtctcaggaattgtctgaaaaaaatggacaacctacctcgtaatgacaatcattcctcctctgtcttcccacatattttattgtggcagagacatcgaaataatctacctgatggaggagacattaaagtattcgtggcataa

SEQ ID NO: 24623 - DNA, 2326 bp, Zea mays
ttcttttcgtttttgcgataaaatacatagtactcttttgtttgtcctacaaaaaaatgtatcggagcttgatgcgtgttttcagggacttattaaacatatcctccatagcaccttaacagatgaaacacgagccagaggcaacaggcgcttcagctttctgcaactgccgagacataacagtgaatcccagagctctatggcgccgctgtcactagaatcctcgcaactcacatctacttcctgctcgagtcccaatacgccaagcctactccaggaagccagacggctgatccggtgaccccagggatcggggcaaaatagcctagagaagatcgatttgcttctgcacaatttcactaacgaatctcattttgttggccactcttcctgccagttcatccaggaaggaacaggcacgcactgaagagagtgcaatgttcttatgatgctcgcaagctccaaattcgaagacatggactgtcgtctggatgaagttctcagcaagtggtagtgggcgggcatcttccaagaaaagtattggtggatggagctacgaattctcagggaagacggtctggatgaagttcaagaaacgctccgagtagaactgggggtccacagccgagatcgagaccgagtcatactgcatggacttgacagcgtgctcgattttctttgtcatgttgtactcttgcagtatgtcaatgatgcccaggtagaggaccacatcgtacacctcacggaacggtttgctttcatcttccttaggggtctgctctgcccttgcaggcatgttaactcctagctggatctgaagcctggctgttccaggcagcagtaggtctacttcgccaaatccagcagccgatgcacgcaagcggctgcctcttatgtgagggccaacaataacactgttctcaccactgctttgaaccaagactagtccttctggatggctaagggcatcatcttcctgagcatcttcttctgaaacaacagtcaatctatctgctgccatgctccggtgataagatgcacgtgtccgcaagtgctgtggagctctataatggacaccaagcagtaggctgtaatccattatccgctgtgttctcaaaaaatcactgtctgtttcaatctgtttaagaagagcctcacgccaggaaggttcaagataaaaggaatagttaagatccaaatccttcagagttgtgttctcgtcaatttcaattttatcagtagaacggcctaaagatgatcctttcaaatcaaacctccggtggattctcaattcagtgcaaaacatgtttcccattacaacaaaccgaaacttttgaccactagaaggtttcaccctgtggaggccaaaaaacttagttatgagggtgttctcataggtacggacatgatcataatagtttggaagcattcgtaaaagaacctgcacttcagattttcggagagtcttaatcatgaatctatcatcttgtgacaggaaaaagacacttccactctttccaggggaagatagttgcctaagagcagaatttccacatatggagatcatatagtctgcagcatcaatcttgaacatctctctcaaattcctgaaaaccatgggacagtagtctttccatttaaaatcttccgctgaatgtgaaggagtaagccgagatccttcttttgggaagttcatccagaaacttgctcttggtccaaaatctgaagcacgaacttcacgtttttgaattggtgtgatctttccaactgtgtacctgattccaagctgcaggctgagcattaaatcatagcttctgtgtcccttaattattgtctctccaggcttttttgtgtccctcaccgttttcttctggcggcgttttgtcttctttgaggagtctgaaaaactcctgtcaagaaccacctcactgattagaacaccttgcatgtattctctttccagtatgggcaaacgagaatcactcaagttttccaagctttctagaccagaactttcgctggattcatggccaataaatttttcaatagccacctcaagactccaccgtctttccaaagacacattcttcaaagaagattgctcagctgaattccttttgaacaaaacatctgaagattgcctagccataccaaccttcatgttccccatgtcaaccgaggaagagtgaagtatgcgtgaaccatgattctgccttctaatgggggggggggggcctcgatttcttagattattgatatacatctcgtcgttaacaggtactctacaacctttcggaaagaccggccggcctcgaggtacccaatg

SEQ ID NO: 24624 - DNA, 1526 bp, Zea mays
gaaaccccaaatttatagtgctactgtttttcattccttttccaatgtttcttcacccagcagcattcgcaggtacatgaagcatagaaattcaagtgttttgcactctcacatgtttcacgttacacaaaatccgtacaccgacagaaatacagactaagatcctgttccaaacctctaaaactagttggcatctaaaattacctgaaaggtttaaaacagatcagataatagaccgactaattattagctatacctctcaaatagtcattagttgtagctgtctcaacccagctaaaatcaactaacaacttattagttagctaacaattagctctagaggttttaaccggggcctaactttaggaaagaaaaaacacgctttgaaattataaataagcacaaggaatactgatagagcaaatggaaaggccaatgcttccggatgcctaattctatcccgaccatggttgatcacacaagacgatgtgtggccgccattactttgtgcataaggcacttcaccaggccagattggtaagtgggttcccttggcagtcctgaatacagctcgtagctaaatctctcagtttttcttcaacagtctccatgggaaggaaaccatcaaccaccttccatgtcgaatcacggagtgaatggtaatgctctgcaactttcttttggaactctatcttttcatatcgctcacccccatagcctcctctttcagccgctttctctggctgtacatcaagatatattacaaggtctggagcaataagtccattttctggagccttgcaccactcaatgtcaaggcccttagcagctgaaaaggccactcccgaataggagtaacggtctacaatgagagtagttccactaagtagcttgctctccatcaaagctcttttctcccagcggttggcgctgaagagcagatgaatcgtcctgtcatcaagctgcgaatcgttcgcgaggtaggaagagatcatctgccccacactggtggccctatcggggaacctccatccttcggcattgtagcctttgcctttgaggaaggacagcagccgggcacactgcgaagttttcccgctccggtccaggccttccaggaccaccagagcgccacggccgcccttgctgccccccgtctccattctcacgccctggaacgccctccggcgctgcacggacaagccgacaggagggggtgccgccgccgccgctatgccgaccctgctccgcgaagctgctcttccggcgagccgaaccaatgcagtcatgcacggctgggtacaccggtttgatcaggctgaaaacctgagagctgatacgaggatacgcgggagggcgagcagtagcggcgaggagtgaagaggtcgagatctcaggcggggcgggagacctggatcgcggcggcagcggcggcggcggtagtttcgggaggggagtggggttcctagttttcagagagagtgagtcgtgagtcgggtcaggaaaagcgcatatctcccggccgg

SEQ ID NO: 24625 - DNA, 1487 bp, Zea mays
ttttttttttttttttgcaatttaagtgttttgcactctcacatgtttcacgttacacaaaatccgtacaccggcagacagactaggtcctgttccaaacctctaaaactaatagttggcatctaaaattaactgaaaggttttaaacggatcagatcagataatagactgactaattgttagctatacctctcaaatagtcattagttgtagctgtctcaacccagctaaaaccaactaacaacttattagttagctaacaattagctctagaggttttaaccggggcctaactttaggaaagaaaaaacacgctttgaaattataaataagcacaaggaatactgatagagcaaatggaaaggccaatgcttccggatgcctaattctatcccgaccatggttgatcacacaagacgatgtgtggccgccattactttgtgcataaggcacttcaccaggccagattggtaagtgggttcccttggcagtcctgaatacagctcgtagctaaatctctcagtctttcttcaacagtctccatgggaaggaaaccatcaaccaccttccatgtcgaatcacagagtgaatggtaatgctctgcaactttcttttggaactctatcttttcatatcgctcatccccatagcctcctctttcagccgctttctctggctgtacatcaagatatattacaaggtctggagcaataagtccattttctggagccttgcaccactcaatgtcaaggcccttagcagctgaaaaggccactcccgaataggagtagcggtctacaatgagagtagttccactaagtagcttgctctccatcaaagctcttttctcccagcggttggcgctgaagagcagatgaatcgtcctgtcatcaagctgcgaatcgttcgcgaggtaggaagagatcatctgccccacactggtggccctatcggggaaactccatccttcggcattgtagcctttgcctttgaggaaggacagcagccgggcacactgcgaagttttcccgctccggtccaggccttccaggaccaccagagcgccacggccgcccttgcttccccccgtctccattctcacgccctggaacgccctccggcgctgcacggacaagccgacaggagggggtgccgccgccgccgctatgccgaccctgctccgcgaagctgctcttccggcgagccgaaccaatgcagtcatgcacggctggttacaccggtttgatcaggctgaaaacctgagagctgagacgaggatacgcgggagggcgagcagcggcggcgaggagtgaagaggtcgagagctcaggcgaagcgggagacctggatcgcggcggcagcggcagcggcggcggcggtagtttcgggagggggagtggggttcctagttttcacttttcagagagagtgagtcgggtcagtagaagcgcgtgatctagaccatccataaagcatcgcatgtccgt

SEQ ID NO: 24626 - DNA, 829 bp, Zea mays
  misc_feature (814)..(814): n is a, c, g, or t
  misc_feature (819)..(819): n is a, c, g, or t
gcaatgaacggacacttttgttattcttttaagtatgtaaacatccttttttattcggtatttaatttggaatttgtctaattattcaacatttacatatatatggattttatcatattgattccgtagcaacgcacgggcatatacctagttattacataagctagcaaattaattattacgcgtgaacagtcgtcatcttcttgtatagttgtatatccttctgctagactgctacgggtgcttcttccattggcttgctgaaaagaatcctctggatccatgcgatgcgacggcacgcattcattcactcctcgatgaagcctgtcatcttgaggacgaggttccggacgtcgcggaggtctcgccctttgagcgtcctccccttgccagcgcacatggagtaggccgccgtccggccgcgcaccagcctcctccgccgcgcgacaagaacgtgcggcggcacgactgccgagccgtggttcgcagtcgtcccttttgcaccatcgccgacgtcgtcggtttcctggtcgtcgagcgtggtggcgtaataatgctccgacgacgacgacaccggccaggggcggcaccgccgcttctgccgagagatgtcgaccggcgtggctgccctgggacgatgacggaccgagcaagcaggcgccgcctcgccgccgccgtcctcgccttggctgttgccggagacgcctgccggccataggatttcggcctcctggaattcctcctccatggtacgtacgagtgaatatatatagataggatcggtggcctcgccgtcgaggacgggcaggccggnccggnagggtaccca

SEQ ID NO: 24627 - DNA, 2667 bp, Zea mays
acccgaataaaacccgacccgctgtcatccctagagaagagagggcaatcccattagaaacatagctttgttgctgctagcgttggaatagtaattgtttataagcatatatccagttatccagagaagttttcctttgcgattctagctgtgctagcgttgttcgttgttcttactctggcagctagctcagcgcctcagcccatatatagatttgctcaagaaaagaaaagaaaacgagagacgttctcacgttgttctggcttcaagttttgtagtttcgttgtttctgcaatttcaccaaaggtttgatttttttccccattcagggcacagtagtcctccttttccagccgggtgaggaggtcggtattggcgcaaagaggatggtggaggcaggcgccgtggagaacgtggaggccatattcgggttccacgtcaccgtgctgctccccaccggcgtggtgggctccaggaccggcccgctgcttgccgggtgcgggttcttcgaggcggtgatcaccggggtcggcggccacgccgcctccccacacaacaccgtagaccccgtcctggcagcctccagcgtcgtgctcagcctgcagagcctcgtgtcgcgcgaggcggacccgctggactcgcaggtggtgacggtgacgaggttcctgggcggcggcgcgttcaacgtggtcccgggctccgtgacgatcggcggcacgttccggtgcttctcggccgagggcttcctgcggctgaagcggcggatcgaggaggtggtcgtggcgcagtccgcggtgcaccggtgcgcggcgtccgtggacttcagcgccggtgggagcccgctgctgcccccgaccgtgaacgccgcgccgctgcacgcgcacttcgaggccgtcgccgccgacacggtcggcgtgggcgccgtccgtggcgccatggagccctgcatgggcagcgaggacttcgcgtccttctcggcggccgtccccgcctcgcacttctacttcgtcggcatagggaacgaggcgatcggggccgtgcacgccgcgcactcgccgcacttcctcgtcgacgatggtgcgctcccgtacggcgccgcgatgcacgccaacctcgccatcgagtacttgcggaaccacgcgatagccaataggtccgttggtccccacgacgagctttagttagatctactgcagccagcctttcgcgagcagccacagcggtggcggcggcgccggcgccggcttcacgctcatggctcgtgcccaacgaagctcaagacgagctcatgcttgcgatcgtcaagcaatcacgtcgtgatccgatcattttgtggctcagggagggcgttgtaggaatgcagtgcgactgatgttgttgttcaatgcgcggggcgtaattaagctggttgagagataagaatgagatgttgcctttacaatacaagcgctcctgtccgagctctgtttcacaattagtttgggaaatgaaagatgagaccgtggactccaatgtttcacatcctcctcctttttttgttaagcaccgaaaattttaaaattagaagtactgattccgttctcgaatattgtcgcgtgctatatggccgcttgttcggttgttgttggccggttggttggtgtaggttggaagggacatcttttgtatagttcatcagagaagaaacattacacaagaaattccagagaaaaaatcattaatatgcataatggttggaagggacgtgactctgattctgaaacaaatacctactgcggctgaggaactgccgatatagaatatctgaatcggtaaagatacatcatcataattcatacatgcgatgcagctagcgtaggaagaaacatgctaggactagtactagtacatacaaagtaggaacgggacaaactcgccgtggcctggagcactcagtggcgcaggctgccgaagaggagcgccacggcggggcagaggacggcggcgacgacggaggacgagacggcggcggccccagacgtggggctgggcgcgggcgcgtcggcggccatcgcgacccccgcgagggcggacgcggcgagcgcggcggcggcgacggtgcggaaggccttggatgccatttccttacggtacagtttgcaggcttgtaccgtgcaccgtagaaagggagatgccgaggagggatctgggattctgggttgtactggtgcagtggtgtttttcgattaggatgttctaggtaatggtctcgtgctcagagatgaacggcgcctgctatttatagctgacgaacgccaaaggctggaagcggagccaccgcgttcacagactggctgccctggcgtgccatgcctgcctggtgcttgcctccgagacagctcacgatcgacggctggttggccgacgcggtgcctgcgagcctggcgtatagctgcatgtccagtgttcatcgatgagacgatgacatgagagccccttgtattccgcaacgtaggtgcaagcactgcgcatgactagtttctttgcacagtactccttgctgatgcatttgatgccgccacagtatagcaatacagaacctgccggccgatgggcaacttgctgtcatggtttgtggcgtacctgttcctcgaacctgccgtacctgttcctcgaatgccaattgcc

SEQ ID NO: 24628 - DNA, 4687 bp, Zea mays
tttatggcgtgctgttcatattgtttttaggatcccctcacctacaagctatgttcatttattcaatagttggttaaaacatggggtcacaaaagtaattctatgttattaaccagagcgagttctctttgttgggtaatttggcacacagggaatgactctatacttaacaagaggaaaccaaaatcctacttgtaggttgtattcaaagagaacacgttactagtatgtgctcggttgcagcacatagatgagcaaagggagctgttagttcaacattgccagcatctagaatcacgagcaaaggattttttgcttcacgtggatgcccttttgtgtttcttcgtctaagatgaatcttgttttgtcattgacttttatggttgtaataaacgtggtctgagaccattactctgaaaataccggaagtcggaacattttccattatctagaaaaaaaatacataaaaaaaataacatatctttttttcgagacgctacgaatatcttaaaaagctaaaacattttataatttagaacggaataaaatataaaacgtagaaagaagcggagtgaataattgttttagacctcacaaaccgcctttgtgtttgcttcttttttcttttcactggtaaggaactcgcgagttcgcgtattttcatttcctttgcaatttcatgttacagtgtagggtatgtacacgtattgacgcctaacctctgcttggctggacaacaatcgccacaatcttccacagagttcatcctgcctgttgtgaacaaaaacagcatacaataggcacagatggatagatcgtcctaaaagaaacagaagggagagaaaaagaaaaagaaaaccggagtggtcttccctgtcgccgcgcttggaatggcctggatgcattgttggcgttacggtgaccattggtcaggtagagccaagaagtacttggacatggccttcctgaacctcttcttgtactggtcaggagatataatggtcggcagaacatccttggagccaccaagaaatcctgtcgccttcacccaagtctctagttgtttgtcccaagtgtattgccgaagatagtcgataatccccatcacaagctctttcctttcttcatcaatgccgactaggagagagtagtccatcacatccaccgatgccagaaaagaagtatcattccagacagctcgttctagccttctttttgctttgcttccaagaaaaatgggctttgtgtgaagtgtctctaacagattaagatccaagagaaccttgttgttccctgaagtatcagggttgtagcgggaacgcaaagaaccctttaggtcatatattcttgatacctttctcttgaaaaataggttttccatgaccattacatccatcttcagctctttcccatctctcaaattcttggcagtgatctgataaagaccaaggactttagtgaggcaagttgggcttccagatgatacagagtctatcaaatatttgaaataatcagcagcataatcctcaaatgaatctaattctgtccgggtcacttgctttatcacaaatctgtcatctagtgttttggcaaagtagacattactcttgccaccttgagcactccatcgcttgcagcgacttaaggagcggatatagtctagttcatctggacagcactttctcctgattgcatcaaactgctttgcaaaataacatgtcacagaaaattttgctttatcaacggaatttgagtcttcatcctcaaaagaaatagtgaaatggttatacttagaatcatttctagttataggttgaggctgatcagaaccataattcaataaattagattcattattctgatacagaagtggcaacaagaagctgtgatattctggaacagtcatggcatgggctatcatgctagatggttcatcatcataaattggaacaataacacctgaatcattttgtgacagcagcaaccgactctcgccatgaatcataccaggaagtgagagcttgttcaagaatgttggtgacagacccttaccagttctctcaatagcctttgggggcctttgagaataagatcttcttatactagcatttgaatcatcaacatttctggaacttatagcagaatcaaacgatttgattctaatgggtgctataaccttctggtatgcaggattatccttcagactagcaggtatgaatgaaactgcctccatgctacttgatgaatcgttaacaagctgaccagaaccagtccatgctaagtcaattctatcagaaagattggaggcagaagattgtgatttctgcaaagtctttccagcttctagttcagccagcactccttcactctgcatttcatacgagcctggggcaaagctgataacagttgagacagaatgcatggatgcatcacccataatgttggtttccaataccaaatgtgaaatgctagtgttggtttgttctgtcataggggatgatttcactgaaactgcagccacttcccacatacttggttgattctgttctagagaactctcagcattcaaatgtttaccagatgtcacatcctttgattgttctaatgagctttcagtaagcttctcagaaaattgtgcatcatttggcatagtacgacagttttctttcgtgagggagtgcatcatgtacagtctgcgatcccatacgtgaatatcacgtccaagctctctcctcaggagatggagctctagaacacccatatacggttcaaatgtctgcaagttatctacgatagaaaacgctgatacaacctgaaaaagtaaagaacaatgttctggtctgtaaccatattttcgctagcaatctacaagagaagtagaaaactaggtacagttcaatagcaatctataaaaaaagtagcatttaaacttacgtcatacttcttccactcaactttaaccaactccttaagatcagccacatgtttatgcaagcctgacttcataccaatgttctggtctttaactatcttttcgatgcagtcaagtttagcaacgatttccctatacagatgttccttcctagcgcatacctgcaagttaagtcataaaagattacctagggcaatacatctcccaaaatgatggcaatgggttggcttttagagccaaattagacaagcttagataaaactaacataaacatacatcaacagcttctttgatgacccaatcttgagcttttggacaagcaaagtccagtactgaggatggcaagttgacagaaagaatgtctactggtgaataacggaagacagcaaccatgctcccaagcctgtttgattgagaacgctaactgttaggttggtcattattagataagaaactgaatagtatacaataagaagcaacaaacccatagaaacgaaggcagtccctttggagggagtgtccacagcaggcaattcgattggctgttgtgtgatttgaaaaactaagttccagaaacttcccaaaagataatccacgtgctgcatctgacatgactatcctttgtgtggctggaggaattccatcttttggtttgcacctgagacacctgtgccacatccataccttcccatcaagctccccgggtagcttcacagatggaagagttttgacactgattgtgagactgccttgttgatgagtgtaacatcgcacatgagattctgcaggctccttgcaggattcacagcatgatgtctgaaaatatagtggatgaaaaataataaggtactataaagcctatataatagttaactagcagattatggatgacaacacaagtacctgaacaaataaatcttcacgaaaataccttccaagcggcttatcaaaagtaccatagaactttatacgaaatagctgagactgcttacataccattcctctcagagggcatgccattgacaaggaaaccaaaatgctctgtggactgtcagatgttgggaaatattcattgtgattaccgttgtgatcatgtattgctacagaatcttcatctgagatatgattccaaccattatccaagtcaaggaagtcattatcaacctttgacattccaccacccgcttcatctatgtgaacattattggaaaaaaacaaatttcctggtgtactttttctcgcactggcaagtgaacttttaggtgtctgaacagtcatgcatacaggtggcatacatctaccatacattgaagcttctgtggaataagggtatacatcaatggttccaccagtatattcttcccaacttaagtcagatcttgaatgacagtgtgcatgttcctcatgaattatgccatctcttgaatgagattgatttgcagagccattaaggcaaggtgtgatgcatccagctccataagtttccccttcaatggtttgaaattcattcaaattctgctgatagtatcttgaggaagaattcggcttctcaagttgaaggtctgaagggacttttggaagtgtcgcaccctcgtcagcaagatatgaggtttcaagtgacaggtggtatgctgcaaataaagccggccgcgcggccggtttgactttctttaactcttcatatgattttcctcttagaagaacctaggaaaagcatgccatttttatcagatatgacatgatcacagtataaac

SEQ ID NO: 24629 - DNA, 1874 bp, Zea mays
ggtacccttcgtagccggccgggatccgttgcgtctaataatacggccaggaggggaggttcggcctgggacgctaccgcccggggtgagccgtcctcaccagtcaccgcagaagccacagaggggcagccgcctgcgcggtggccagcatcgtccggccgggttcgtcgggaagcgacccaaccccacgcccgcttccaacctcgttctgaccgacggcgaccgccgtgccgcgccaccgctatacttacatctgctccatcatccctcgcccgccgcgaccaccaacctcggcagggaaatccaactccggtttctcctcctcgcagcgtctctcccgcagtcggggagatccgggttggcccgcccggtaatccatccctcgccctcgtgccgcctgtaatttcgcctcctaacccgaccgccgggggccacagcggcgccggaggcggtggagtggggacgatggggatcggggcggtgtcggacgagttgctgggcacgttcgtgccgatcgccgtgtactggctctactcagggctctacgtcgcgctggatggggtggggcggctcgacggataccggctgcacaccagggaggaggccgctacgaagaacgtcgtctccaaggccgccgtcgtcagaggcgttctcgtccagcaggtcttccaggtcgccgtctcgctcaccctctttgcggttattggtgatgagagtagtactggacagaagcaacctcctgttcttgtcatagtgttgcagtttataactgcaatggttgttatggacacatggcagtacttcatgcacagatacatgcacattaacaagtttctgtataaacacatccattctaagcaccatactcttgtagtcccttattcctttggagctctatacaaccatcctcttgagggccttattttggacaccattggtggtgcactctcattcctcgtctctggtatgactccacggacatccatattctttttctcctttgcaaccatcaaaactgtggatgatcattgtgggctgtggcttcctggtaatatcctccaggcgctgttcagcaataacagtgcttatcatgacattcaccatcagctctatggaaacaagtacaacttttcacaacccttctttgtgatgtgggacaagattctcggaacttacatgccctactctattgaacaacgaaaaggaggggggatcgaatcaaaaccagctaaactcgactgagctgaggataccaagactgattagtacatgcatgcatagtttctatttttttttttttgacttgtccaatactcatgccttgtggtactgctgactgcgcaaatgatgtacacaccctgtgtcataacttcatatagtgaggctgcttttgctctctacatttcttgttttgttttttagggtgttctatcttgtaacaagatacagtgagtaaagtattgtaatgtaccaaagaatactcaacaccacttggatttgtgttctgttgaaaaaaaaaaaaaaaaatccgtcattttgttcggaagttgatattggcaatggccctctactcgtgcgtcctgttgttaaacaaagaaagttgatattggcacatggcacttcatatagcctttgctcattccttctttacttgtggtacaattaatagttgatttgctcattaacctacaaattattgagttctattggtttgctttaatttggtcatctgaagttcttgtcaggttacatcgcttggttcgctttaatttagtcttctgaagttttttttatcaggttatatcgcggccggaagtttgatacacactgaattttccattaaaagcaacagataagaattttgtgggggcaat

SEQ ID NO: 24630 - DNA, 1112 bp, Zea mays
  misc_feature (354)..(354): n is a, c, g, or t
gacctgccatcgtcccccatctgaattcattatctcccgtatttttttcccttctacagagagtcgaagccagaacataaaatactaatgtggcattgtggcccttgtaaccactaagctacacgctcttttggatcagagcggtagttttataccttaggggctagtttggaaacctcattttcccaagggtttttcattttcccaagggaaattagttcattttcccttgggaattagaaatcccatggaaaaatggggatgccaaactagccctagatttagtttgtcccacatcaaacaatttatatacaacagttcctcactccgcctgagaaccatgagcacatttcnacatccagcaacttctgtctcgtcgttctcgttttattgcttcgtaagaatccataacctctttgaattttgcctcagcaacctctttattattttggttttggtctggatgatactccattgcttttctcctgaaagcattcttgatttcagcatctgaaaatggctctgaccttgacctgtcaaggcccaaaacagaatagtggtgtgacatagtgtaagtcatggcttccctggtcattgccctgaaatttgtcctttgattggcataaaatgcttctgcgttccagtaccagtcatctctttgatgatgctgataatagttgggattatggctatcccaatttcgataatcccgacatttacttctctcctttttaaatacatcttgcatgtgccgtatgcgttccactctttccctttgatcctcggtcctgtcacgcatcctctggtgatatcgttcccaggcttcaccgcaccgatgacgatttggtcgacgaggtatgtcttcccagaaaacatatggttccgacctactaagttgagtgtagaaccagctgaccgtccggcgcagttgtccgacggcggcggtggtggcggtagcgccaacgagagcgaagaagatgatggcggaggggaaggcgcccgagtcctcctccgccgcgggcgtcccggatcgccacgggctcgcctggtgctcgccttcgcggcggccggccatggctcgccgagcaggtggctgtccgaattgggcgcgg

SEQ ID NO: 24631 - DNA, 1184 bp, Zea mays
ttggcgcccctccggctcccccgggccgtcccccggcgtccttatcccccacacaagcgccgcttaccgcccgggacaggactgttggaagtccccagacggcagcgatggcggaattatcgacatcttcggatggattggtggacgaagaagcgaggcagcaggaaccaggacaaggaagtgctgaaggtagccatggtctgcaagacacaaaggagcaggacataataaagggaaaggcggctcttgtttccactgaactgctgagggaggatctggttcagagtgctgttagttttctgaaacacccgaaagtagtagcctcttcagatggacagaggcgatctttccttgtaaataaaggactcaccatggatgaaatagatgaagcatttcgacgtctacaaagcccgtcatcgaattctgcgagctcaaatatgtgcacatctcaaggggtgtttgatcattcatgcaggattactgagcaggaaattaaagtcgatagaaagtgtatggatggtttagagagggtggaacctgaagctggacctgtggcccctgtggtacctcgtcatccaaaatcatatatggagatcatggaaatgatacaaaggggtgagcggccagacgatatacaggatattaacgatgaccctccaaatcctgatcaaccaatctcagaacctcgtatggcaccgaaaccaaagccatgggaaaagcaaggtcaagggagtttggcctgtgatttgaaatcgccgccaagggaatccgacgtgctgaggtcagaagttcagcacgatggcaccaacaaggctacggagtccgccgatggcgccaaccaaacgcactcattgctgcaggtaggcgtagctgctggatctgaatctcctgcggttccagatgacgccgcttcttcgcttgagtaaccaccgcgaaaataaatgaatgacgccgtaatcagacgcgaaaacaaacgacctcattaccacaacactgttctgatatttttgggtcctcagagagccacttgagttcacaataaatgtagtacccatcactggatgatcttttttagttgctggaaccatatgatatgagcattcttcaccaaaaaaaaaaaaaaggacggcccccttcttagaggatccaagcttacgtaaccaaaaaaaaaaaaaaagggcggc

SEQ ID NO: 24632 - DNA, 1099 bp, Zea mays
gagaggttcgtcttcctcctcctgtcctccgtgcaggactggttggaagtccccagacggcagcgatggcggaattatcgacatcatcggatggattggtggacgaagaagcgaggcagcaggaaccaggacaaggaagcgcctgaaggtagccatggtctgcaagacacaaaggagcaggacataagaaagggaaaggcggctcttgtttccactgaactgctgagggaggatctggttcagagtgctgttagttttctgaaacacccgaaagtagtagcctcttcagatggacagaggcgttctttccttgtaaataaaggactcaccatggatgaaatagatgaagcatttcgacgtctacaaagcccgtcatcgaattctgcgagctcaaatatgtgcacatctcaagggatgtttgatcattcatgcaggattactgagcaggaaattgaagtcgatagaaagtgtatggatggtttagagagggtggaacctgaagctggacctgtggcccctgtggtacctcgtcatccaaaatcatatatggagatcatggaaatgatacaaaggggtgagcgcccagacgatatacaggatattaacgatgaccctccaaatcctgatcaaccaatctcagaacctcgtatggcaccgaaaccaaagccatgggaaaagcaaggtcaagggagtttggcctgtgatttgaaatcgctgccaagggaatccgacgtgctgaggtcagaagttcagcacgacgacggcaccaaccaggttacggagtccgccgatggcgccaaccaagcggactcattgctgcaggcaggcgtagctgctggatctgaatctcctggggttccagatgacgccgcttcttcgcttgagtaaccaccgcgaaaataaatgaatgacgccgtaatcagacgcgaaaacaaacgacctcattaccacaacactgttctgatatttttgggtcctgagagagccacttgagttcacaataaatgtagtacccatcactggatgatcttttttagttccggaaccatatgatatgagcattcatcaaaaaaaaaaaaaaaaaagtcgacgcggccgc

SEQ ID NO: 24633 - DNA, 1401 bp, Zea mays
  misc_feature (4)..(5): n is a, c, g, or t
  misc_feature (9)..(9): n is a, c, g, or t
tttnntttntttttttttttttttttttttttttttttttttttttttttttttttttggttaatgcaacagttttacccaattttctgcctgacatcaacagattcacatacgagcgtaccgaaagtctagctagaaatagcagtgttaagcaaggcacagcacagacacaactccagcagattcacatacataaaggcacccagcgatgcttcaacctgcttcttctcagacatctatctcaagacggccacggcctactacactacggtctggaattcttcgtagattgcagcatgaggtacctgcaagtgtagaacccagcagcataccatgaatttaagagagcagcaagatcactgtcaagatttgggttcatgcccatatttgtgctttcctcctttccagtatcagatttgcttccttgggtgctaggctgtccagatatcgtacttctcataaaattaaaggcagcttcagcagtcatcattgcagccttatcaacttgatcatcattgctagataccatcgttggggcctgcatgaagtttgaaacactagggtatgcagtagttgcgcctgggcattgatcacaagtcaatgatacactgcagccagcagtaggtggcgtacaagcagagcctccacttggttggcctgctgaacagcaggagacagataccaggggaacgttccaattgcagcatgaggattgagtggtggaagagtaaggatctggtactgtggcactatagacaggaacttgctgctgttgggtcgtagaagcatatcctgatgcttgataattcgaatagtttgtttgttggagttgctcaagaatgttccgactcttctcctcaagttcatagtattgtctcagcaattcattgtactgcccagtttgctggcttgagctccaatttccaccagcattagtagaagcatctgtggagacgggcgtcttagcctctgaaacatgtgtctctttgcctggatcagtttcttgaagaggagcatgctcaactgtctgtctgccttcatagggctgttgttgtaactctgacagatcacagtgtgtgctgtcacagttggcatcttcctctccgcacccatccgctgctccagcagtaattggctcctcttctgcagtagcagcagcaagttcggtcttcccatcctcgcttggcgttgctcgcttgctcttgcaatgcatttctttcatgctgaacatggcgcggtcgaaggcgtccaccagcgcggagtcgtcccacagttcgccgcccttgcccatccccgaaccacgccgccgagctgtctcgccctcgcggagcctgcgacttctcttccttctcttggaacggaaaggcgcattcacgaatcccggcctcgaggtacccaatg

SEQ ID NO: 24634 - DNA, 970 bp, Zea mays
  misc_feature (7)..(7): n is a, c, g, or t
  misc_feature (13)..(18): n is a, c, g, or t
  misc_feature (21)..(21): n is a, c, g, or t
  misc_feature (85)..(85): n is a, c, g, or t
  misc_feature (88)..(88): n is a, c, g, or t
ccttaantccctnnnnnnttnttccccccatcaccccctcatcctcccccccactccccccccctccccctccccccactatttntcncgcctccccgataggtcaatgcgacagtttacacatttatacgcaatttttctgcctggcatcaacagattcacattcgagcaataccgaaagtctagtgtagcttaaaatagcagtgacaagcagcaagcagacagtagacaaactccagcagaatattcgtacttgaaggcacacacgcgcacccagtgatttgctttttttttccccagacatctaaaactcaagacggccaaagcactctacggtctggaatttctcgtagattgcagcgtgaggtacctgcaagtgtagaacccagcagcataccatgaatttaagagagcagcaagatcactatcaagattcaggtttgtgcccatatcagtgctttcctccttcccagtatcagattcatttctttgggcgccaggctgtccagatatcgtacttctcataaaattgaaggcaccttcagcagtcttcattgcagccttagcaacttgatcatcattgatagatacatttgttgggacctgcatgaagtttgaaacgctagggtatgcactgcttgcatctgggcattgatccccaagtcaatgttgcgctgccgccaccagtaggcgcgccatataagcaagaacctccaccttggctggccagtttgaaccgcagcatacggaataccagggcgaactttccaaattgccagtatgattgattgaaggggcggaaaaaactgaagggtcccggcgcttcgggccccctattaaacaggcaacttttgcccgctgctcgcgcctcgcaacaaaccacaaaccctgggccgccctcgcataacatcccccacaaaatctcttgctctctgctccgaaaatatggcctctccagcaaaacgggacc

SEQ ID NO: 24635 - DNA, 2483 bp, Zea mays
atcgatcgatcattctcaagccatttgaattaataaactggcttgattctaaattcgcctggttttattgatttatcaggattaatcgcatattggtcccactgttttttcggacataccgggcagtgcatgcagcagacctggctagctcgctttggccatccagtttctatagatggccaataagcacgagccccgcgagtccggcacgaagctcgctgtttggacctggtccgagtccggcatggcccgggcacgaacaagcgggcagactcggacaggaaactaggcacggtgggctagtccagcacggctcgtttacctctaagtccattaaatccgtttttttacactaaaacgtgcttaccagcccgcataatccgtttttcggtccgcttttttcgtactaaacgatcagtttctgagttccaccaatcaggcaatcacgccttagctggcacgcttcaccttttatccaccccgtcgcagggccggccgggaaaacggccaaaccactcccctcttccccagttccccttgtcgtttgcgcaggggaaaaggagcgccgcagaccgagggacggcgacgaggtatccaatggccgaccctgacgtgatcgaagtgaccttcggcaacgacgtgattaacaccaccgtcacatcctccggccaggctgtggagcgctggatcgcggagatcctcgcgttgcaccgccccggcagcaacggctacagcatcatcgtcgggcttgacgttgagtggcgcccaagcttcggcccgcaccagaacccggtggccacactgcagctctgcgtcggacacagctgcctcatcttccagctcctctacgccgactacgtccccggcgcgctggcggagttcctcggcgaccgcgggatccgcttcgtcggcgtcggcgtggaggcggacgcggagcggctcagcgacgaccacggtctggtggtggccaacgcggaggacctgcggggccgcgccgcggagcggatgaaccgcccggacctccgccaggcggggctgcgtgcgctcgtgcaagtcgtcatgggcgtcaacctcgtgaagccgcagagggtcaccatgagccgctgggacgcgtcctgcctcagctacgagcagatcaagtacgcctgcatcgacgccttcgtctctttcgaggtcgcccgcaggctgcttggcggcgcgtactgatcgacgcggtgaggtgctgtgttgtttaatccttactctatcctgtcttagtttgttgtactttgccgtggactcccgttgcttaatccttagcctatcctatcttagttcgttgcgctttgcttccagacaatttgtgctagtgtgctcagacttcagatttggttgttgctgcatttcgggctacaaggttgtaggggtttctgtgatcgaggagaattattcagacagtcatgtactgcgttcctggtttgtcgctgcttttggcgtacagagtcgcattgagcatttgagatcatgcttgtgatttggggcttttgtgtcgatcgaggctggacagccttaaaccttttgctgattactgagttgccttaaaccttgctgaccagttgtttttcattttaccatcgctactagctactgtatcagtttatctctcttcgttttcgtttccgattatttccaactcggtcggaaactagttttcccgtatgtttccattaattttcattcctgaataaccgataatgttgagccggcacagcaggccactccttcccccaaacgcacgcgatgcaccggtctgtggggatcatggggatttgaggggatcgaggaggaaatgaactaagtttcctctcaatcctctccaattttctcatgatctttggtcactaaattagcccttaaagtgggaaaatcgttactcaccggtttactgccggtgaaaaccgataaaaaacaactggtttaacaatccaatcaatttgaatttgtaccgatttaacagcgaaaaagcggtaaaccgttggttttccatgaaacgaatcggtattcgttgtttttacagaaaaaatggaaaattttgacagtatttatttgtaatttactcaattcacattgtactgtaaatattaattgatccacacgacatatgttcaccaaaataacatacaacatacatatacaaccacaaacaacggttttcacacaacaaacaaccaacgaacttcgcaatactcaaatacaagttcttttacaactctccaacgaggcaacaacacataggtcgacttatttcacaatactcacatgttcagctcgagtcatagtgatagtactcaggcatgttggaaggttcgtgctattattttaatccgtcatagtgatagtgataggtctatacaaaagatattgcatgtgcacctcaccaagtgttgaactatcactatgaccctaaaccctaaacatacatatgaagccacaaacacttccat

SEQ ID NO: 24636 - DNA, 2426 bp, Zea mays
  misc_feature (35)..(35): n is a, c, g, or t
  misc_feature (171)..(171): n is a, c, g, or t
  misc_feature (2412)..(2412): n is a, c, g, or t
  misc_feature (2418)..(2418): n is a, c, g, or t
gcatggctcactctcagctgctgaactgtttttgngctcagttataatcgaccatccatgtgggtgtaatacctctcaaatgtgtagcttaaatgcttctttcctattcatatcctcttactctgtcaaagccttttccatcagtctccacaaacctgtagtaacaaagcnttgtacatgaggcaattcagcatagttggagtggcttgagcatctaacgcgatattgcccctccccgatattgaccgtccctaagataatctggctccttaatgtgagggaacacaccacctcctattcgtaccatccaaaggaacttattgatatcatcgctagggtatccaacaagtcctccaaagacaacaagcacatatttgacatctaaagaattgaagatttcccaagctgctttttctggggacgacattgctgtaccaactgttgctatatgagtgttgttccaggtgttattgtctacaatcacagttctgttggccattgcagttgtttggtaaccatagtcccaccaggaagcaaccttgtcatcaacatctgtgttatggctcagccatgcgtaagcttcacggaaatcatcaaaaacatgcaacccatctcgtgaacgagatgtcaacacaattgaaggcgcggagtacgcttcagctgccgcccatacacaatggaccacatagaaaccacctaatacgatgagcaataaaatacccataacagataattcaaaaggcagaaccaaaggcctattttcctttttaggctttacaggaacactctctgccacttctttctccttcttccggttcttctttgatgttttttcctttggagctgtttcgtgtttttcattcctattttcattttttgttgaatttgtagaactctctgggctactgtcacctgaagaagtagggctatcatcaaataattttgacagctgcaatttaatggatcgtgtgagcacactgaaaacttcagatagagcaatcccagataaaatacacgcagcaggagcaaggacaagcataagccgtaccattactccagaaaaataaactgcagtgactaagtacaagaccatgaaggagcttgcgtcagacagaggcaagaagcatgaaataatcccagcaggaatcaggaaggccaacacattaatgtccataaaatacgagggccaggtaggaggttggtgttcactgacactagcaatgatggggatgtacttgcttgcataagttgggtcaagtagactcaaactgcggccactccagcctttcgttggactagatgccaccaatgcaacaagtatggctactactgcaaaacaaacagctaagccaacagatatgacaagagtcatagcaactttgaacagcctaggagtcaaaagccctttgatataatacacaagagcaaccacgtgaaggattatgaacaccagaaatgatgcgaagtgctcagaggtcattactgcattaaaaccaaccaccggtactaatgctgccagaagcgttccaagtacaacaaggggagcatatgcaatgtagagacgcgaagaataacgaccagttacaatgcacaagaggacatgcattgggataagattgataatgaatgtgtagcctccccaagagcagaccatgtagaaatatgagagagcattgagtgttgcataaaagagtgatcccgtgttcagcgtctttacatatagataaaatgtaaatatcaaggcaaatattgctacagcttcattatcatagctgcctgcaacagatcttgaaatatatgaggggaccattgctaaaatggctgctgccattaatccagctccagtacctttcgcttcctttgttagcaggtaggtagcccatgatgcatttgctgagaaaattggagctgtgaacacacaaactgtctccaccgacaatgggatgttaagagagttcagcaaccaccacatagttccagcagtcaatgtcaacccaggatacacagtgccaccgatcacacggccaagggggtaccatgtcctatcatcaaaccagttccagaactcataaattccattcttggacagaaactgagtgacgcggaagttgaagtaggggtcgaactcgtggatcacgctctcgtacttgattacggagaagagacggatcgagaaggcaacgacgccgatgaggagaagcgtgaaggcgcagagcacgcccccgaaggcgttgcggagccgcccgccgccgccggccgctgcgggggagacctcggactccgccattgcggcctgcgtcctttggtgtgtgtgtgtgtgtgggtggaagtggaacgcgcggaaatccgagtgctggacccaggcggagacgacgacctcgcgatcgtgaacatgcggttcccggcaacggncctcgnagggtacc

SEQ ID NO: 24637 - DNA, 1251 bp, Zea mays
  misc_feature (1243)..(1243): n is a, c, g, or t
ttttttttttttttttgcactcactatcaccccagtagagaagtaccttgtaagaaaaattgtaggttacacaaaacagcaagtaacaggtagtcttaaacaacccctgtcactagaaaattatcgccgccatccaatctcaaacccatgggattgataaactcctctggtctatcaaaaatttcatcagcacccggccggttgggagaacatataacgagggtccaatacaatagtccagatctctaatctagttctgtagttttctggttcaccaacctagcgcacttgatctaccaacaaagtatcaggtaaatggcactattggtaacttcatctattgccacgggttctttcgccctgccgcaagtgtgggactagttttggcactggccttcaacttcttcagcttgcctcgaaccctgttcttctggggtttcagtttatatatgcggaccatccaatggtgggttgtaaatacctcctcaaaatgtgttagcttgaaatgcttctttcctatttcatatcctcttactctgtcaaagccttttccatcagtctccacaaacctgtagtaacaaagcttgtacatgaggcaattcagcatagttggagtggcttgagcatcaacgcgatattgaccatccctctgcagataacattgcaagataatctggctccttaatgtgagggaacacaccacctcctattcgtaccatccaaaggaacttattgatatcatcgctagggtatccaacaagtcctccaaagacaacaagcacatatttgacatctaaagaattgaagatttcccaagctgctttttctggggacgacattgctgtaccaactgttgctatatgagtgttgttccaggtgttattgtctacaatcacagttctgttggccattgcagttgtttggtaaccatagtcccaccaggaagcaaccttgtcatcaacatctgtgttatggctcagccatgcgtaagcttcacggaaatcatcaaaaacatgcaacccatctcgtgaacgagatgtcaacacaattgaaggcgcggagtacgcttcagctgccgcccatacacaatggaccacatagaaaccacctaatacgatgagcaataaaatacccataacagataattcaaaaggcagaaccaaaagcctattttcctttttaggctttacaggaacactctctgccacttctttctccttcttccggttcttctttgatgttncgattagg

SEQ ID NO: 24638 - DNA, 1056 bp, Zea mays
ggccgctttttttttttttttgtcttaaacaacccctgtcactagaaaattatcgccgccatccaatctcaaacccatgggattgataagctcctctggtctatcaaaaatttcatcagcacccggccggttgggagaacatataacgagggtccaatacaatagtccagatctctaatctagttctgtagttttctggttcaccaacctagcgcacttgatctaccaacaaagtatcaggtaaatggcactattggtaacttcacctattgccacgggttctttcgccctgccgcaagtgtgggactagttttggcactggccttcaacttcttcagcttgcctcgaaccctgttcttctggggtttcagtttatatatgcggaccatccaatggtgggttgtaaatacctcctcaaaatgtgttagcttgaaatgcttctttcctatttcatatcctcttactctgtcaaagccttttccatcagtctccacaaacctgtagtaacaaagcttgtacatgaggcaattcagcatagttggagtggcttgagcatcaacgcgatattgaccgtccctaagataatctggctccttaatgtgagggaacacaccacctcctattcgtaccatccaaaggaacttattgatatcatcgctagggtatccaacaagtcctccaaagacaacaagcacatatttgacatctaaagaattgaagatttcccaagctgctttttctggggacgacattgctgtaccaactgttgctatatgagtgttgttccaggtgttattgtctacaatcacagttctgttggccattgcagttgtttggtaaccatagtcccaccaggaagcaaccttgtcatcaacatctgtgttatggctcagccatgcgtaagcttcacggaaatcatcaaaaacatgcaacccatctcgtgaacgagatgtcaacacaattgaaggcgcggagtacgcttcagctgccgcccatacacaatggaccacatagaaaccacctaatacgatgagcaataaaatacccataacagat

SEQ ID NO: 24639 - DNA, 2568 bp, Zea mays
ggggggcacctttccggattccccgggacgtttccacgcgaccgtctcatactcatgaagaaactcgccaaatatagggactacttaagcaaacaaaaccactttttgccgcagatattgctctcctactgcaaagaaatgaggctcttcgggttgctttcatacacgaagaggaaatcatatcaacggacgcgtgggctacaacaagagagtattattccaagcttgtgaaggctgatgttcatggcaaagaccaagaaatatactgcattaaattgcctgggaaccccaagcttggtgaaggcaaacctgagaaccaaaaccatgccataatcttcactcgaggagatgcagttcagacgatcgatatgaatcaggataactacttggaggaagcaatgaaaatgagaaatttacttgaagaatttcataatgctcatggaaaacatggcatacggaagcccacaatcctaggtgtgagggagcatgtattcacggggagtgtctcttcgctggcgtcatttatgtcgaaacaggagactagttttgttactttggggcaacgtgttcttgcttacctcaaagttcgaatgcactatggacatcctgatgtttttgatcggatatttcacataacccgaggtggcattagcaaggcgtctcgagtgattaatataagcgaagatatatatgccgggttcaattcgactttgcgccaagggaacatcacacaccatgaatatatccaggtggggaaagggcgtgatgttggcttgaaccaaattgcactatttgaggggaaagttgctggaggcaatggtgagcaagttctcagccgagatgtgtaccgtctgggccagttatttgatttcttcaggatgctaaccttctttttcaccactgttggttattatgtctgcacgatgatgactgttctaactgtgtatatcttcttgtatggaagggtttatctggcactctctggccttgactactcaatatctcgccaagctaggtttttggggaacactgcactagatgcagctttgaatgctcaatttttggtccagattggtatttttacagcagtgccgatgataatgggtttcattctggagctggggctgatgaaggctgtttttagttttattacaatgcagctccagttctgttcggtgtttttcaccttttcgcttggaacaaggacacattactttggtagaacaatccttcatggcggtgcaaagtatcgtgctactggaagaggttttgttgttcggcacataaagtttgctgaaaattataggctctattctcgaagtcactttgtcaaagcgcttgaggttgctctcctcctgatcgtttacattgcatatggatacacaaaaggcggttcatcttcatttattctgattactatcagtagttggttcctcgttatgtcctggcttttcgcgccttacattttcaacccttctggtttcgagtggcaaaagactgttgaggactttgatgactggacaaactggttactttataaaggtggagttggtgtaaagggcgacaacagttgggaatcttggtgggatgaggagcaggcgcatatccagacattcagaggacgtattcttgagacaatcctcagccttagatttctcatgtttcagtatggcattgtgtacaagcttaaaattacagatcataatacttctcttgcagtttacggcttctcatggattgtactctttgttatggttcttcttttcaagctttttactgcaactcctaggaagtcgacagccttgccgacttttgttaggtttctgcagggcgtccttgctattgggataattgcaggaattgcccttcttatcgtgctcacatcattcactgttgctgatttatttgcaagtgcacttgcttttatagcaaccggctggtgtgtcttgtgtctggccgtaacatggaagagggtagtgaaagtccttgggctatgggattcagtccgtgagattgcaaggatgtacgatgcaggaatgggagccatcatctttgtgcccatcgtcgtcttctcatggttccccttcgtgtcaacattccagtcacgtttcctcttcaatcaagcgtttagtcgaggtctggagatctccctcatccttgcagggaacaaggcgaatcagcagatttgaaaggccctgccgcatccatcgtatttttctgttgtatattctgggaattactgagagctgcttagttagtttgaacaatttaatgagctcgatttgaatgacaaccttctacataattgcccctgtaatttgtacactaattatgcggagaggcagctacggcagtagagatgagctgatgtatgtcgatttgatcttaaccaaacctctctttaaggctacgacggttcagtaggcctgcactagtatgttgcacccatccaaaaaaaaaaaaaaaaaagaaaaaaaaaaaaaaaaaataccaatatttaaattctattatataaatagtttagtatataggataacccaatataaatagtataagcccagtatatag

SEQ ID NO: 24640 - DNA, 1927 bp, Zea mays
gaaaaagagtcaccatcccataatttaatctttaaatatcaagattcccaccataaaagtattcgaataaattccaaagatcaagataaataagctcccaaaaatcttgaaagaattcagcgggtaaaccatcgggaccaagagcgttgttatgttttagatcaaacaccacctttttaatctcatcgacgccaaatggatgtttttatatcatatagcaataaaaataagtgaccaacatgtatgaacgtgtgagtactttgttttgaaaagaaaaaaaggaaataagtctgatcaatgcagtcctcggcatgctcgtccgtggcacgacacgtctcggccgaaccagacaggttaccgtggctcgtgcctagtactgctccagcatctttgcgaacgccgacagattagccgttaattctggcctgaagatctgactgagaagataaagacactgcagtactgctctgcctctaaataaaaccaacacttaaattgtatcaaatcaacctttttaacaagcaaaattttaatacaaaacattgttattcacgtcaaaaaataatcatacaataaacatgtactcactccgtcccagaatagtactacatccatatttttcatttgtcgcgttttagttcaaaaataaactagccgacgacaaatattcgagaacggatgtagtattcgttttagagtgttaattaatagatttatataatatatttaatatatgtgtttgttatctatttgaataaaaatagaaagataagacgaataatattttgggatggaacgtcgatataatatttagtgccacaaataattatgtgatctgtgaattcactatgacctagatttgttctgggtttacgactctagaagttgatcgggagtactaggctactagcagtagtatactaaggaacgatcgagatggcagtagatggagtgcgcggatttgatagcgagcttggagcctgcgtcaaggcagctagctagctagcttcgacgcgcgatgcacgggcagcgattcgcgcgatcagcgtcagcgagaccgcccgatgaaaaactactggcgcgtcgctgtggttgtacgcctaacgcctgtgctcgttcggttccgtatctattccgcatacctcttgcctgtggatgctccgatgcaagtgcaacccataaaaaaaactgaagctgaaatcgttttggatgctttgctgtgctctcggtttgggagcagaggtcatcttctccttgaagctgaaaccagaacctgacttgtgcattattgtacccaagcagaatattgcgttcgaaaaaaaaaagcgcaggagcagaatcacaaatgaagcggagtgtagactctcactggtccgtgcctgagaaaaacatggaattacttcctttttctcatacaagtgtatactatatcataaataacacagatcgtcgtcgatcttcctccccatcatatatatatatacacggatgtttattggcacctctagtactactacctacgcactcctccatagatagaaacgagcagaaatacattacacattgaaggcaaaatagagagagagagagactaccctgatcttttccccttccgtcagtccgtcctcgtttccccttctcattcgacgagcgcggggaagcagctccccgtgcgcgccagcgagctccgggacgcccccgcggcgagggcggagacgccggggtcggcggcgtcgcgcgtcgggctgctcggcgtggaccgcgccttcctcgacgccggcggggacccgagcctgcggcgcagcagcaggcgcagcgcagcgatgagcccgtcggggctgcccgcgggcgacggcggggcggaccccccgccggaggcggcgggcggtgccggccaacggcctctggggggagatggggggggggc

SEQ ID NO: 24641 - DNA, 902 bp, Zea mays
ttttttttttttttttttgatccgtgcctgagaaaaacatggaattacttcctttttcctcatacaagtatatatactatattataaataacacagatcgtcgtcgatcttcctccccatcatatatacacggatgttttattggcacctctagtactagtacctacgcactcctccatagatagaaacgagcagaaatacattacacattgaaggcaaaaagagagagagagactaccctgatcttttccccttccgtcagtccgtcctcgtttccccttctcattcgacgagcgcggcgaagcagctccccgtgcgcgccagcgagctccgggacgcccccgcggcgagggcggagacgccggggtcggcggcgtcgcgcgtcgggctgctcggcgtggaccgcgccttcctcgacgccggcggggacccgagcctgcggcgcagcagcaggcgcagcgcagcgatgagcccgtcggggctgcccgcgggcgacggcggcgcggacgccccgcggcaggcgcgggcgtgccggtccagcgcctcggcgggggagatgggcggggtccccgcgcgccccagctcctcgcccaccgcgtccccgcacagcccgcagatccaccgcccgccgaaccgcgcgcgcacgcccgcgatgtacggcgccgtgcactcctccgtgaagccgcagcactcgcacgccacctcctcctcgtcgtcgtcctcctcctcgaccgccggctccctctccatggcctccagagctcccgcctcacgggacacgcgcgcaactaggaataggtcagatcggcggctcctcgccctccgctgctgttacggtgacaagctgccggtcgtggccgtggccgccgcctgcttccatctacttccccttccccgttgaa

SEQ ID NO: 24642 - DNA, 2924 bp, Zea mays
  misc_feature (1)..(1): n is a, c, g, or t
  misc_feature (585)..(596): n is a, c, g, or t
  misc_feature (609)..(609): n is a, c, g, or t
ntttgtttttctgcccccccccccccgccaaaaaaaaaattttagggggggggtgtcccataaagagggcgcccccccccccataaaaagggtgtgttttccccccccccagggaggggggaccccccctttttaaaagaaagggggtttttttctccccaaggggagacaacaccccccccccctttttggggggggggtttttttttagaaaaaaaaaaaagggatattttcgcgatttttgccgccttttgggttaaaaaaaaaaagggggggttgttttacaaaaaaaatttttcccggggaatttttttaaaaaaaaattttaacccgtttaaaaattttcccccttccccccctaaaaggggggggaaaatttttgagaaaaggggaatttggtggggggctctttttcttttttcccccaccctggggaaaaagggggaaattttttcccaaggggataaaaaggggggaaaccccagggtttttcccaatcccgacggttgtaaaaaggccggcccaggaaatttaaatccgctcccttatagggcggaattggttccgggcccccccttgaagttnnnnnnnnnnnnttttccttttttntttttttttttttttttttttttttttttttggttttttttttttttttttggagacgggctacaaattcatttacaagtacatacagtatatagcatatctgcgtatgcagacgtgagatttcgagagacgggctacaaagtttacttattttgatctatcactcattttaaagcaaatgaccacagaactctatgcctgtttacaacaagaaaaaaaaatgttggagcaacccaccaaagggtacagaattagacgcacaacgaagccacaaaacaagaacacagctcatcttccatgcgagaaaatagcgtgacaccgagcctcacgcatggataagactgtcaataagaattgatgcatgctagctgggaaaggttgttgccagcaccttgttttatagaatcatcataagatagacgtgacccggacagagtggtctgcggacccagtgatgtacattggcagtgttggatgccaatccacacttgtgatagatgaactgtgcggcagtgtcctcagttcgctttcatggccttgtacctggtatattggggcccgaaccaaaccggaggtgaccagcagcctcttgccatttgaatccaatgctatttcatgcattcgtgttttaaagctctccggattgcagaatctgctgcaatctcttgaccaaagaatctgaccttgattgtgcaagctccattcaagtatctttccgtccgagcctaagctgaagatgctagtttctgccggcccaaaaagaacagagctcacaggtgaatcatgggcaggccatcctgtaatttgaagaccagcagacatgtcaaacatgtgaatcattccatctgtagcagaagctgccaaaatcttcccattgtgattgaagcaaagagaagtaatggcaggtggatcctcaccaagagggaggacagtcaatggcttccatgttttcatatgccacactgtcaagttggcaaatcctgttctctcaaatgtagttgatccatgccgtcttgatgcagctgcagagacaaacacaggttcaacagggctgcatttcaaatctaagatgcttggaaagtttctagatgtactcaggtcgcaaacaactctctttgcatcagcattccaagctttaattcctccattagctgtgcctatgagcagcaatctgtcagatctgcattcccatgaaagtgcactgacttcagacccacagtatatagtagcatttctggatgatgcagtggacgaatcatatgtccaaatcctaactgtgccatcaattgatgaactagcaatatttgacccagatgcagaaaatcgacatcggctaattggactgttatggcctaaaaatgtttcctggaaatctactttcacctcaggaaactcttcctcagtcaccaaaacctgctgatcctctgtatggttgatctcagaagattcatggaattttccacctcttgtataagatttcactgaacttgaggaccgagaatcaaaaccctgtatcatgctactcgaggccgaggattcttcatagttttctgacatctcttcatgaggggaaccagctgtactagtaccaactacattcttgtttccataaccaccactattatagttcctcctcaacagagagatttcatcttccttctcctctaaggatgcttgtagctctgccaatttattattcagttgttttatgtcattcttgagggatttgatggtattcttttcactactaattctcataagagctggggtccgagtatcattgaatatcccactcaaaaaattcctaaatgaaagaaccaaagtgtccagccactctttggagaaatatagacggaattgtggatccaagcttgggttcttaatatatggaatagcaaaccatgccagccaatctccacgcttttgcatcagataattgccactctcaccaaagaattcaattactttgtcttgtcttccagatttcaaagcattaataacatagtaccttaatactgacagctccaacttaacaagggttgagaacaactctgtgtcggggggggggggggacaaggggctctttctttttctttctccttgagcccgggggaacccctagtttttgaaggggccccccaccgggggggacccccgctttttttttccttttaggggagggtaatttccaacgttggggaaatcatgggccaaagctggttcccggggggagattggttttccccctccaaattcccaccaaaatatagaagccggaaaaaaataaaggtgaaaaccctgggggggccataagg

SEQ ID NO: 24643 - DNA, 1998 bp, Zea mays
cattgggtacctcgccgccggccgcgggcttctctccccggtccggcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgcttgtagctgtatgctgcaaccctactctgcctcgtcttcttccatcaccctaagcatgcgcgcaacccccactcaccaacgacgggcccggccgccgccgccgtcctgcctcgccacccgccaccttcgccggcgacgagcaccagcaggaattaatagagttccaaacctcggttctgcagtttctactaaaaaagcagggatgagtaaggatacatttattaatttggacgtctctcatcacagagcggttgcagtggtgaggttgctaagaatcgagaaggggaaagcatttgtagaccttttgaacgagaaagcaaatgattctggagataaagagataggatatgtgcagaggacactaggtttcagcacacgctatttggaggacagggatataagactggttaccgtcatagttgctggaacagtgcgctggaaacgctaccttgattatctaatcatgtcactatgcagtgaggagaaggttttcagggagatggagccactgcttctacagatattgagaattggctttttcgaaattctcaagcttgatgtacctgcttatgctgccgttgatgagaatgtaaggcttgctaaagtagctttaaggcctggtgctgggaatatggtgaatgcaattctgcgtaaacttgtattgctaaaggagacagactctcttcctcttccaaagatagaaggtgatgatcgtgcccaagctcgtgctctttctataatttattctcatcctgtttggatggtgagacgatggatacggtttcatggaaaagatgaagctctaagattgatgaattggaacaacagtgatcctcatttcagtctaagggtgaacacatcaaaaggctatactagggctgaccttgtaaaacgattggaaagtttacaggttcattatgaagaatcaattatggatgaatttgttcgcattcgggaagggatgcagcaagtcttaaaagctggattactgaaagatggcatttgtgctgtgcaagatgagagtgcaggtcttgtagtgtctgtggttgatccacaacccggggaaacgattgttgattgctgtgctgcacctggtggaaagactcttttcatggcatcacggttgtcaggagaagggaagatatgggctctggacataaacaaaggtcggttgagaatactcatggacgcagcaaagttacacggtctagatgatatgatcactgacatccatgctgatcttcgactatatgctaaggaaaccacagttaaatatgacaaagtattgttggacgctccatgctctggtctgggagtgctttccaagagggcggacttacgctggaatagacaatttgaaaatttggaagagttgatgtgtttacaagacgagcttcttgattcggcatcaatgtgggatactaatttacagtacgtgttcgattgaccctgaagaaaatgaagagaggattactgcttttgttcagaggcatccgaatgttttggattttttac

SEQ ID NO: 24644 - DNA, 1260 bp, Zea mays
ttttttttttttttttggcgcataaaactatctcgagctttactcatattcaaattacagtctacaaacattataatgtcagcattgcaccatatggtcacaaaaacaccgttttacaccgttttgggctgtattgtattatttgtacagtgtaatttaaatataattatagataagctgctatagatagagatagtcccattatggggccatgacggcatgcaaacagttagcaagtcgggtcgcacaaggtctcatcaaccacaaccttgcactgacgtctcacaagcactaaggacgcgaaaatataaacactggatggaagcggattaagttgctagcagcttcggtgtgtcaattccaagcgggtcgtcaatgacagtggtcaaacatcaggtccacagcatcatcagtctctccagaacggcacttttctcttcgtctgcttgaagcccttcattaaatctgaatatagaccttccacccttttctctgtctccttagtgaatgaccatattctgttaatagtatagttcatcttgacccattcatcagctataacttgaaccttctcgatagctgaatgcaaaacttcgaccttttctgtcgtgtcctttgctactgatgatatatcagaattcatctttcttgacccatcttttagaatttgaacctcattttccatttccttgatactgttaccaaaatatgagctgcataatgattcctgaatcttgatattttcccgctcattgatcagagactggacatcgagtgccattgctctcattacacggccattatcctcctctaaagaatcaagtttatcatccacagctttcgatttactatcccaaagagattcaagccgcgccagctgctgcttaagctgctcgacctccaaccgcagctcctcgcggaaaccgccgtcatcatccccggcactggagacagaagcgatcggagcggcgcactcccggacgtggtcacgcgggagggcgaagatgactgcgaggagcgcggctgcgacggccaaagcggcacaggaacggcggacgcgtctggagctagtaccgtgacgcccggacgccaggctgaggccgagggagacgaggcgtagcgggaggaggaaggcgacgatgatggcgaggagcgccgcgtcggcagtcattgtcgtccgtggcacggggaaagagtccctgctacaactgcaatgggttttgtgcgcggtggcccagttgaccaagcacacgctcggaa

SEQ ID NO: 24645 - DNA, 4377 bp, Zea mays
ctgcagacatacaagttgcttctagttctttcatcaatctgcttgggaggccgggaccttcgctgaattgcgtggttaagtaccaagccgcggtgcttcaaggtctattccagaaggaagaagacactggtggttgaggaatcggtgatatcaccccaattgctggaattcagaaacgatctcgtgttgccgacgactcagctgttgcctactcctcctctgattgctaagcgcagaaagacaataccaagcaatttcaagccacggcgtagcaggagggttgcgaagtttccccctgagttgggctctgaatccgctgctaaagtgtgcagatttttgggtttctgtgatgagcaggaaaatatttctttccaagatgctaggaagtatgctagcttgtttgatgctgccctgtccaacgatcatattgctgccctggcggctctgtttggttgggaggtgccccaggtggtgcaggcctgagctggttctgtccccgtcttggttgcttgttttactcttttccatggagccgggctgttttttggtgtggaatgtcaggggtctcaacagtcgtgctaagagagattctgtcaagtctgtggttgtaagccttaaacctgctgttgtttgtcttcaggaaaccaaattggattctgtctcagattttaacattcttactattcttgggtccgggttcagtaattttgtttttaatcctgcccatgggtccagaggaggtattttaatcgcttggcgtgatggttcgtttgtctcagctgcctcagttatcaagaacaattctgtttcagttcagttgcaaagtgcagatggtcctctttggtggttcactggggtgtatggacctcatcaagacagtttgaaatctgcttttctccaagaattaagagatattagaaatacatgtgtgggtccgtggatagttgctggtgattttaatcaaatttacaagtcagaagacaagaataattctaatattaacaggtcttcattgggcaatttcagaggccttattggctccttggatttgaaggagattcctttgaatggtagaagatttacttggtcaaatcagcgggcggttcccacccttgttaagctggaccatgttttttgctctacctgttgggaggaggctttccctgattgttttctttacagcagtgcttctgaaatttctgaccactgtcctctaatccttaaactcaatgcggatcttagagggaggcgtaggtttcattttgagaacttttggcctaaactcccgggttttttggaggaggttgctgcttcctgggatcaaccggttcagtcttcttgccctctggagagggtgtcgatgaagcttaaaagattggcgcggaggttgcagtcctgggggcatagtgcggttggaaatgtcaattctcagctgggactggctcgcgaggtgctgcacaggttggagaatggcccaggacagcaggccgttgtcctcagatgagccgatggttgctgcagaaattgaaacaacactgccttgtccttgcttctttggaaaggacagttgcacgcttgcgttcccgcttgcactacttgagagatggagatgccaacacaaatttttttcacctacaggttcgcttccgcaagaagagaaattttatttcctatttggagaatgaagggaggacagtcactagccatgaacaaatgcaggaggttctggatgattttttctccaatcttttgggttctaatatccagagaccgtattctcttaacctagctgcttgccacagagacgctattgatttgagttccctggaggcacctttctctgagaaggaggttcgcgacactattggtgctctcccatctgataaggctcctggtcctgatgggtttactggaaaattctacaaatgttgttggcatattattaaatcagatttgttggcagccattaattcactccatcaaggaaatactcacaagttggggatgctgaattcagcttatttaagtcttctccctaagaaagttgatgccttgtctgcaagagattttagaccaattagcttaattcatagttttgctaaattggtcaccaaaatgcttgctaatagattgggaccctatctgcaggagttggtggcatctaatcagagtgcctttgtgagacgccgatcgattcacgataactttatgttggtgcagcattcaatttaatctctccacaagaagagagtctctagtttgctcttgaagttggatatctccaaagcatttgactcggtctcttgggccttcttgattgaagtgctttcatatcttgggtttggtcctgtgtggcgaaatatgatctccaatattccggcctcttcttctacgcaagtgcttttgaatgggtctcctggtattcctattaggcaccggagagggcttcgccagggtgatcctctctctccaatgttgttcgtattggttatggatgttctcaatagtctgtttaatctggctgaaaatagggggctgctgcacagcttggagggtgctaatatccgaaacagactgtccatttatgctgatgatgtggtcctttttgttcaaccttttgaggaagacttttcaatgtgtcaaaacgtttttggactgctttggttcagccacgggattggtatctaatttgcaaaaaagtttcgttatcccaatcaggtgtaatgagcaggcggtacagatgggctgcaatattcttcggtgcactgcttcctcttttccttgcacttatttggggctgccgatttcagataaaaagctcagaaaatctgatctcatggtttgggtcgagaaagttgcggaccgacttcctaattggaaggctcggttgcttagtcttgctggcaggacagctatggtgcgctttgtgctttcagccatcccgatctaccttctcattgccatgaaaatccccaagtgggtgattaattctatacacaagattcggagaggatttatttggaaaggaagaaaggaggtaaatggtggcaattgccttgtgtcgtgggacattgttacaaggcctttggatctcggtgggcttgggatttctaacctgctgtaccagagttgggcgctgcaagctaaatggttatggttagaaaaaactgatcctaccaagtcgtggtctggtttggacttgcctattcaacaacttgtcaagagattctttactgcttctattgtttctctggttggtaatgggcataatacattattttggacagatcggtggttggatgggtcttgtatccaagattttgcccctgctgttgtggctaatgttgggaaacgagctatttcttctagaacggtggctcatgctcttcaacactggcagtggatcagtgacattgagacccctcttaatttgcctgggctgcaacaatatcttaacctttgggatgcattaaggggagtggtgctcactcaggaggctgatcgacatgtgtggattcattcttcctctggtcagttctcttcgaagtcgtgttatagggccttcttcatgggttcgattaccttcgaaccatggaagaggttatggaagacttgggctccacccaaatgcaaattttttctttggttggcaataagaaataaatgttggacagctgatagactgcagaaaagagggttggcttatcctgaggtttgtcctttatgtgatcaagattcggagaatatccaacacctcctttgcacttgcatttttgcgcggcaattttggttctacattctctcttcattgggactggctaatctttctcctgcctctaatgagtccacttttgctgactggtgggagaaggtgtgtaagcaagtgcacaaatccaaaagaagaggctttaacagtatcatcatcttgggggcttggtgtttatggcttcatcgtaataaggcggtttttgatggcgtcaggccttccattcatggaataaaatcagtttttctggatgagtttgagtgttggaggcttgccggtgctagacatcttgaggctttgggtcctggtgctgcaattttcagatcaagggttctattgggggcttagtgaagagcagttgtgtgggtgtgtggcctgctggcacttgtgctgctgtccttttgcgtgctgctgtttccatgcgcagaaggaagctgcaggtcgccttgaaaggaaccctgcgtagcaggaattggtggtcttgtgtttggtcaggatttggtggtcttgtgtttggccttttgtggcattgtactttggtccattttggactgtttcttctcttaatttaatgatgcgcaactctcctgcgcgttcacgaaaaaattaaa

SEQ ID NO: 24646 - DNA, 1477 bp, Zea mays
gcacgagaccattgcctacctcgtccccggcccggagagccgaccgacaacatcatggcgaggattccccaggttctggcgccgctcctcctcctgctgctccccgccggtctccgggagctgatgatcgaccgccggcccctgccggaaggcgctgccggcggcgaggtcctcctccacccgctggtgctggtgcccgggctgacgtgcagcgagctggacgcgcggctcacggacgcataccgctcttccgcgccgcggtgcggcgccatgaaggggaagggctggttcggcctctgggccaactgctccgacctgcccgcgcaccactacgtgcggtgcttcatggagcagatggccctcgtctacgaccccgtcgcgaacgactaccggaacctgcccggcgtcgagacgcgcgtgcgcaatttcggctcctcccaaggattccagaagaacccagagcacacgacctggtgcttcgaggtcctcagaaacgagctggcaagggccgggtaccgcgacggcgacaccctgttcggggccccgtacgacctccgctacgccccgccggtgcccggccagccatcggaggtcttctccggctacttccgtcggctggcgagcctcgtcgaggacgcgagccgcaagaaccggggcaggaaggtgatcctcttcgggcacagcttcgggggcatggtggcgctggagttcgtccggagcactcccatggcgtggcgagacaggtacatcaagcacctcttcctcgtcgccccggtgccggcggaagggttcgtgaagccgctgcagtacttcgtctccgggtccaacctgatgtacgtcccgacagtcagctcgctcgagctggcctttaggccgatgtggcggaccttcgagtcctccctcgtcaacttcccctccccagcggtgttcgggcgcaggccgctcgtggtcaccgcgcggaggaactactccgcctacgacctggaggacctcctcgtcgccgtcggctacggcgccggcgtggagcccttcaggagacgggcgtccccaagatgagctacttccaggccccaatggtgccgaccacgtgcatgaacggggtgggcaacgacacgccggagcagctcgtctactgggacggcgacttcgacgcgaccccggagatagtgtacggcgacggggacaattccatcaatttggtcagcatgctggcgttcgacgagaagatgcgccggcagccggaacagaacaaggtgtacaagtcgatcaagattcgtggggcccagcacggtactattgtgacagacgacacggcgctcaagcgggtcatgcacgaaatccttgaagcgaatcgtagttaggctactcacaatggggatttcatgtctctgtttccaaaaatgccacatcagatttatggatgaatgaaataccctctctcaatagagagtttcatctcacaaaaaaaaaaaaaaaa

SEQ ID NO: 24647 - DNA, 708 bp, Zea mays
  misc_feature (16)..(16): n is a, c, g, or t
gcacgagaccattacntagaacatcctaatcgaaaaacgacttacgagccgcgccccgcaggccgcagaattcgaccccacacgcctagccgccgacgcaggccatcccgactccgcccgccggctggtcggagttctccctcccggtccggaaatcctcgccgctggctcctccgtcgactccaggggacgagtacaacaggtacggtgcggtgggacatgcctaatggtgcagaagcaagtgtgtgtgcattatcaggcagatggatggactcgttcaggatcgacatgacagacgtgtgccgctcgacgaatactagcaacaactatgacgaagatggcagagcacctcaaagagaggcgttgaacagggccatgtcatgttcgtgctggtcctgaggtcgtcaccgatccagcctttcttgtgaccaggaacatggaggcctgatcaatagaaggaacccaaaaaaaaaagagtcatggagtacattgatgcattggatgatcatgatgccatgctttgagggtactgttgagagaaaattctgtggccagcaatgtaggatggtgtcattttttggggcctatcatctgaggtgattcttgcagaaatattagttttgtgcatttggctattttgggctgcagatacgattttacgctactagttaattaaattaataataatgaagaaaaaaaaaaaaaaaa

SEQ ID NO: 24648 - DNA, 5687 bp, Zea mays
ggtagatgaacagtcgtcggagtccggctcgtcggctccgaccaccggccggttcccatccttccttctgttctagcgtccagatatctatacctactatagtttgtttgtgtggtttaaacttgagacacgtacgcgccattgctttgaactctgagagcaagagcaggggggtggcgcgtttgtgccgtacgcgatcgcgtgtggtgttaatttgtatagcctttagagacgaaaaggccccctgtcttctcgtgtgttggtcgtcgttttgtcgttgcagtatataccatatcttaaacaattgtttcccatcgccgccagactgtggctatgaaggccaccgcgcctgcccctgccatggctgatttttttaaagaagagacactaacactattagccgttacagcaccaactagacaaacgcgctgctcgatcgatcacagatctctgacgatggcgatccccatggagcgggccgtggcgacgacggacttgcacatggcctcaagcgacgcgtacttgcaggaggggtcgtcacccagcttcagcctcgcgatctcgtacacgtggcggacggtgagggacgcggcggtgacgtggccggggaaccggctggcggtctggatcccggcggccttcttgaggagccacgacaccgagggcggcttcaccacgagctggaaggtgctgtccctgtagacggtcacggtgacccgtatcggggtgtcgggcttgtacctctgcgtcctggcgttgatctccttgcagagcgccatcaggttcacccggtaggggcccagcgctgggctcactggaggccggtcccgtgcgggctgcgccggctggtaggacgaggcggatcgttgccagcacaggcttccttacgaatgcatctttcagtgctgccgccatcgtcccgccccggaaataggatagaatagaattgcatgcctgcagtctgcacacgcgcagaacgttaacatatcagatcagtcgatgaatcgaaaaccgatataattaatcaataatgccagtaaatgggaatggaagccaattatattgattcacagtgggtactgccatcgattagaaactcggagcatccagacctgttcctcctcggcgggacgtacggtggctcgatcggtgccaaggagccgccgccgtcaggggtgcgagcgcgatatataataatgcccctaggcttgggtccgtttgtttgggctttgttaacgctgctaggggctgtcaaatgtcctatttttaagtccatttctataagaatcgatttgttagtgagcgaaaattggcatgcctatctttttatgttacggtccgtcatatgtgtttcacctttccttttgtagtgagtatcattacctgttgccttaaaaccttgttgtggcgcgtaacaagagttacctgtcggaggccagtgacaatgctcttcatttctcaacatccattttcttcagtatagatatgaaataggaaatccgatttgctgattactaagatgatcagaacaaaagcagtcagtcagtttggtggatgcgcattgcaaatgacagtcaagttgcatgaaagaaaccggcaagcaaaatggacgaaaactggacaccttcagtgtcgacatgatattaattacccaacaagtctgaaatgcctgtactgtccaactcaatgcagcgccgcggctcttccttctgattcacactgaacacctgagtttattcattgcagcgaggttatttgttcagttttgtgtttatagagaacgataaacatcaggatttcaacaataaagccacacgcttatagatgctacaggttacagatttgactaaggggaatgctgagctaggaagctagctaacaagcggatgttgcacatcatggcagacccccatggcgaagcaaattacagaatcctaaacaacagaaacacccctacaaagctggcgtgtgtgcagcagaacttaacaaatgctgacaaacaggtgaaagcaatcgaatcaaaaagaagcaagcaagcatctaagagatagagactggcgaccacaatcttagttgtccacgacaagcttccgcctcttgtagttaaccatcacctcgcccttgatgccaaccaccatggcgttccagtcgttctctgggaacggcgataccagctcgaactcaaagttcctcagtaggtgcgtccagatcgccttgatctgaaggtaggcgaagggctcaccgaggcacccatgcctgccaccaccgaaggagatgtacgagaaggcacctgcagccttgtcctcctcccttccgggaccgaaccggtcagggtcatatgagtcagggttcttgtagatgtggggcagcctgttggcgaaggatggtgatgtcgcgacgatgtggcccttggggatgtcatacactttgccttcctttgttgtcacggtgaagtcgctgtgcgattgacgaagcaacatgattagcggcgggtggagacggagggcctccttgatgcaccggtagaggacgtccatctccgcgaggatgtcatgatcaatcttgtcgccgtgccgtttcatgacatccttctgctcctctacagcctctgcgaagtactgcttgaaccgaagcatgtatgctccagtccaggttgaggtgatagagctggtgtgctgcccagcaaagagtgctgcgataagtagcccggttacctcgccctcactggtggaacgcccattcttgtacttggaatcaatgaagcactgcagcatgtcttcttcagactgtccagaggccttgcgggacttgatgatggtggcaaagatttctgccagacgtgcacgtgccctgtcgcggcgcttatgtgcagggattgggaggtatgggaagaggacactgattggctgcatcccgttgtcaaggtcgtggaagagagcagaaacatcgtcgaacagcttttctcgcacctcccttcccagcaagcaccggctagctgtcagtatgatgaggtgctccaactcatacttcaaatcaacagtgccactttctccccattttgagaagtactcctgcaggaaaggttgggtttgcatgatattaattacccaacatggatacaaaaatatgattaaaaaatagcaaattcagaaaactagaagatcaggatgacatatgtgattttttattttattttatcttggcttgataagtaaatcctaacatgttattacttaatatggagaaagggtgttgaagcttattaggccagatgtacagaaaatctggcacaaagaactctctgcatatacatgaaaattttagcttcttcattagctaaaaagaacaaaaaaatatgaaaaactaatattataagaagatttgtttgggttcaacactgcagtagcaacctaaatatcatgaataaaggcgatgagattaacaagctcccatggagccagtgtgataaaattcaatttgcaaggtagatgaggtactcaaagcaatttttcttgcactatgtgtacatccaggatgcctttaggagtttggcagtttatcctgccaattctggtgcttgtagccacataaattcttttttttcagtaacaagtttgtgtaatgtttcaatgcaagcatgaagctcaaggcctaaaattaatacttaagtcaagaatcttaggacagggcaataaataataataatgctggctgtaatatgaagccatgcttttataattgaccgtcacattcaactagatggagtacagcacaacatatcttgtcagctctcaaggaaacataactgcacttctttttacaaacttaggagctgataacaagataatattctttaatagaaaagggaaatatattattcccacctcacctttacaagaaacagaaactgtgtccatgtgtcatatccatttgtgagttagcaaataaatatagcttgcagagatcagctagtaaaggaatgttgcccattatatctaatcttttttacaacaattatctctaaattgattgagtgtcgcttgagaaaaaaaggtagaaagaatgtgaacacagaaacagttcatcagaacatagaaaagaaactttaatacacaaaactaggaaatatacaaagaaccacataaagaaaatgtcccaatacaaaagaagaagacatgcaaggaatcccaaaagcctgctacttagggtctggaagcatcagctcaaaaaggatgaagatgatgtgagatagacacgcactggttccaaaagttgcacattagtcataattgagcctcctttccgaaaagaaaaaaaaggcaacctataacttcccgaaggaactagataatccagtgaagaaaaatatgctggcctcaaatgaactcagacaaaaaaaacacacaccatgtctacgctcttaggaaatggaagtgaagagctatatcatagatgttaagtcctatttgctaaagtagtgcattttttgccaccacaaagctccaccgagatagtaaacaaaatgctcgagaagcactaaaccaacaacctttaagcagaaatgctcagaaaataaacatgaatgagaacaccaagtatggggtttatggtactcctgtggaactatcatattgcaaaccctgtccccccaagtactgaattactcctaatgtgcccacagttacagatccacaaacccaaacatatcaagaacaagcacttcaccctcatcgcaagtactgaatcgccacatgaaccacatattaaggggttagactaaaaacagatcttaagacagagcagtaagtcggtaagtgattccgcacctcagcctcagcaaccatctggtcgacatagctgcgcagcttgttcgcccggagcgcctcggtaaagaacctgaactgctcctgcctgacggagtagtcgacgtcgaagacgaccccggggccgaaggtgggcacgttgaacctgtacacctcctgctggctcatctcggcctcgttgcccttgaagaagtgcgcggacacctcgggaccgacgaggaacgtgatccttcgggtgatgatggggacggtgaagacgctgccgaggcgggcgtactgctcccggatcatggggatgggcccgcgcatgaacttgacgaggccgccgaccaccggcgcccccgggatggtgggcggcaggcgcttgccgcccccggagcgggagcccaggaggagcctgaggaaggccgcggttgccagcagcagcgccgcgccggcgatgagccgctgctgctgctgggggtcggcgagatccatcatctggttcacgagaaacggcatttccatgggttaggaactaggatcggatcgcggcgagcgcaatgcagtcaaaaggtgccagagtggatcagatcaaaggtggtagggtgggcatggaggccgcgaacttcgtttgtatcgaagtaaaagtgtcttttgaaaaataaattctgaatggcaggcactggatacagttaggggagtgagcaggattaaaaaaaagagagagatcctcggtggccggcgccgcaaaaatcatcatcggtgctaactggtaagcaggaaccatggatcgcgaggccgggggaaagatcttacctttcgctttccgtattccaattcgtcgggacggggggcggcgatgccgggggagtgtggagtccg

SEQ ID NO: 24649 - DNA, 1987 bp, Zea mays
caattcagcatcggacgcaaccaacagaggccgctcgttttctgtttctgttgtttttttttgtttcacactgaacacctgagtttattcattaggttatttgttatgtttgtgtttacatccatctaagacaatgataaacatcaggatttgaacaaaagacccacaggcttatagatgctacaagttacagatttgacataggggaatgcttagccaggaagctgaacatgcagaagttgcagatcatggcggccccatagtgaagcaaatttcaaaatcctaaacaacagaaacacccctaacaaggctggcttgcgtacagcagaacttgcactgaacaaatgctgacaaacatgtgaaaacaattgaatcaacaagaagcaagcatctagagactgcggccacaatcttagttgtccacggcaagcttccgcctcttgtagttaaccatcacctcgcccttgatgccaaccaccatggcgttccagtcgttctctgggaatggcgataccagctcgaactcaaagttcctcagtaggtgcgtccagattgccttgatctgcaggtaggcgaagggctcaccgaggcacccatgcctgccgccaccgaaggagatgtatgagaaggcgcctgcagccttgtcctcctcccttccaggaccgaaccgatcagggtcatacgagtcagggttcttgtagatgtggggcagcctgttggcaaaggatggcgatgtcgcgacgatgtggcccttggggatgtcgtactctttgccttcctttgttgtcacggtgaagtcactgtgtgattggcgaagcaacataatcagcggcgggtggagacgaagggcctccttgatgcaccggtagaggacatccatctctgccaggatgtcatgatcgatcttgtcgccatgccgtctcatgatatccttctgctcctctacggcttctgcaaagtactgcttgaagcgaagcatgtacgctccagtccaggttgaggtgattgagctggtatgctgtccagcaaagagcgctgcgataagtagcccggttacctcaccctcggtggtggggcgcccattcttgtacttggaatcaatgaagcactgcagcatgtcttcctcagactgtccagaggccttgcgggacttgatgatggtggcaaagatttctgccaaacgtgcccgtgccctgtcacggcgcttatgcgcagggattgggaggtacgggaagaggacactgattggctgcatcccgttgtcaaggtcatggaagagagcagaaacatcgtcgaacagcttttctcgcacctcccttcccagcaagcaccggctagctgtcagtatgatgaggtgctccaactcgtacttcaaatcaacagtgccactttctccccactttgagaagtactcctcagcctcaacaaccatctggtcgacatagctgcgcagcttattggcccggagcgcctcggtgaagaacctgaactgctcctgcctgatggagtagtcgacgtcaaagacgaccccggggccgaaggtgggcacgttgaacctgtacacctcctgctggctcatctcggcctcgttgcccttgaagaagtgcgcggacacctcgggcccgacgaggaacgtgatcttgcggctgatgatggggacggtgaagacgctgccgaggcgggcgtactgctcccggatcatcgggataggcccgcgcatgaacttgacgaggccgccgaccaccggcgcccccgggatggtgggcggcaggcgcttgcccccggagcgggagctcaggaggagcctgaggaaggcgacggtggcgaccagcagagccgcgccggcgatgagccgctgttgctggctgtcggcgagatccatcatcttttgcttctcctattccaattcgtcgggacggggacgaggacggcgtcgtcggggccggccggcccgatgggtacctgccccggccgcctcgagcggccg

SEQ ID NO: 24650 - DNA, 2082 bp, Zea mays
  misc_feature (5)..(16): n is a, c, g, or t
  misc_feature (19)..(19): n is a, c, g, or t
  misc_feature (21)..(21): n is a, c, g, or t
  misc_feature (24)..(24): n is a, c, g, or t
  misc_feature (26)..(27): n is a, c, g, or t
ttttnnnnnnnnnnnnttntnttntnnggcacactgaacacctgagtttattcattgcagcgaggttatttgttcagttttgtgtttatagagaacgataaacatcaggatttcaacaataaagccacacgcttatagatgctacaggttacagatttgactaaggggaatgctgagctaggaagctagctaacaagcggatgttgcacatcatggcagacccccatggcgaagcaaattacagaatcctaaacaacagaaacacccctacaaagctggcgtgcgtgcagcagaacttgcaccgaacaaatgctgacagacatgtgaaagcaatcgaatcaaaaagaagcaagcaagcatctaagagatagagactggcgaccacaatcttagttgtccacgacaagcttccgcctcttgtagttaaccatcacctcgcccttgatgccaaccaccatggcgttccagtcgttctctgggaacggcgataccagctcgaactcaaagttcctcagtaggtgcgtccagatcgccttgatctgaaggtaggcgaagggctcaccgaggcacccatgcctgccaccaccgaaggagatgtacgagaaggcacctgcagccttgtcctcctcccttccgggaccgaaccggtcagggtcatacgagtcagggttcttgtagatgtggggcagcctgttggcgaaggatggcgatgtcgcgacgatgtggcccttggggatgtcatacactttgccttcctttgttgtcacggtgaagtcgctgtgtgattgacgaagcaacatgattagcggcgggtggagacggagggcctccttgatgcaccggtagaggacgtccatctccgcgaggatgtcatgatcaatcttgtcgccgtgccgtttcatgacatccttctgctcctctacagcctctgcgaagtactgcttgaaccgaagcatgtatgctccagtccaggttgaggtgatagagctggtgtgctgcccagcgaagagtgctgcgataagtagcccggttacctcgccctcactggtggaacgcccattcttgtacttggaatcaatgaagcactgcagcatgtcttcttcagactgtccagaggccttgcgggacttgatgatggtggcaaagatttctgccagacgtgcacgtgccctgtcgcggcgcttatgtgcagggattgggaggtatgggaagagtacactgattggctgcatcccgttgtcaaggtcgtggaagagagcagaaacatcgtcgaacagcttttctcgcacctcccttcccagcaagcaccggctagctgtcagtatgatgaggtgctccaactcatacttcaaatcaacagtgccactttctccccactttgagaagtactcctcagcctcagcaaccatctggtcgacatagctgcgcagcttgttcgcccggagcgcctcggtaaagaacctgaactgctcctgcctgacggagtagtcgacgtcgaagacgaccccggggccgaaggtgggcacgttgaacctgtacacctcctgctggctcatctcggcctcgttgcccttgaagaagtgcgcggacacctcagggccgacgaggaacgtgatcctgcgggtgatgatggggacggtgaagacgctgccgaggcgggcgtactgctcccggatcatggggatgggcccgcgcatgaacttgacgaggccgccgatcaccggcgcccccgggatggtgggcggcaggcgcttgccgccccgggagcgggagcccaggaggagcctgaggaaggccgcggttgccagcagcagcgccgcgccggcgatgagccgctgctgctgctgggggtcggcgagatccatcatctttcgctttccgtattccaattcgtcgggacggggggcggcgatgccgggggagtgtggagtccgggtgtttatatataggtgtgccacgcggcactgccgaatggaggagggagtaggatagatcccgtggtttggggaggagtggctggattagcaatggcggatgggaggtttacagggggcggcggaaacaggggcgagcccggccggc

SEQ ID NO: 24651 - DNA, 1720 bp, Zea mays
  misc_feature (3)..(3): n is a, c, g, or t
  misc_feature (10)..(10): n is a, c, g, or t
  misc_feature (12)..(12): n is a, c, g, or t
  misc_feature (15)..(16): n is a, c, g, or t
  misc_feature (18)..(19): n is a, c, g, or t
  misc_feature (21)..(21): n is a, c, g, or t
  misc_feature (25)..(25): n is a, c, g, or t
  misc_feature (27)..(27): n is a, c, g, or t
  misc_feature (37)..(38): n is a, c, g, or t
  misc_feature (47)..(48): n is a, c, g, or t
  misc_feature (56)..(57): n is a, c, g, or t
  misc_feature (63)..(65): n is a, c, g, or t
  misc_feature (69)..(69): n is a, c, g, or t
  misc_feature (71)..(71): n is a, c, g, or t
  misc_feature (77)..(77): n is a, c, g, or t
  misc_feature (85)..(85): n is a, c, g, or t
  misc_feature (90)..(91): n is a, c, g, or t
  misc_feature (95)..(96): n is a, c, g, or t
  misc_feature (99)..(99): n is a, c, g, or t
  misc_feature (102)..(103): n is a, c, g, or t
  misc_feature (114)..(115): n is a, c, g, or t
  misc_feature (120)..(121): n is a, c, g, or t
  misc_feature (125)..(125): n is a, c, g, or t
  misc_feature (127)..(127): n is a, c, g, or t
  misc_feature (132)..(132): n is a, c, g, or t
  misc_feature (134)..(136): n is a, c, g, or t
  misc_feature (146)..(146): n is a, c, g, or t
  misc_feature (155)..(155): n is a, c, g, or t
  misc_feature (158)..(158): n is a, c, g, or t
  misc_feature (160)..(160): n is a, c, g, or t
  misc_feature (167)..(168): n is a, c, g, or t
  misc_feature (172)..(172): n is a, c, g, or t
  misc_feature (177)..(177): n is a, c, g, or t
  misc_feature (184)..(184): n is a, c, g, or t
  misc_feature (189)..(189): n is a, c, g, or t
  misc_feature (194)..(194): n is a, c, g, or t
  misc_feature (204)..(204): n is a, c, g, or t
  misc_feature (220)..(220): n is a, c, g, or t
  misc_feature (224)..(224): n is a, c, g, or t
  misc_feature (233)..(233): n is a, c, g, or t
  misc_feature (237)..(237): n is a, c, g, or t
  misc_feature (247)..(247): n is a, c, g, or t
  misc_feature (250)..(250): n is a, c, g, or t
  misc_feature (253)..(253): n is a, c, g, or t
  misc_feature (257)..(257): n is a, c, g, or t
  misc_feature (260)..(260): n is a, c, g, or t
  misc_feature (299)..(299): n is a, c, g, or t
  misc_feature (305)..(305): n is a, c, g, or t
  misc_feature (342)..(342): n is a, c, g, or t
  misc_feature (367)..(367): n is a, c, g, or t
  misc_feature (404)..(404): n is a, c, g, or t
cgngtgggcngntgnntnnangacngnggcggcgacnnggttagtgnnataagggnngaagtnnnatgngnttgaancaagccancgtgnngtgnnaanggnntgtggagatgnngaagnnggtnancccanannngcaggtaggncgtacacgntancntagtgtnncagntagcngaagggncacgnaaggnaaccattgcntgccgccccggagganatgntttaaaggngcgnccagcgtttntcntcntccnttncaggaccgaaccgatcagggtcatacgagtcaagggttnttgtanatgtggggcagcctgttggcaaaggatggcgatgtcncgacgatgtggcccttggggatgtngtactctttgccttcctttgttgtcacggtgaagtcnctgtgtgattggcgaagcaacataatcagcggcgggtggagacgaagggcctccttgatgcaccggtagaggacatccatatctgccagaatgtcatgatcgatcttgtcgccatgccgtctcatgatatccttctgctcctctacggcttctgcaaagtactgcttgaagcgaagcatgtacgctccagtccaggttgaggtgattgagctggtatgctgtccagcaaagagcgctgcgataagtagcccggttacctcaccctcggtggtggggcgcccattcttgtacttggaatcaatgaagcactgcagcatgtcttcctcagactgtcccagagcccttgcgggactgatgatgggtggcaaagatttctgccaaaccgtgcccgttgccctgtcacgcgccttatgcgcagggattgggaggtacgggaagaggacactgattggctgcatcccgttgtcaaggtcatggaagagagcagaaacatcgtcgaacagcttttctcgcacctcccttccccagcaagcaccggctagctgtcagtatgatgaggtgctccaactcgtacttcaaatcaacagtgccactttctccccactttgagaagtactcctcagcctcaacaaccatctggtcgacatagctgcgcagcttattggcccggagcgcctcggtgaagaacctgaactgctcctgcctgatggagtagtcgacgtcaaagacgaccccggggccgaaggtgggcacgttgaacctgtacacctcctgctggctcatctcggcctcgttgcccttgaagaagtgcgcggacacctcgggcccgacgaggaacgtgatcttgcggctgatgatggggacggtgaagacgctgccgaggcgggcgtactgctcccggatcatcgggataggcccgcgcatgaacttgacgaggccgccgaccaccggcgcccccgggatggtgggcggcaggcgcttgcccccggagcgggagctcaggaggagcctgaggaaggcgacggtggcgaccagcagagccgcgccggcgatgagccgctgttgctggctgtcggcgagatccatcatcttttgcttctcctattccaattcgtcgggacggggacggggacggcggcgtcgcgggggagtggggattccgggtgcctatatagatgtgccactgccaaatggaggagggagtggggtgggacagtgagagatcccgtggttgcgggggaggagtgtggaaggattagcaacggccggttagggggcccggctcggcgggccccggccggcctcgaggtacccaa

SEQ ID NO: 24652 - DNA, 961 bp, Zea mays
  misc_feature (916)..(916): n is a, c, g, or t
ggacttgaggtggggtggcaaagattttctgccaaaacgtgcccgtgccctgtcacggcgcttatgcgcagggattgggaggtacgggaagaggacactgattggctgcatcccgttgtcaaggtcatggaagagagcagaaacatcgtcgaacagcttttctcgcacctcccttcccagcaagcaccggctagctgtcagtatgatgaggtgctccaactcgtacttcaaatcaacagtgccactttctccccactttgagaagtactcctcagcctcaacaaccatctggtcgacatagctgcgcagcttattggcccggagcgcctcggtgaagaacctgaactgctcctgcctgatggagtagtcgacgtcaaagacgaccccggggccgaaggtgggcacgttgaacctgtacacctcctgctggctcatctcggcctcgttgcccttgaagaagtgcgcggacacctcgggcccgacgaggaacgtgatcttgcggctgatgatggggacggtgaagacgctgccgaggcgggcgtactgctcccggatcatcgggataggcccgcgcatgaacttgacgaggccgccgaccaccggcgcccccgggatggtgggcggcaggcgcttgcccccggagcgggagctcaggaggagcctgaggaaggcgacggtggcgaccagcagagccgcgccggcgatgagccgctgttgctggctgtcggcgagatccatcatcttttgcttctcctattccaattcgtcgggacggggacgaggacggcgtcgtgggggagtggggattccgggtgcggggtgcctatatagatgtgccactgccaaatggaggagggagtggggtgggacagtccgggaccccgtcgccgcgcgggaccacgtgtggaaggattangcaacggcggataggaggtttacgggtggcggaaagagagcccgg

SEQ ID NO: 24653 - DNA, 587 bp, Zea mays
tgggtaccgggccccccctcgtatttttttttttttttttttactagtaaagatttatgagcacatattttctctgatatatattgtatacaatttcttggtgaattttctctgatactacatatatgcagttatggatagaaaacttcatatgacgagagtaacacaaacgcaatcatgcatgttttattttattattgtcgtcatcaaacacacgaacacatcctctattcgtttgggcagcagcattctcctggagaaatacttttacagtaggccttgtcgctcctgtggtgttggtgctcgcataacctgcggcacccgtccgtagtgcaggggtactgtgaggttccggcgtggaagcacggcatcccaggttttggcttgggagcaggggtgtcctccgtgccgattgcaccgatgcaatatacggatgtgtaagatatggctccaagaaccaagaacacagcgatgattgcgctcttgatgatgagtgccatggggagagaagctgtgaaacttctcttctcgtgatgaggagagtggatctgtaatttctctccccggccataaatggccgaatcccg

SEQ ID NO: 24654 - DNA, 2659 bp, Zea mays
  misc_feature (775)..(776): n is a, c, g, or t
caaatttaaaaacatgctacggattttaaactaaaaatcaaacaagttttgaagaaataaaatcggtcgattttaccgattagccgcccctgctagccgattaatcggtcccaggtagagataaaccggtggcctctagtagctaggttttgaggattttttttacccttttaacttcaaatcttttaacttgtgataacatttgggtcatcttttgtttaaattttatgacctcaatatactttatttgccaaatgtcaagtggttcggtttcttcgcacgtgctaccgatttatcaatccaataatcaatttatcggtcttatcagccaattaatcagtttcgtatcgtttcaattcaaaaatcagtttggatgtgagcacaacataaatgaggtatttggtttgatgaatcactatattcaaaatgaagtggtgcatcatgggttcatttctcaaatttggtgggatgcctccattccacatattagtactaaacaattaactatgaggaatgaactggtgatggattaactcactccattccacaaaccaaacaaaaaaaataaggagtgagaagatgatgaactatataattcctcaaaccaaacactccaaaagtgtctcgcatagcagcctccagactttttgacgagtattaccaggttaaaaatgtagagatccctgaaccccataccacctttattcttcagaatacataattttcaccaagcttgccactgaatagtttgtgttcctccgcgttgctccatcanngctgagatatggcatctgtgatctatttaccgatatttatttagaatttaaaaatcatcatcacatataccaatatggtttgagctatagattttattaacgagcacatatccagtgcacatgaaagctttgtgcacatgatgcacatattaaatcgccactattcatctcagatttaacgtctctggttgatcattgtaatttacaaataacactttccaccactacaacccaccacgtcagaagatgtctttaacaaatataccaaacaactacagacgttagatctaaaatgagtggtgatgatttaatatgtacatcatgtgcactaaaatttcatgtgcattagatacgttctttttattaacacctccttttcctcacatgctaagaaacttctccttgcatccccttgttcttgccaaaactctaccaattaaatgattaaaacagccactcattgattaaaagtcactcataccttatccaacattaacctgctctgtctagtctctattcggtaattagaaagaaatcacatcgctaatccccgttctttagcatcacaaattccaggtcaagtgaatgttcagaacaagggtctaagccttgtctacgaacatatagaaccaccttttattctgattcaaattcggagtaaactggatacaatagttgggtccatcagttagacaagtcattacagcacaacctctggtttgaatagccaaacacccaaaaattacttgtccacgaagagaaatggtgccactgcatatggggcaatagacaccctatcaaccgccgcggcaaccagagaaccttttcagcttcagctacatctctgcatcaagttgacttgtcaagcttcccgatggtgttttgtcgtgcgttccgtagaatggttttgtcagcagtgatgaagaagccagcaatacaggctgtcaaacaaatgagtgcaatttcagtgtacgtctgaggttcgtttcagcagcagtgctgtagctaatgctgctagcaatcagctagccgaacagcaggtgcagcacttgccaagctgcagcgcagcaactgcgacctatggcgtctccagaagcatgctttctagtaaaatcataccatcatttttcgagatgcaaaatcaacctttactattacaggttacagaggcatggtaaagcagatgcaagtctcggcgtgcttctacaagaggtaggctgtttgtttctgctgttggcttctgagatgcagaagcacagaacaaactaccgttggatcatgttggtaaaactgttaacacttcagaaaatcaatagtccatgatggtcacttcatataccaaactaccattgaaccagtaaatttgttaatttaaagttttaaactatagcactttatgttgtccaagttcactctgaaaacaagaaagttgcctggcctcattggaacacaacatatatagtcatccagactcactagaacttaaagaggaataaaacaaaagaaagaagggggaaacaaacagagttacatgtcaatctatacttgtgcaaatacttcacttcaacagcataatttgaatacattatagcagaagccctacaacaaataacctccggacagacagaacaaataatacaacttatttcatttattatcgatgctatgctaaagctttgatttgcattttaatcatgcaggacaaacaatccaacttagttgacgtgacttccgtgccttatgtggcatatgatataatcagtaatctgacgacacatttaaagctacttactttacttgacaaaaaagtgaaacaaaacctcacttgacacccattgtttttaagttaaagtacttaagttatgtagaaaagaagcctatcc

SEQ ID NO: 24655 - DNA, 851 bp, Zea mays
ggagggagatggatgggagaggacagagacaaggggcggttcgggcccttttttttttttttttttacgaacatatagaaccaccttttattctgattcaaattcggagtaaactggatacaatagttgggtccatcagttagacaagtcattacagcacaacctctggtttgaatagccaaacacccaaaaattacttgtccacgaagagaaatggtgccactgcatatggggcaatagacaccctatcaaccgccgcggcaaccagagaacctttccagcttcagctacatctctgcatcaagttgacttgtcaagcttcccgatggtgttttgtcgtgcgttccgtagaatggttttgtcagcagtgatgaagaagccagcaatacaggctgcagatataatgagtgcttgtgcagtgtagttgagattcgccttagcccaaggaaggacacggcagccaaccaacgtgggaactgcaaccacagtaccagctattgcggcgttctttgctcccagcagtacagcttctctgacggcggcgttggactcctcctccttgggggaccgaatcaggaaactcctgccagccatgctctctctctctctctctcgatcgatcgactctggtagcttcctctggccgtcgttccgttgggggcagcagccgggcaggggatggcgagcgagctagagataaaatagaagaatttgtttctccttgtgatggtggcggtggccggtgggcgagtggcaaggtcggacacggatcggaacgaacctgtacagctcgtgtcatgaggactaaacgacggcacaggcccactcagccttagccgccacactttatt

SEQ ID NO: 24656 - DNA, 865 bp, Zea mays
cacaaattccaggtcaagtgagggccgcgcttttttttttttttttttacgaacatatagaaccaccttttattctgattcaaattcggagtaaactggatacaatagttgggtccatcagttagacaagtcattacagcacaacctctggtttgaatagccaaacacccaaaaattacttgtccacgaagagaaatggtgccactgcatatggggcaatagacaccctatcaaccgccgcggcaaccagagaaccttttcagcttcagctacatctctgcatcaagttgacttgtcaagcttcccgatggtgttttgtcgtgcgttccgtagaatggttttgtcagcagtgatgaagaagccagcaatacaggctgcagatataatgagtgcttgtgcagtgtagttgagattcgcctttgcccaaggaaggacacggcagccaaccaacgtgggaactgcaaccacagtaccagctattgcggcgttctttgctcccagcagtacagcttctctgacggcggcgttggactcctcctccttgggggaccgaatcaggaaactcctgccagccatgctctctctctctctctctcgatctcgatcgatcgatcgactctggtagcttcctctggccgtcgttccgttgggggcagcagccgggcaggggatggcgagcgagctagagctaaaatagaagaatttgtttctccttgtgatggtggcgggggcgtggccggtgggcgagtggcaaggtcggacacggatcggaacgaacctgtacagcctcgtgtcatcccggccggcctcgaggtgccctaaacgacggcacaggcccactcagccttagccgccacactttatt

SEQ ID NO: 24657 - DNA, 958 bp, Zea mays
  misc_feature (921)..(921): n is a, c, g, or t
  misc_feature (923)..(923): n is a, c, g, or t
  misc_feature (933)..(933): n is a, c, g, or t
gagagaacaatcgctagatgctctagtaatttttttggaaggcctcgcgatgtgaagaaatcaatcctacatagaactggggccattcattcattcttttatttatttcattcattcatttcacccatgacaaatattatctcttcttatttcccacaacatttactggacattgtcatgatgttcagattagaagaatggcgcacgttggggaattcccttgcgtctgtgacgagcaaccctttttggtggtggttcttcgtagttcttgtcattgcagctgttttggtcatttgtagtacttgaaccaacattgtcaatcctagccacatgatccataccattggaccgagggttgttgccaaccatagcttgcataccagcttccatatttaagcctctaagattgcatccaagagagcagaagcgaaatgcatcaagtagcacacggctacatgtctcacagctatgtgttgatgatgtgggtgccttacaaatggggacactagaagcacgcagttgtggccgctcattcaggaatacaatccttgcactattgattacataagtttgcacatcgctgacatcaaggatatcctcaatctcggacaccctcacaacgtcatggtacgatgaacgccttatctggattacacggtgggtggaatgatcacttgaacgacaatagttacagaaagcagctggtttggtctcacactgggtgcaaaataggttacattcattgcgactagcaagaagatggttagcacaagtcgtaaagaattgtgttgcaagcaacagttctagccatgaaggcattgtctcccttttcattgtgaaatcagtggtctattgtgttctttgtgctaatgttccgcgccggccggccgcgtccgccgcgtccctttttttttttttttntntggggttttncccggccggcctcgagggacccaat

SEQ ID NO: 24658 - DNA, 1682 bp, Zea mays
  misc_feature (790)..(790): n is a, c, g, or t
cggcgacactaattttcagcgtcgcttgattgccgaacataagttattttttggaggccccgagcgaaaaccaccaaaaataagatattttcagcggctagggggcgaccgccgaaaattagtctttatttttaactaaattttttagcggctagaagccgccgaaaataggccatatgccgccgaaaataatatgttttcggcggtgtatgtcttattttcggtggcttctggccgccgaaaatgatcttgtgtcttgtagtgtttatgattcaaagtaaacctacggttagaactacttaagtcataaaggctatgattaaaactgtgtgcttccggtataacaattacatgctttgagagaacaatcgctagatgctctagtaattttttttgaaaggctcgcaatgtgaagaaatcaatcctacatagaactggggccattcattcattcttttatttatttcattcattcatttcacccatgacaaatattatctcttcttatttcccacaacatttactggacattgtcatgatgttcagattagaagaatggcgcacgttggggaattcccttgcgtctgtgacgagcaaccctttttggtggtggttcttcgtagttcttgtcattgcagctgttttggtcatttgtagtacttgaaccaacattgtcaatcctagccacatgatccataccattggaccgagggttgttgccaaccatagcttgcataccagcttccatatttaagcctctaagctgtaataaaggttagaagttttttanatatatttcttatttctgtacattaaaaaaataagatgcttagattgtctgtgataacttacattgcatccaagagagcagaagcgaaatgcatcaagtagcacacggctacatgtctcacagctatgtgttgatgatgtgggtgccttacaaatggggacactagaagcacgcagttgtggccgctcattcaggaatacaatccttgcactattgattacataagtttgcacatcgctgacatcaaggatatcctcaatctcggacaccctcacaacgtcatggtacgatgaacgccttatctgaaacatccaattattggaaacttcaatacaaccatgctttcatatgtgtgcttgcttaaataacccgtggactatgaatgaaatatatttttgtatgtgcaattttataacacacattatgtgatgtttttacacacttgtcttatttgcgaggcgacataataagcaacaagacaaagaacatcaaaactataaacttctgaattctatgacttgtatggtataaaatgtttgaattgcgaggtgccataataagaaacaagagaagatgaacgccttatctggattacacggtgggtggaatgatcacttgaacgacaatagttacagaaagcagctggtttggtctcacactgggtgcaaaataggttacattcattgcgactagcaagatgatggttagcacaagtcgtaaagaattgtgttgcaagcaacagttctagccatgaaggcgttgtctcccttttcattgtgaaatcagtggtctattgtgttctttgtgctaatgttccccgcgttaagtgaaaggaatggctgtacttataggaaaataacccggaaaagtccatgacttttcctgtaaattt

SEQ ID NO: 24659 - DNA, 1721 bp, Zea mays
aattcccatcagagaagagataaccacacgtccacacaccacagaccacacgcacggtacagcctctccgcagctgcaggtgcctgctgttctccgacgagaccccaagaactcgccaacctatcccaattcccagccacccttccctctttcacaatgctggcctccgccgccaccgtcaagccctccaccgccgcggccgcggccacctgcaaggcggccttcaagccgctccacctccctcccctccccgccgccgccggcctcaggccgctctccctctccgtctccgcgcgcccgctgtaccgtcaggagcatgtcctggcatccgtggcggtggcggcggctgggcgcaacgaacgcgccacgtcccccgcgccgccgtccgccaccgctgacggcgcccggccgctggaggtcgccgcgccggcggagacgggtcggcgcgccaagatcggggtctacttcgccacgtggtgggcgctgaacgttatcttcaacatctacaacaagaaggtcctcaacgcgttcccgtacccgtggctcacgtcgacgctctccctcgccgccggctccgccatcatgctcgcgtcctgggccaccaggatcgccgaggcgccccagacggacctcgatttctggaaggcgctgactcccgttgcgatcgcgcacacgatcgggcacgtggcggcgacggtgagcatggccaaggtggccgtgtcgttcacgcacatcatcaagagcggggagccggcattcagcgtgctcgtctccaggttcttcctcggcgagcacttcccggcgccggtctacttctccctcctccccatcatcggcggatgcgcgctcgccgccgtcaccgagctcaacttcaacatggttggattcatgggggcaatgatctccaacctggcattcgtcgtccggaccatcttctccaagaaggggatgaagggcaagtccgtgagcgggatgaactactacgcctgcctctccatcatgtcgctggtgatcctcctgcccttcgccgtcgccatggaggggcccaaggtgtgggcagcgggctggcagacagcagtcgccgagatcggtcccaacttcgtctggtgggtggcggcgcagagcgtgttctaccacctgtacaaccaggtgtcctacatgtccctggacgagatctcgcccctcaccttctccatcggcaacaccatgaagcgcatctccgtcatcgtcgcgtccatcatcatcttccagacgcccgtccagcccatcaacgcgctcggggccgccatcgccatcctcggaaccttcatctactcccaggccaagcagtagccgcccttggcgcgcgcgtctggctctcaggcctcagttcagttcaccgccgaatcagctcggcgctcgaagatataacagattatataacttttgaggatatctacctagcttgtataatagtattattactagatcctctcttctttttttcgtattttcttttttcctaggactagcttattactagatcatttcgtcgtcgtgttttcactatgactatgatggcgtagagagagagagagagatggatccatctaaataaaaaaaaaggtaccggatcttgttttgttaaaaaaaaaaaaaaaaaagcggccaaaaaaaaaaaaaaaaaaaaaaaaaaaaaaaaaaaaaaaaaaaaaaaaaaaaaaaaaaaaaaaaaaaaaaaa

SEQ ID NO: 24660 - DNA, 956 bp, Zea mays
agggatgctaagatacttattgtgtgacatagatcccctcacaaaaagagcagctgcctgcctgtgtagggacaacagatcacggttctgagatatgaactgtgtggtctgcaacggcctgctcgtcctgcagaagaaacaaaaccgatcattgccttgatacttgactgataatccagtttcgattcgtgtggctaagacttcctctgtggtgtggacgcacgtacgcaggtgggtggctgcgcagagcgtgttctaccacctgtacaaccaggtgtcgtacatgtcgctggacgagatctcgccgctcacgttctccatcggcaacaccatgaagaggatctccgtcatcgtcgcctccatcatcatcttccagacgcccgtccagcccatcaacgcgctcggagccgccatcgccatcctcggaaccttcatctactcccaggcaaagcagtaacgccttgcattaattggcgtctagatggcctgccctcatcagttcaccgcggatcagctcggtgctcgaagatgacagcttatgacctttgagaatgtctactaagaatcgccctttgtataatactactagatcctctcttttttggattttctttcctaggactagcttccagtgttactgggctcatttcgtggtgtttctattatgactaagattagagagagaatgagagatggatccatctaaataaaggttccagatttttttaaaaaaaaaaaaaataacgagaggtaggaaagggggggctatatatctacaacatattaaatataattaagacaatatatctctctctctctctctctctctctcactctagctaacatgcttctgctacctccacagtaacaaacggggggggccgccctcgcgtattctctgtctcaatatttacctccacttactctctttttactgcctggcgtcactccctaca

SEQ ID NO: 24661 - DNA, 3110 bp, Zea mays
taaaaagaaagaaaacatacttcagttttttcatataatcgttgtttttgtgtgcttctccacagttcgcggatacgtgtagggtttccactaaccccagcactcaaaaaaagaaagaaaagaaaaacacgattccgctgatccacctccatcccccattgggtacctcgaggccggccgggatccgcgtcactcaccagtctcctcccctaatcccactccgccgccgccagcttgcccatggcggcgacaacccacgccgcctccatgtcgttcctcctctctcacccccagtcgcgctctgccaccccaagccgccacctcccgctccgtccggcagcccgccgcgtccagtgcgccaccgacgccgccgccctttccccggcggtcaccaccaagcaccggcgcgcggcggatgagaacatccgcgaggaggcggcgcggcacccggccccgaagcagggcctgtcggcgtggtacgagcccttcccgccggccccgaacggcgaccccaacgagcgctactccctggacgagatcgtgtaccggtccagctcggggggcctcctcgacgtgcggcacgacatggaggcgctgtcccgcttctcgggcgcctactggcgcgacctcttcgactcccgcatcgggcgcaccacctggccgtacgggtccggcgtgtggtccaagaaggagttcgtgctccccgagatcgagcccgaccacatcgtctccctgttcgagggcaactcgaacctgttctgggccgagcggctggggcgcgaccacctcggcgggatgaacgacctgtgggtgaagcactgcggcatctcccacacggggtcgttcaaggacctcggcatgaccgtgctggtgagccaggtgaaccggctccgccgcgcgccgctgtcgcgccccatcgccggcgtcgggtgcgcgtccacgggggacacctcggccgcgctctccgcctactgcgccgccgcggggatcccggccatcgtcttcctccccgccaaccgcatctcgctggagcagctcatccagcccatcgccaacggcgccaccgtgctctcgctcgacaccgacttcgacgggtgcatgaggctcatcagggaggtgaccgccgagctgcctatctacctcgccaactcgctcaactccctccgcctcgaggggcagaagacggcggccatcgagatactgcagcagttcgactgggaggtgcccgactgggtgatcgtgccgggaggcaatctggggaacatatacgccttctacaaggggttcgagatgtgccgtgtcctcgggctcgtcgaccgcgtgccgcgcctcgtctgcgcgcaggcggccaacgcgaacccgctctacggctactacaagtcaggctggaccgagttccagccgcaggtggccaggccgacgttcgcgtcagcgatccagatcggcgacccggtgtccgtcgaccgggccgtggtggcgctcaaggcgacggacggcattgtcgaggaggcgacggaggaagagctcatgaacgcgatgtcgctcgccgaccgcaccgggatgttcgcctgcccgcacaccggggtcgcgctcgccgccctgttcaagctcagggagcagcgcgtcatcgggacgaacgaccgcaccgtggtcgtcagcacggctcacggcctcaagttctcgcagtcgaagatcgactaccatgacagcaagatcgaggacatggcttgcaagtactccaacccgcctgtgagcgtgaaggccgactttggcgccgtcatggatgtgctgaagaagaggctcaagggcaagctctgagcgcctgtgcctggctaatgcaatcaactgattggaatgcagtggtttcgtcggtatcggggggtcttttaggcttcagaaattctgtctgggttaggctatctgtttgtggagtttagcaggagaatggatctctctcctgcaagactggcgctctctcttgtgctgctacgatgtgttaccatggataataagtgacctagttgctgttggattgaataatcatcactcgctcctttgtcctctgtgctggcaatgcttgtcgagttctcatgtattgttgttttgatcattttggtgttgcaatgctggctgaaagctactggtgacagtggatgtcaaccttgctggtctggctgtgagttccggttgcagagatttgatgcctgaatttctgttggtgctccatgaccatgactcgcaccagcctgtccagccatcgtggcccaaagtagatattcgtgtgcatcgcagcctagatgcagtttgcaaatagtaagcggcaggccgacaattagcatcatcaccaataaggcgcaatcaagtagtatgaacgtggtccaaagtggatgacctggcttttcttttttttaggcaaagtagatggtcttgtatcctctttttatgcaaagtcgtaggtaatctgggtcggtgattttgggtctgtttggtttcggcccatttgttttgttttggcggcagatcggtgcttgtttgtcatttggacccgattaaatgcatccgatcaagttaatcatgtgctatgcgtttggttgatccaactgcaccgttgggcgagtgctagcatgatacattatcaggctataatacttactgtagcggggctacagattaagctccgtctgtattggccctgtttgtttgatctttttttagcttctggtcaccaaaatctgctgcatatcgttaaacgtcctagcttttaagctaacatatataaaaatcattttagtaaaaatcatccaaaattaacatgaacacaaaatcggtcgaattgtcatgattgtaggaatccaccgcatcctaaacctttggaccacatcatcttccttcatacttaatcaccatgatacttaaattcttaccatagctaaattctatgtatagacagatcctctgaaaaaatgagctgaatcaaacaggccgccacgccctgcctgctttatacggcaccgacgctagctacgcagagcgtgtcaatcgtctcacacgtcacacctgcctgccaaaacgagtccacgaccaaactcgtctggcaacggtagacccca

SEQ ID NO: 24662 - DNA, 1986 bp, Zea mays
  misc_feature (18)..(18): n is a, c, g, or t
cggccgggccgggaaagnagaaaagaaaatacgattcaactaatccacctccatccgcgtcactcaccagtctcctcccctaatcccactctgccgccgccagcttgcccaccatggcggccgccgcctccatgtcgttcctcctctcccacccccagtcgcgctctgccaccccaagccgccacctcccgctccgtccggcagcccgccgcgtccggtgcgccaccgacgccgccgccctttccccggcggtcaccaccaagcaccggcgcgcggcggatgagaacatccgcgaggaggcggcgcggcacccggccccgaagcagggcctgtcggcgtggtacgagcccttcccgccggccccgaacggcgaccccaacgagcgctactccctggacgagatcgtgtaccggtccagctcggggggcctcctcgacgtgcggcacgacatggaggcgctgtcccgcttctcgggcgcctactggcgcgacctcttcgactcccgcatcgggcgcaccacctggccgtacgggtccggcgtgtggtccaagaaggagttcgtgctccccgagatcgagcccgaccacatcgtctccctgttcgagggcaactcgaacctgttctgggccgagcggctcgggcgcgaccacctcggcgggatgaacgacctgtgggtgaagcactgcggcatctcccacacggggtcgttcaaggacctcggcatgaccgtgctggtgagccaggtgaaccggctccgccgcgcgccgctgtcgcgccccatcgccggcgtcgggtgcgcgtccacgggggacacctcggccgcgctctccgcctactgcgccgccgcggggatcccggccatcgtcttcctccccgccaaccgcatctcgctggagcagctcatccagcccatcgccaacggcgccaccgtgctctcgctcgacaccgacttcgacgggtgcatgcggctcatcagggaggtgaccgccgagctgcctatctacctcgccaactcgctcaactccctccgcctcgaggggcagaagacggcggccatcgagatactgcagcagttcgactgggaggtgcccgactgggtgatcgtgccgggaggcaacctggggaacatatacgccttctacaaggggttcgagatgtgccgtgtcctcgggctcgtcgaccgcgtgccgcggctcgtctgcgcgcaggcggccaacgcgaacccgctctacggctactacaagacaggctggaccgagttccagccgcaggtggccaggccgacgttcgcgtcagcgatccagatcggcgacccggtgtccgtcgaccgggccgtggtcgcgctcaaggcgacggacggcattgtcgaggaggcgacggaggaagagctcatgaacgcgatgtcgctcgccgaccgcacggggatgttcgcttgcccgcacaccggggtcgcgctcgccgccctgttcaagctcagggaccagcgcgtcatcgggacgaacgaccgcaccgtggtcgtcagcacggctcacggcctcaagttctcgcagtcgaagatcgactaccatgacagcaagatcgaggacatggcttgcaagtactccaacccgcctgtgagcgtgaaggccgactttggcgccgtcatggatgtgctgaagaagaggctcaagggcaagctctgagcgcctgtgcctggctaatgcaatcaactgattggaatgcagtggtttcgtcggtatcggggggtcttttaggcttcagaaattctgtctgggttagactatctgtttgtggagtttagcaggagaatggatatctctcctgcaagactggcgctctctattgtgctacgatgtgttaccatggataataagtgacctagttgctgttggattgaataatcatcactcgctcctttgccctctgtgctggcaatgcttgtcgagtactcatgtattgttgttttgatcaaaaaaaaaaaaaaaa

SEQ ID NO: 24663 - DNA, 1138 bp, Zea mays
  misc_feature (1126)..(1126): n is a, c, g, or t
gaacaggtctaccgtacacccatgtgtcagccactggacactgggttcctcaaacgtgtcgtctgcgtcactgccaatcaaacttggcactgcctacgccgcgtccaccaagagcctctcatagccttccttccggccgcagccttagccccatagacccatcccacgcaacaccttagcgacccaccgccctcctctccgctcccctcggtaaagccgaaatccctcccccacatcgcacggcgtacccgatctccaaatcgcccccccaaaccctcttcttcccccttcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaagcccatgatgtcggtggtgcccttctgcctcttcctgctcatggacatctactggaagtacgagacgcgccccacctgcgacgacgagcacgcctgcaccccctccgagcacctccgccaccagaagtccatcatgaagtcgcagcggaacgcgctcctcatcgccgccgcgctgctcctctactggatcctcttctccgtcacccagctcgtcgtcaggctcgagcagatgcagcagcgcgtcgacaagctcaggaagcgcgacgactgatggatccgcatccatccggtgggctcgttcttcctctgcctgccttgtgttcctgctttatgttgtggtgctgatgttttagatctcggatcgtaatttgagacctgctggtagcatttgcttcctttgccttgccgtcttcagataaaaaagaacagcgctcttggaaacgatgataatgtttaggatgtttggacgaatggtatctgtcgtaattgatgtcttcatccatgaattggttggtgtcactcaatgtacactgagatattggttaatagctactagtgctgtttttatcatgtgattatgcccatgctgtaatgagttagttcttgtttgtaataagatgacattagaggtcggattttatatcttgccaaaaaaaaaaaaaaaaaaanagctcgaggggg

SEQ ID NO: 24664 - DNA, 1420 bp, Zea mays
  misc_feature (13)..(13): n is a, c, g, or t
ccgggatctccgntctaaacgaaaggaacaacaaaacttcattttcttggatgtgcgctgtgttcaggatttcagattgttcaacggagaacctccacgcgtcgtgagagcgcgagctctgaccgaagatctcagtggtcggcaccaaatttcgcgtgcacacctgcgcatccggcccttcccgtacgcccatgactcagccaccgcgttccgcgaacgtgtcgtccgtgtagcatccatagagacccgtcccacgcaaacacctcagcgatccaccgccctccctcttcgctaaagccgtaatccgaaatcccgcccccagacccagattgcacgacgcaaccgatccccaaatccccaaatcttcccagttccctcctcccgctcgacccagatcgaggcctcgatccaccggccatggcgctggagtgggtggtgctgggctacgcggcgggcgcggaggcggtcatgctgctgctgctgacgctgccggggctggacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcaccccctccgagcacctccgccaccacaagtccgtcatgaagtcgcagcgcaacgcgctcctcatcgccgccgcgctcctcctctactggatcctcttctccgtcacccagctcgtcgtcaggctcgaccagatgcagcagcgcgtcgacaagctcaagaagcgcgacgactgatggggctcgcgttcgcgccttccccgcgtccacccggtggtctcgttcttccctcttcctcgtatttctgtttttttttaatgttggagtgcggatgtcttagatctcgatcgtaatttgaggcatggtgcttcctttgcccttaccgtcttcagataaaaagaacaacgctctttgaaatgatgatatatttaggatgtttggacaaatggtatcgtaattgatgtgttcaccaatgagttgattggtttcactcgagatacaccgagatatgggtctagttgccatccttgagatattggttattagctactagtgctgttttgatgatgtgactgagcttatgttgtaatgagctagttcttgttcagaataagctgacattaggggccggattttatatcttttgtataaaaaatgagctccaacttggaagctagtcgtgtagctgttctagttctagactgagatgctcatctagtgatcaggtgacatgaatgaatggatagtcacgtttgctgcaaaactgttctatcttctagactggaatgcttatataggtgattcaagtcaaaaaaaaaaaaaaaaaaaccttagaaaaaaa

SEQ ID NO: 24665 - DNA, 847 bp, Zea mays
tctaactccaacctacccagcctcggccagccacctccccgtcgctctcacgctcttcgtgcccgccgccagatcgcacgacgcaaccgatccccaaatcttcccagttcccccctcccgctcgacccagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcaccccctccgagcacctccgccaccacaagtccgtcatgaagtcgcagcgcaacgcgctcctcatcgccgccgcgctcctcctttaatggatccttttttccgtcacccagcttgtcgtcaggctcgaccagatgcagcagcgcgtcgacaagctcaagaagcgcgacgactgatggggctcgcgttcgcgccttccccgcgtccacccggtggtttcgtttttcccttttcctcgcatttctgtttttttttaatgttggagtgcggaaataaaagatctcgatcgtaatttgaggcatggtgcttcctttgcccttaccgtcttcagataaaaagaacaacgctctttgaaatgatgatatatttaggatgtttggacaaatggtatcgtaattgatgtgttccccaatgagttgattggtttcactcgagaaaaaaaaaaaaaaaaaggttttaaaaaaaaaaaaa

SEQ ID NO: 24666 - DNA, 914 bp, Zea mays
cattgggacccccgtggccggcccgggtagcatccatagagacccgtcccacgcaaacacctcagcgatccaccgccctccctcttcgctaaagccgtaatccgaaatcccgcccccagacccagatcgcacgacgcaaccgatccccaaatcttcccagttcccccctcccgctcgacccagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcaccccctccgagcacctccgccaccacaagtccgtcatgaagtcgcagcgcaacgcgctcctcatcgccgccgcgctcctcctctactggatcctcttctccgtcacccagctcgtcgtcaggctcgaccagatgcagcagcgcgtcgacaagctcaagaagcgcgacgactgatggggctcgcgttcgcgccttccccgcgtccacccggtggtctcgttcttccctctgcctcgtactttctgtttttttttcatgttggagtgcggatgtcttagatctcgatcgtaatttgaggcatggtgcttcctttgcccttaccgtcttcagataaaaagaacaacgctctttgaaatgatgatatatttatttaggatgtttggacaaatggtatcgtaattgatgtgttcaccaatgaggtgattggtttccctcgagatacaccgagatatgggtctagttgccatccctgagatattggtt

SEQ ID NO: 24667 - DNA, 942 bp, Zea mays
ggccaaaacattggtacccattgtataaactggaacatgcattactttttttagcccctgggcaagttgccctagctggcctgaacattgcacaacactgaaaataatacttactcagttctcgaatatttggcgcccggtagttcatttttaaactaaaccgggattttttttttttttttgaaggagtaaataacttctgataataccaggccaacacattcaccacttgcgctctgccttctgaactaggctccaacccttgttcttaggtgtacaaaagacaagggtactagttgagaacaacaattttctgtcttttattgggcttctttcctttcgctggacccatctccgcgtcatcaggacttttacacttattatctttgtcagacatgacaggtttgtcatcagcatcttcatcgctgtcatcactatcatcttccgagtcagatgagctgcaagcaaatgacatttctgaagtctggcggccgtttattgtcgcttcagctgcctccacagcctgctctgaatgaagatcagcgacacctagaagcagatccatctcaatgcattgacatagaaagaacatcatgcaaacataagttcaaacagcttggacctcaagctttcctccatgatgcagctgagacaacatattacaaatatactatccctctcaccatctcaatgtattgctcctcgttcccagtaagggcttcaatatcgtactccacaggaggcttgttctgcaattgcacggatacgatttaaccacatcgtgaataacatgattaatgcaaaactggttagaatcttataattgtacctgtgcatcaagctgcaacttttggttggcccttgcaatctcccccaagaaatccttcactttcccgataactgacaccccaaaacaatcaatcaaaattcagtgaactggca

SEQ ID NO: 24668 - DNA, 1224 bp, Zea mays
  misc_feature (1208)..(1208): n is a, c, g, or t
  misc_feature (1216)..(1217): n is a, c, g, or t
tccaccgcggtggcggccccccttttggaacgcattgtataaactggaatatgcattacttcttttagcccccgtgcacgttgccctagctggcctgaacattgcacaacactgaaaaaaatacaacctcccttctcgaatatttgtcccctgttcatttttaaactaaaccgtgacaaataaaaaagaacagagagagtccctccgtaacttctgataataccaggccaacacattcaccacttgcgctccagcccttgttcttaggtgtacagaagacaagggtactagttgagaacaacaattttctgtcttttattgggcttctttcctttcgctggacccatctccgcatcatcaggacttttacatttattatctttgtcagacgtgagaggtttgtcatcagcatcttcatcgctgtcatcactatcatcttccgagtcagatgagctgcaagcaaatgacatttctgaagtctggcgtccgtttattgttgcttcagctgcctccacagcctgctctgaatgaagatcagcgacacctagaagcagatccatctcaatgtattcctcctcgttcccagtaagggcttcaatatcgtactccacaggaggcttgttctgtgcatcaagctgcaacttctggttggcccttgcaatctcccccaagaaatccttcactttcccgataacttggcttttgggcaggggatcagtggacgcccccaacttacgctttccctccttatcctgctgctgctgctccctgccagcgagaagcgactcgatgaaggaggcgggaggcctggggtcggagggcaggtccaggagctccttgctcgactctcccatggtgttccttggtgtcggagctcggaaagtcgggcgagcggcgagtcgcgaggaagagtctgcggcggcggcggcggcggcgggaggaggagtagggctcggcgccacgactggaacttgttaaaaggtgcggggcctggtatggtgggcgctcttcaccggtaaagcgcccgacgaagacctgggcagctgggcgaagggcggcggcggcagtcgccctagtcgccgcaagcgaggcgtggacgcaggagagcgactctcgggagtagctcgcgctcggccggcctcggggtgccctttttttttttttatttttttttttttttttttttttttttttgtattttttttttnccggccgnngcctcga

SEQ ID NO: 24669 - DNA, 1226 bp, Zea mays
ggccgcttttttttttttttttttgtttttttttttttttttttttggtacgcattgtataaactggaacatgcattacttcttttagctcctgtgcaagttgccctagctggcctgaacattgcacaacactgaaaaaaaatacaacctcctttctcaactatagttcatttttaaacttagttcatttttaaactaaaccgtgaaggagtaaataacttctgataataccaggccaacacattcaccacttgcgctctgccttctgaactaggctccaacccttgttcttaggtgtacaaaagacaagggtactagttgagaacaacaattttctgtcttttattgggcttctttcctttcgctggacccatctccgcgtcatcaggacttttacacttattatctttgtcagacatgacaggtttgtcatcagcatcttcatcgctgtcatcactatcatcttccgagtcagatgagctgcaagcaaatgacatttctgaagtctggcggccgtttattgttgcttcagctgcctccacagcctgctctgaatgaagatcagcgacacctagaagcagatccatctcaatgtattgctcctcgttcccagtaagggcttcaatatcgtactccacaggaggcttgttctgtgcatcaagctgcaacttctggttggcccttgcaatctcccccaagaaatccttcactttcccgataacttggcttttgggcaggggatcagtggacgcccccaacttacgctttccctccttatcctgctgctgctgctccctgccagcgagaagcgactcgatgaaggaggcgggaggcctggggtcggagggcaggtccaggagctccttgctcgactctcccatggtgctcctgtaaagtgagttagtttgccagtggcgcggtggagacgcctcgaggtcgtaggtgcagcgtggtagtcagacactcagaccttggtgtcggagctcggaaagtcgggcgagcggcgagtcgcgaggaagaatctgcggcggcggcgggaggagtgaggaggagtagggctcggcgccacgactggaacttgttaaaaggtgcggggcctggtatggtgggcgctcttcaccggtaaagcgcccgacgaagacctgggcagctgggcgaagggcggcggcggcagtcgccctagtcgccgcaagcgaggcgtggacgcaggagagcgactcttcaaa

SEQ ID NO: 24670 - DNA, 1831 bp, Zea mays
  misc_feature (1588)..(1648): n is a, c, g, or t
  misc_feature (1652)..(1656): n is a, c, g, or t
  misc_feature (1661)..(1665): n is a, c, g, or t
  misc_feature (1670)..(1681): n is a, c, g, or t
  misc_feature (1691)..(1702): n is a, c, g, or t
  misc_feature (1714)..(1718): n is a, c, g, or t
  misc_feature (1740)..(1744): n is a, c, g, or t
  misc_feature (1749)..(1760): n is a, c, g, or t
  misc_feature (1764)..(1815): n is a, c, g, or t
attttttttttaatgaagaggttcgtgcacgcactgtgttcaacgcaattccaattttctatccgagtgatgagtgactgtgcacatacatcgtactacaggtgggacccgcttactagatcagattctaacatcctgttcgtggagtcgtctcggcggcggcggaacaagccgggaacctaccgcaaagggcgccaccgatgctaaagccacagacgtcgtggacagcttccctccctctccttctcatccgccgctgctcgagaaccgcggccagtccatctcctgccggtgaccggccgctctcctttgtcccggtctgcaagcggcggatgagcacgctggcgcatcccaggtttgcccctctccctacggagcaaactgaatcccaaacagatggcggggctgcacggtaccagttccggctggtctcttacaacatcttggcccaggtttatgttaagagtacgctttttcctcattccccatctgcgtgcctcaagtggaaatctcgatcgggagctattcttacagaactaaagagctttgatgctgacttcatgtgcatacaggagttggatgaatatgataccttctataagaaaaacatggaaaactctggatattcaagtatttacattcagcgatctggagacaaacgagatggctgtggtatattctataaacctaaaagtgcagaactggtgcagaaagaagtaatactgtacaatgatttagtagaaaaatatgttcctagtgataatgtaaatagtgctctggaaaataattcttcagcagaagaagacaagaatgcaaagccagataatagcaagcgtggagatccaaatgatccacgcgttagattgaagcgggactgtgttggtttactcgcggctttcaagcttagtgatccttgtgatcaaattttgattgtggcaaacacacatatttattgggacccacaatggatcgatgtaaagttggctcaggcaaaatatcttctttcgagagtatctcagtttgagcaactcatctcaaataaatataattgtaaaccttcagtgatcattgctggtgacttcaattcgacacctggtgacaaggtatacaattaccttttatctgccaacctaggatctacggacgaagctccaatcaagttacgcagcctttatgctgcgaatggaggggagccagagtacacaaactacactcctggttttaccggaacactggactacatattcttgtcggatggtagttcgataaaacctactagcctacttcgtttgccgcgaggggattctgaggatgtgaaaggaggcttgcccaactttcgacatcctagcgatcatctcccaattggtgctgattttctggtagtcaacatctagtgcaggtgttgattgctttttcaacagaaatagtaaatgccgttgaataatttgtgttgttggctcaagtttcagagtttaaatgtaatatctcaaggaacaagcgtttcttttcttgtagagcaattaacaatgcgaattttattcatcaattttaatataataggagtattgtctataaaaaaaaaaaaaannnnnnnnnnnnnnnnnnnnnnnnnnnnnnnnnnnnnnnnnnnnnnnnnnnnnnnnnnnnntttnnnnnaaaannnnntcgtnnnnnnnnnnnnaaagggcgcnnnnnnnnnnnngcctggaggggnnnnncccggggtttacccaattaaannnnnttggnnnnnnnnnnnntttnnnnnnnnnnnnnnnnnnnnnnnnnnnnnnnnnnnnnnnnnnnnnnnnnnnnttgccacacccgaagg

SEQ ID NO: 24671 - DNA, 3625 bp, Zea mays
ggaaactacccaacccacccgcccaccacttcttctcacgcgtcccgccgcggcgccacacgctgcaccggtctcacgccccccacgacgccgtggggccctgtcggtggaccaggcccacggttggctcttcctcgcttcctcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccagttcggtgcctggctgactccgcgcgtcttccccccttttccctcccgcggccgacgaccgtccgtcccccaccgcatccaggagcgaccctccctcgtgctcgtcgacgatcgaccggccgccgatcgtccaggtactgcgcaagctcatcaccgccgcagcttcgctgctcgcttcttactgcctagctggggtttgtggttctgtttcgtaccgcaactgattcatcatcgaaacggaagccgacaccaccaaggccgagcgacttgctgagacggacaaggtactctagtccacgacgaacgaaattgagcttatggattccctgttcttctcaggaaggatgtcgagcctcgaggagccgctgggtctcggagacctgcctaagttgagtattaacagactcgggcggttcgtgtcgctgggcgctcggaggccaccggccgacgacgacgaccacagcactggcaagtaagtgtagccatatacgtatggtatggatactatatccctatgagcagttgacgtgcacaactcatcaaggcccccagatggggtgagaccgccagcagcagtgtcgttcgttcgtccgtgcgttctgccgaatgcttttggttgtttgaagttcgtaattgtttgctcggctttcagatacagcagcagctcctgcaacaatggcagccatcagatggccttccatcatggcagcaactcctcctatccctggcacccgcagtgccgccaggccgccgatccatcacgcgatgcagtggagcttagagatctccctcgcaaggtatttttcgcctttgcacccccaccgcatcagccagcctagcttgtcgatcgatcgaccgacagtacgtccctcacccaggtcatgtgggagctgccgaggttcgtgaagatagtggaggtggggcctcgggacggcctgcagaacgagaagggcaacgtcccggcgtccgtgaagatccagctgatacacaagctggtcggcgcgggcctgtcggttgtcgaggccaccagcttcgtctccccaaagtgggtgccgcaggtgacgtgcatgtagcctactaccatagtgccatggctcttccatggaaaaaaaaggtcatcaagttcttatctagcacagtacgtttggcaactgcagctagccgacgcagaggaggtgctgaagggtataaagcaggagccaggcgtgcggtacccggtgctaacacctaacctcagagtgagatctactccgccaccgttttcctttttcctctaagaaacctacgtgtattctgctactactagtagagtcgagaagaaggtgtgggtacggtctgtgcatgatgaatcatgagtcgagcgcttttccaggggttcgaggctgccatcgcagccggcgcgaaggaaatcgcggtcttcgcgtccgcgtctgaatccttctccaggtccaacatcaactgcaccatcgaggagagccttgctcggtaccgcggcgtcacagcggctgccaagaaacacgggctaagcatccgggggtaagtgagtcgatcgatttttctttctttctttcccgcctcttcaagtccgtgtgatgtggtctgaattcctctgttggtctctcaggtacgtgtcatgtgtgattgcttgccccgttggaggcgcaaccgatccggcgaaggtggcgtacgtagctaaggagctgtataccatgggctgctcggagatctcgctcggcgacacgactggtgtcgggacaccaggtgtactactggttctctctgcctatgctatgccgaacccgttcgtggctctcagtcgttttctggacagtacgtggagagaccggccaaaaactatactcactgcgatttgcaaacgtctctgcctcaggtagcgtggttgctatgcttcaagctgtcatgtcgtttgtcccggtggacaagattgccgttcatttccacgatacgtacgggcaggcccttgccaacatcctcgtctcccttcaagtaagcaaagcaacggtatgtttcgtcattggtctacgacattcatagagatatgcctaacacacacagacacacacatacacattcattgtctcgtcagatggggatcaacatagtggactcgtcggtgtcgggccttggaggctgcccgtatgccaagggcgccactggcaacgtcgccacggaggatgtcgtgtacatgctccatggcctggggatcgagaccaacgtcgacctcaacaagctcatggaggctggtgactacatctccaagcatctgggcaggccgctgggttccaagaccgccactgctctccgcaagctgaccgcctgaaaaaaccttttcaagcactcccaagagaaatgtatcggttcgaggtcccatctctcagtcatatgaatgtcctgtagttttactttatgctttttttccgctcagacattgcctactctgagcattttattcacacactttgtacccgccgttggatgattctgaataatcttggtgttcctggacgcgagttatgtttgcggaaacgagtgtacggacaaatgtatcagaatatctcggttaacgatctaaacaacaaatgctgctgcaacagtttcttgctgccggacaatctcgtgtttcttacatgcacatgtatcagaatatcacggttaaggataaggatctaggcagtaaattagcaaaactaatggaagcatgcgcctatctcccctgccatatgacacaaaacggagggagaactatgccgtattctgtaccacatgcatacatccgaatgagtttcgaatcaccaagagaactttactatgtatcggaacgagtttacaatcaccatgagaactttgcgtgttccctcttctggtttctaatccgtcgtcatggttactccagggagagctttaagaatggccaggcattccttcagaatcgcctttgcttgttcgcttttttcagactcgcagagctctgtgagttcatcctcgaacttggcctctgttctgttcgacagcgggaagtctctgtacagtttgctcaaatcaagaaggcactccgatgcagcaacgtgaacctgcaaaaacacaggtgatcaattgtggctcgtgagggtaaggtttgctctggacactaacagctaatggcaaactcaacaaccgcttctaaaaccactggtttaagaaacaaccatgtgttctgttttattatttagca

SEQ ID NO: 24672 - DNA, 1817 bp, Zea mays
  misc_feature (1810)..(1810): n is a, c, g, or t
ctgacggacggacgggctgaggcaaggccgcctgcgggcgggaggaagaaaagccatgcggtacccccgggccggccgccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgtcttccccccttttccctccctcgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcccaagttgagtattaacagactcgggcggttcgtgtcgctgggcgctcggaggccaccggccgacgacgacgaccacagcactggcaaatacagcagcagctcctgcaacaatggcagccctcagatggcattccatcatggcagcaactcctcctatccctggcacccgcagtgccgccaggccgccgatccatcacgcgatgcagtggagcttagagatctccctcgcaaggtcatgtgggagctgccgaggttcgtgaagatagtggaggtggggcctcgggacggcctgcagaacgagaagggcaacgtcccggcgtccgtgaagatccagctgatacacaagctggtcggcgcgggcctgtcggttgtcgaggccaccagcttcgtctccccaaagtgggtgccgcagctagccgacgcagaggaggtgctgaagggtataaagcaggagccaggcgtgcggtacccggtgctaacacctaacctcagagggttcgaggctgccatcgcagccggcgcgaaggaaatcgcggtcttcgcgtccgcgtctgaatccttctccaggtccaacatcaactgcaccatcgaggagagccttgctcggtaccgcggcgtcacagcggctgccaagaaacacgggctaagcatccgggggtacgtgtcatgtgtgattgcttgccccgttggaggcgcaaccgatccggcgaaggtggcgtacgtagctaaggagctgtataccatgggctgctcggagatctcgctcggcgacacgactggtgtcgggacaccaggtagcgtggttgctatgcttcaagctgtcatgtcgtttgtcccggtggacaagattgccgttcatttccacgatacgtacgggcaggcccttgccaacatcctcgtctcccttcaaatggggatcaacatagtggactcgtcggtgtcgggccttggaggctgcccgtatgccaagggcgccactggcaacgtcgccacggaggatgtcgtgtacatgctccatggcctggggatcgagaccaacgtcgacctcaacaagctcatggaggctggtgactacatctccaagcatctgggcaggccgctgggttccaagaccgccactgctctccgcaagctgaccgcctgaaaaaaccttttcaagcactcccaagagaaatgtatcggttcgaggtcccatctctcagtcatatgaatgtcctgtagttttactttatgctttttttccgctcagacattgcctactctgagcattttattcacacactttgtacccgccgttggatgattctgaataatcttggtgttcctggacgcgagttatgtttgcggaaacgagtgtacggacaaatgtatcagaatatctcggttaacgatctagacaacaaaaaaaaaaaaaaaaaactcgagagncttgaag

SEQ ID NO: 24673 - DNA, 1159 bp, Zea mays
aaccccacttcttctcacgcgtcccgccgcggcgccacacgctgcaccggtctcacgccccccgacgccgtggggccctgtcggtggaccaggcccacggttggctcttcctcgcttcctcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgtcttccccccttttccctccctcgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcccaagttgagtattaacagactcgggcggttcgtgtcgctgggcgctcggaggccaccggccgacgacgacgaccacagcactggcaaatacagcagcagctcctgcaacaatggcagccctcagatggcattccatcatggcagcaactcctcctatccctggcacccgcagtgccgccaggccgccgatccatcacgcgatgcagtggagcttagagatctccctcgcaaggtcatgtgggagctgccgaggttcgtgaagatagtggaggtggggcctcgggacggcctgcagaacgagaagggcaacgtcccggcgtccgtgaagatccagctgatacacaagctggtcggcgcgggcctgtcggttgtcgaggccaccagcttcgtctccccaaactagccgacgcagaggaggtgctgaagggtataaagcaggagccaggcgtgcggtacccggtgctaacacctaacctcagagggttcgaggctgccatcgcagccggcgcgaaggaaatcgcggtcttcgcgtccgcgtctgaatccttctcccagtccaacatcaactgcaccatcgaggagagccttgctcggtaccgcggcgtcaca

SEQ ID NO: 24674 - DNA, 1262 bp, Zea mays
actcctatgggcgattgggttccgcccgaatacccaccgggtccgacccgtctgccgctgtgccgcaccccgcacgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaacccgtgtagctttgtccaaactatctaaaaagggtttaagaatacataccttgtatcatactgctgtttggcgatcggctgctcgacagaggaggaattcccctccctggagagtgtagtggcaaagcagcgcggctttcgccactgcgatcgtgctagaacgagcaaacaaaaacgaagtgcgggtgtgcatactcagagtatatctgtaccttgttaccctgattcttttgtatgtaatatgggctctgcctgactttcactgtgtgatcaaatttccaagcccgtgggcgctgttgctgcgtgccttgttattagtgaataacaaacattgcaaatggttcttgaaatgcaggtgtgtgtgtgtttttatctaacatgtatgttaatcagcaggtgccaccatttgctgttccagactgataatgcagagtttgtatccacgttctttggagaaaacatttgaggct

SEQ ID NO: 24675 - DNA, 1048 bp, Zea mays
ccggccgcgaccggttaaccacccgtctgccgctgtgccgcaccccgcacgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaacccgtatagctttgtccaaactatctaaaaagggtttaagaatacataccttgtatcatactgctgtttggcgatcggctgctcgacggaggaatccccctccctggagagcgtagtggcaaggcagcgctgctttcgccactgcgatcgtgctagaacgagccaaaaaaaaaaacgaagtgcgggtgtgcatactcagagtatatctgtagcttgttaccccttgattcttttgtatgtaatatgggctctgcctgactttcactgtgtgatcaaatttccaagcccgtgggcgctgttgctgcgtgccttgttattagtgaataacaaacattgcaaatggctcttgaaatacagtgtgtgtgtgttttaatctctctgcatttatgttaatc

SEQ ID NO: 24676 - DNA, 1722 bp, Zea mays
  misc_feature (1691)..(1692): n is a, c, g, or t
  misc_feature (1704)..(1704): n is a, c, g, or t
gcacgagaccattacctagaacatcctaatcgaaaagaccgaataaccacccgtctgccgctgtgccgcacggcccgcaccccgcacgagacccgtccttgaggggcacgtcctagatcggtggcgccttcctctcgccgccgatacggtgcctctcgcggtctcgctccccctcgcaggtcttttggtttttttagttcctccctttgcttcttggaggtgtttgttgccgtctcacccgcagttcttgaggtacgcacgcagtaatccggcttctttctatgttccgatgtcttgctggttggatgaggagggtacgacgctctgtggagagatctaatcgcgctggtaaactggggcgatcggtgtgggggaatcggatagcgtggatgggatttgggattggaagagaagctggaggatgccttttttctggatgacggtgataatcgtggacgagctaagctcattgagtgtctggctgatgtgggattgggtggcatatgctggattgctaactgttccatctggtgcaccaagaattggactgcactggggttgggattgggattgggatgggattgctttgcctttgattgtgtatatgcttattatgtgctcatccgctgtggctttggccggaactttgcagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactacctgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaaccgtgtgtagctttgtccaaactatctaaaaagggtttaagaatacataccttgtatcatactgctgtttggcgatcggctgctcgacggaggaatccccctccctggagagcgtagtggcaaagcagcgaggctttcgccactgcgaacgagccaaaaaaaaacgaagtgcgggtgtgcatactcagagtatatctgtagcttgttaccccttgattcttttgtatgtaatatgggctctgcctgactttcactgtgtgatcaaatttccaagcccgtgggcgctgttgctgcgtgccttgttattagtgaataacaaacattgcaaatggctcttgaaatacagtgtgtgtgtgttttaatctctctgcatttatgttaatcagcaggtgccaccatttgctgttccagactgataatgcagagtttgtatccacgttctttggagaaaacatttgaggctcatacgctgtttcataaacccatnngtatattttctntgaaaaaaaaaaaaaaaa

SEQ ID NO: 24677 - DNA, 4015 bp, Zea mays
ctgtcaacggagccaaaccgatgcgagcgtgcgtgcgttcgtggggaacacggtcggccaggcgaacggggtgaacgacaaagcccctcgacctccagttctgcgacttcacggacgagaagaccaatctgaagggcaagtccctagcggcctagccgcggcgctgatgtccgaggcaaagtttaacggcgccgacatgtccgactccgaagtcgtcgtcatgtccaaagcttacgctgtcggtgcaagtttcaaacgtggtaaggctattcacactgcattgttccctctgtatccttacttaatacttaccctacactactatttgaaatctagtcagcaaaattacttagtctgtattataattttctgcactcatatcgctcctctgtatattatctccatatcaactgccacatattctatccatctccattctactaccacacatcgtcgctaccgactgtatcggcagcggaaatatttgtttgccccatatatagcagagtagtactcctacgagaccacatacagagatgaaaagcgcacaccgctacacaattttttttttctggatcgcgttatatgtatccatgttacaggagctttactgggccgcagatagtctaagtccatctccaggaggagcgcgtatataaacatgtaaaatattgttttatattgttggctacgctgttttttagtgtgaagtttaaactgtggagtgggaatagatagggagtaggataggagaactgatcgccgcaccctttctttatttttttaagaaaaaaaatgtacagattacatatattctgctgttctggctcactactgcacagcgatgttggatcgtttactgagacggtgatgctgaacggacaggtcaggatgatgagctctctcttctggttcaaatgcgtttcaggaaccgacttcgcgtcgatttcgagaaggccgcgccgatggaagattggagctgggctttaggtgcctctggttcgatatcgtccgttgtgtgttcctgcggtcctgccttgcctgcccctgtctatagagccaccacatgagcgaaagccgcggtccctagcagaaaagacatgatgccgattttctgtgtatgcacagtacaaacctctgtgtatctcaaatgtcagcagcaatgtaaaccatccttctcagttctttagacacttgcaaactcaaacaccacatctagatatataaaaacacagatatatatattgttgttgttgctcacaaacgcagttatatataacagcattgctactatctcacgacgcatgctttcgtgccgccgcccgcgctggtactatgcatcacacgctctaacatgcgctagcagctttgccaacattattattgttcgcttcctggccctgcatgggctggctgcctccttgacgcgcacatgcatctagcacactggaaaacttgcacctatctacaacggccggcgctgctcatggatgatatatactacgcttgctgcatagccatcttgcgccgccgggcatgcatgcatgcggcacgacgtacggcgatacctagacgcgccatctaaatggccggcccgccggccggccggggcacttgccggtggtaaaggtaaggtcgtcgcgtcgcgtcgtcgtctttttcttgtctgcttttggattgtgtctccgatcccaagggcgctagctgcgcggttcaatccgcgtcgttgccgtcgctctgcctgccggtgtccatgaggcaggtctcgacgccgccggtcatccataggaaccacgcgtagctgctccggtggtggctgctctcgggctccgcgtcaatggcgccggtgaacatgtcctccgcgccgcccgtgtcgccgcgggcgtgccacaggaacatgccgcacctccgcatcgcttcgccgtccgccggctcggcggccaccgcctgcttgaagtacatctccgccctgcagccgtcagtcacacgtgtgccgtggtcacgacgcgtaagaaacccaagaccatcctaatcacaggtcagtttggatcatgtgatcgtctcgtctggatgaaagagttgtcagttgcgtttgcatgtcatgcatgcatgcacacacacccacctctcgatgtccttgtcgatctcgtacaggagctgcgcgtagttggacaggatgagcgagctggcgccgcctgaggcgatggccatctcgtacgccgccttccggcgccgcgcgcgggcgctgtcgatctccttgacctcttcctcgtcgagttcctcctgcgccccgtagctgctgtccccgaacaggccgccgccgccatgcaagatgccgatctgggcccagagcgccttctccacgtccgcctccaccagctgcggcatgtcgtggtcctcgggctcctccgcgggggccccgttgccgtcggggcggtcggcccccgcgttgcccgccggcgccgcctcgggcttcctcgcctccacgcggcacctctccgcctccacgatcgtgccgaggcagcaggcgaccatcccgagcagcccgacggcgaggtcgggcgactggaggtggaccttgctgaacacccacgccacggcgtccccggcgccgcgcgcggcctccgcggcgcccccggccgccgcgccctggacggcctccacggccttgacgagggccgccacggcgcacccggccgcgctcgtggccgtcgcccgcggcaccccgcgctgcgccgcctcctgcttcctcctggcctggatggcgcgcagcgacgccggcatcgcggccatggacggcggctgctggtcgtccccgccgcacgccgcgggcctcgaggaccggccgttcctccgcaccccggccctcgcgggcgccgggaacgccgccaagggcaacgccccgacgctcctgggcgcggcgaccacgctcgccggcgtcatcctcgcgatcgaccgaccagggaggggaggccggaggagcgacgcaaacggaagggtgttgtgttgcttatgatcgaacggagcctacaacctaaggcggactcccgtcccgtgcccgtcggccttcccgtggggcaatggcggcatttatagcccccgggccgtgccacattgggaaatggtcgtgctcctggacaatgcgtgccttgcgcgccagttcgggccagttcatcgcctgcttatttcgtcgcggagcatgggggaaaaaataaaggctcggctgcgcgctgctctcggcgagggttgttttggccgcgcgcggtgccagctcacgctcctgtgacgcccacggcgatctggcgtggcatagcaccgtggtatggtttccaacctggacggaaacgtggcctctgccgatccgagcaggagaactggccggagagggataccggaagaaagactaaccagtaaccaatcacttacaagattgattaatatgtccaaaaattaatatattgtttactttttaaggggagaaagagagcagtgaagaaattactgagactcaggttcccgctgcatctgcatgtgacagcgttccgcgtgttccaagctgcgcatcgtttatgtagaattgttataggagaacttgaaatgaaacttaacgagttggattgattgcttagatttatatctcttttcttctatagcgaaactcgtttaagtgagtgtttgaatgcaatggaactaatagttaattgattaaacattattagtgaaattagctagctaacaaatagttatttaactattaactaatttaccgaaaataactgatagttgaactattaatcagagtgtttggatatctcaactaattttagtcactaattattaactctgatgctttcaaacactccctaattatcctaatgtttaaccatcgtcgtccatagcgtgtcatgcgatgtgtctacaccaaaccaatgtgcggtacggttgtggcatttactacacataaaaaaggggggaaacagatgtgtgtggtccatatcacttttaccgatccgac

SEQ ID NO: 24678 - DNA, 1315 bp, Zea mays
tttttttttttttttttggccccgccctttttttttttttatataaaaacacagatatatattattgttgttgttcacaaacgcagttatatataacagcattgctactatctcacgacgcatgctttattccacatactactatagtactatgcatcacacgctctaacatgcgctagcagctttgccaacattattattgttcgcttcctggccctgcatgggctggctgcctccttgacgcgcacatgcatctagcacactggaaaacttgcacctatctacaacggccggcgctgctcatggatgatatatactacgcttgctgcatagccatcttgcgccgccgggcatgcatgcatgcggcacgacgtacggcgatacctagacgcgccatctaaatggccggcccgccggccggccggggcacttgccggtggtaaaggtaaggtcgtcgcgtcgtcgtctttttcttgtctgcttttggattgtgtctccgatcccaagggcgctagctgcgcggttcaatccgcgtcgttgccgtcgctctgcctgccggtgtccatgaggcaggtctcgacgccgccggtcatccataggaaccacgcgtagctgctccggtggtggctgctctcgggctccgcgtcaatggcgccggtgaacatgtcctccgcgccgcccgtgtcgccgcgggcgtgccacaggaacatgccgtacctccgcatcgcttcgccgtccgccggctcggcggccaccgcctgcttgaagtacatctccgccctctcgatgtccttgtcgaactcgtacaggagctgcgcgtagttggacaggatgagcgagctggcgccgcctgaggcgatggccatctcgtaggccgccttccggcgccgcgcgcgggcgctgtcgatctccttgacctcttcctcgtcaagttcctcctgcgccccgtacctgctgtccccgaacaggccgccgccgccatgcaagatgccgatctgggcccagagcgccttctccacgtccgcctccaccagctgcggcatgtcgtggtcctcgggctcctccgcgggggccccgttgccgtcggggcggtcggcccccgcgttgcccgccggcgccgcctcgggcttcctcgcctccacgcggcacctctccgccctcgtgctcgtgccgaggcagcaggcgaccatcccgagcagcccgacggcgaggtcgggcgactggaggtggaccttgctgaacacccacgccacggcgtccccggcgccgcgcgcggcctccgcagacgcccccggccgccgcgccctggacggcc

SEQ ID NO: 24679 - DNA, 1233 bp, Zea mays
tgggtaccgggccccccctctagttttttttttttttttttttttttttagatatataaaaacacagatatattattgttgttgttgttcacaaacgcagttatatataacagcattgctactatctcacgacggatgattttattccacatactactatagtactattcatcacacgctctaacatgcgctagcagctttgccaacattattattgttcgcctcctggccctgcatgggctggctgtggctccttgacgcgcattcatctagcacactggaaaacttgcacctatctacaacggccggcgctgctcatggatgatgtatatactacgcttgctgcatagccatcttgcgccgccgggcatgcatgcatgcggcacgacgtacggcgatacctagacgcgccatctaaatggccggcccgccggccggccggggcacttgccggtggtaaaggtaaggtcgtcgtcgtctttttcttgtctgcttttggattgtgtctccgatcccaagccaagggcgctgcgcggttcaatccgcgtcgttgccgtcgctctgcctgccggtgtccatgaggcaggtctcgacgccgccggtcatccataggaaccacgcgtagctgctccggtggtggctgctctcgggctccgcgtcaatggcgccggtgaacatgtcctccgcgccgcccgtgtcgccgcgggcgtgccacaggaacatgccgtacctccgcatcgcttcgccgtccgccggctcggcggccaccgcctgcttgaagtacatctccgccctctcgatgtccttgtcgaactcgtacaggagctgcgcgtagttggacaggatgagcgagctggcgccgcctgaggcgatggccatctcgtaggccgccttccggcgccgcgcgcgggcgctgtcgatctccttgacctcttcctcgtcaagttcctcctgcgccccgtacctgctgtccccgaacaggccgccgccgccatgcaagatgccgatctgggcccagagcgccttctccacgtccgcctccaccagctgcggcatgtcgtggtcctcgggctcctccgcgggggccccgttgccgtcggggcggtcggcccccgcgttgcccgccggcgccgcctcgggcttcctcgcctccacgcggcacctctccgcctccacgatcgtgccgaggcagcaggcgaccatcccgagcagcccgacggcgagacctcgtgc

SEQ ID NO: 24680 - DNA, 1300 bp, Zea mays
  misc_feature (1220)..(1221): n is a, c, g, or t
  misc_feature (1227)..(1227): n is a, c, g, or t
  misc_feature (1292)..(1293): n is a, c, g, or t
ctccatagggcgattgggtatctcgaggccggccggggtgggcccccgtgggggcctccgagaacggtgtcacggataagccgataagatagcgtggccccgtcgacccggcgggctcgctgcgactccgcctcatcgccaccctctcttcacaccccacaggccaagccagccgcaccgcgccgcaccgcattttggacatggcgtcgtcctcctgcctcgcctcgccgtctggcgccacgctctgccgcccgcggcggccgaggtgccgcgtggcgtgctcggcggccgacgccggcgggagcaccgggccggcgtgggccaagggcgcgggccgcctcgcgtgcggcgtgctggcggcttggtccgtcgcgtccgcgtccaatccggtcattgccgcgagccagagattgcctccactctcaacggagccaaaccgatgcgagcgcgcattcgtggggaacacaattggccaggcaaacggggtgtacgacaagccccttgatctccggttctgtgattacacgaacgagaaaaccaatctaaagggcaagtctttagctgcagcgctgatgtccgaggcaaagttcgacggcgctgacatgtctgaagttgtcatgtccaaagcttatgctgttggtgcaagtttcaaaggaaccgacttcacaaatgcagtgatagaccgcgtcaattttgagaaggccgatctcacaggggcgatcttcaagaacacggtcttgtcaggatcgaccttcgatgatgcaaagatggacgatgtcgtgtttgaggacacgatcatcggctacattgaccttcagaagctatgcacgaacaccagtatcagcccagatgcgagattggagctgggctgtaggtgattaattcaccaagagttcatccccatggtccatgttaatctgtctgtctatagagccgccatgacaagacgcgatcaaagacgtgacgccgattttatccatatctatgcatgtacaaattaaaccactgtatgtctcaagaatatcagcagcaatgtaaccatatacatagaagcactatatatggttcccacacgcatatattattattactgttcacatcgccgcagttatatataaaaacattactatctactagtgctttattccacataatactagtgctagtatcgcatcatgccctaacttttctttgccaaacattattgtttgcctcctggnncgtggncctgggttggctccttgatgcgcatccatctactagtatactggaaaactggccactacaagggnncgatgct

SEQ ID NO: 24681 - DNA, 2714 bp, Zea mays
ctgcagactgaaacaaaccacatgacatcattgcctgctgctgctagtagtggtaggggaggagaccaagatagaaatcaaaagaagcgtccagcccagcggtcaatcaggcatttcagtgttgtgtcccggcaacggcaagcaacaatgctttcgctcctgaccatctggtgtgcgatgtacgtaccctctgatctcaacactttgatggatgccctgttgacaacggtgtcgatgtgattaagaaacccttcaaagaggttatgtggactaatatctaaggcactcttgactcttgagtgccttcatctttgatctttctatacaatagagaccatttatcattgtctttcgtctctctatgtttatgtcctcgcaataagaaaaacgataaacgagtcttctacatctttctcgcatctctattactgacaagagaggtgaacggtgcagcaagagctcaataacaacgcttggcgcagaaagtttcaagaggttcagttggagccgttgactgaggacaccatcgtttgaaaaatggacggcagatgcccataccgtgcacaattcctaggggtggtcaagcgagaccatgcaaaactcatttggcagcctcacactgaaacaaatacaagttgttcatctagatccttatgtgtgtgtgtcattcgattaccgtgcacaaatacaaattgttcagatcaaagagcagccagagaagcatccagaaattcggaaacaaggaaaacaacataggtttatatatgtgtctcattcgattttacagacaagtcgacgaggttaagccctagctatatatccaaaaactctcatttattccgcgggctcgccagatccatcgaaggaacgcagaagtggacgggtggggtggagatggtgaggaggaaccaaaaaagaaaagaaaacaaaagaaaagaaagtgaaagaatcgcttcagggaagaactctatacatgtgcactcaaagcatccttttcataggtggtctcacagcactttcagggacactatcagctcagctgctgggcttctgctctgcaccaggtgaggtctgagtagagtgaaactcggcggttagttttctgtttctcatgagaaacacaagttgttttacagtaagaatagcagcgaaatgatggtagtcttctacaacaacaaacattatttgttaattgcatccttttctgaaaaaggatgctttgagtacttactccaaccgatgtcacaaaactgcagaccgcgcacttcacggaccgagccccgtactggtacatgagcagcatgcggcagttcccgcagttcacatgcgcgacttgatttgctgcgacggaagaagaagaaaaaaaacaagaagaccgttcgtcactggagatgttaggaatgagcagagcacttgatttctgaaccctggacaaatacacaatctctgaacgtgatgtttatttttccctttctttttgacaaagttcgcaacttgatgaattcaacgggtggtcatggtcatgggactaaaatccttccttgtaggaaagttccagtaaatgctgtgctcggcacactgaagcatctctacgagatattcattcagctccagtccagtgactctaggacatccctgtcaagcttttccatctctctggataatagccaatttcaacgattacgactccaagataggccaattctacgacgttaaaatgctattggaaggttgctgagctttccagaccacacaatatacagaaagcaggatttttttttcttcttcttcttctttcgtacaggaatcgaagtcacaggatttaccttccatagccaggttcacagtgtggcagcaagaacactgcacgctcgtcgcgccgcgtatgtacatgaggagggtgtggcatcctccgcacactagctgcgccatctcagttcctgcagaagattcacgcggcagcttcacgtttcagaggccagtaaccaactactgctacagcaccagaactgcaagaggttcagagggaaaccaccaaagttgtccccttgaactatcatggaacctacagctaggtctctgtagcgaatgaaagccttcatctcaaaaaaaaggcaaacaaaactttatggatgcagcaaatgctacttcttaactggttaaaaagaccagagagacgaaagggacagtgttgcactgctagctctgcacacacaaatgtggctccacggcgccgtgtttatttgctcgcaagttcttgacgaaggtgatattgattcgtgccatgcgcgtacggcgtacctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggcggctgccttatccgacgacgcacgcagctcggggaggcctcgcagattccggcggcgttcaggcggcagagaccagctgcttcgccccgcatgaaaccctagtagcaatgcttatggctgctgcatgcataagaacagttcttgagttaccacatctatctctctctctctctctctctctccccccccctcccgctctctctcctgtctctctccctcgtgccgaatt

SEQ ID NO: 24682 - DNA, 1726 bp, Zea mays
ctattacagattttttcataattagtctgtagctttctgctactatttttactctcgagttttttttttttttttttttgaaaacaacataggtttatatatatgtctcattcgattttacagacaagtcgacgaggttaagccctagctatatatccaaaactctcatttattccgcgggctcgccagatccatcgaaggaacgcagaagtggacgggtggggtggagatggtgaggaggaaccaaaaaagaaaacaaaagaaaagaaagtgaaagaatcgcttcagggaagaactctatacatgtgcactcaaagcatccttttcataggtggtctcacagcaatttcagggacactatcagctcagctgctgggcttctgctctgcaccaggtgaggttccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgtggcatcctccgcacactagctgcgccatctcagttcctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggctgccttatccgacgacgcacgcagctcggggaggcctcgcagattccggcggcgttcaggcggcagagaccagctgcttcgccccgcatgaaaccctggaaacgacacagcacgtgcaggagacgctgacgaaacagagcgagggagagagacagagtggcttcagttgcattgaaatttgaaatccacagaaatctcggagaaaatgcacgcaaagagctgttcagtagcagtaaaatcgattactaatggacgaggagtccttgggagacggggaaaaatcgattctctgaatgcacgtcaagatcgttccagcttctcctcaagccggctaacagtaatcgcgcgcagaagaaggtgaagaactctactactccataggactcccagcggctcaggcaacaagctgtattcgaggaccagaccggcttttaggaaatttcgtttcgctagcttgaggagattagaccgagcatgcatacgggggatttttcatggacagccatgttcatggaagccacttgccattgttggcctgatgcaacgagtagaccgagcttagaataacgcagcgggttgaaagaagaaaaaaaaactcgcagctaatccagtttcgagataaaacaggcgaggaatcacccaccatggccaataatcaaacaaagaaatcgagtgagagagagaaaaaaaaggaattccaagatgtagttcccagccaatcatcatcaaagaagagcaagaggggaataaaaaacaaagaagaggggaatcggcacctagtagcaatgcttatggctgctgcatgcataagaacagttcttgagttaccacatctatctctctctctctctctctctctcttcccctctctctctctctcctgtctatctctctctctctctatctcccggccggcc

SEQ ID NO: 24683 - DNA, 1049 bp, Zea mays
  misc_feature (55)..(55): n is a, c, g, or t
aaaccaacttaggtttataaatatgtctcattcgattcaacagacaagtcgggcnaggttaaagccctagctataaatccaaaactctcatttattctccgggctcgcgagatccatcgaaggaacgcagaagtgacgcggtggggtgcagatggtgaggaggacccaaaaaagaaaggattccaaaaggaaccataagaaaagaaagtgaaagaatcgcttcagggaagaactctatacatgtgcactcaaagcatccttttcataggtggtctcacagcactttcagggacactatcagctcagctgctgggcttctgctctgcaccaggtgaggttccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgtggcatcctccgcacactagctgcgccatctcagttcctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggctgccttatccgacgacgcacgcagctcggggaggcctcgcagattccggcggcgttcaggcggcagagaccagctgcttcgccccgcatgaaaccctggaaacgacacagcacgtgcaggagacgctagtagcaatgcttatggctgctgcatgcataagaacagttcttgagttaccacatctatctctctctctctctctctctctctctccccctctctctctctctctcctgtctatctctctctctctctcttcctcgcgctgtggagaggtcgacgaatttatagtgaagtggacgc

SEQ ID NO: 24684 - DNA, 1054 bp, Zea mays
ttttttttttttttttcggatcaaagagcagccccacgcgtctcttttttttcagaaacaaggaaaacaacataggtttatatatatgtctcattcgattttacagacaagtcgacgaggttaagccctagctatatatccaaaactctcatttattccgcgggctcgcgagatccatcgaaggaacgcagaagtggacgggtggggtggagatggtgaggaggaaccaaaaaagaaaagaaaacaaaagaaaacaaaagaaaagaaagtgaaagaatcgcttcagggaagaactctatacatgtgcactcaaagcatccttttcataggtggtctcacagcactttcagggacactatcagctcagctgctgggcttctgctctgcaccaggtgaggttccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgtggcatcctccgcacactagctgcgccatctcagttcctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggctgccttatccgacgacgcacgcagctcggggaggcctcgcagattccggcggcgttcaggcggcagagaccagctgcttcgccccgcatgaaaccctagtagcaatgcttatggctgctgcatgcataagaacagttcttgagttaccacatctatctctctctctctctctctctctcttcccctctctctctctctcttgtctatcttcctctctctctctctatctctcccgggaacggccggc

SEQ ID NO: 24685 - DNA, 1553 bp, Zea mays
ggaattttaaaatttggggccctcccaaagccccccggggggggttttaacccccgggccggggggccccccccaatggggttttttagggcggggttttaaacccagggggggggggttttgccaaattttttttcccccggggccccaaaaaacccttttccgggtttccccaaaacccaaaaagggggtttccccccccccccaaaaaggttttccccggaaaacttttttggggggattttttcccccatttttgggagacccccgcccgaaaaaaatttcccccaaaaaaatttttttttttttttttttttttttttttttttttttttttttttttttttttttttttttttttttttttttttttttttttttttttttttttttctgtttcttggaaaacaacataggtttatatatgtgtctcattcgattttacagacaagtcgacgaggttaagccctagctatatatccaaaaactctcatttattccgcgggctcgccagatccatcgaaggaacgcagaagtggacgggtggggtggagatggtgaggaggaaccaaaaaagaaaagaaaacaaaagaaaacaaaagaaaagaaagtgagagaatcgcttcagggaagaactccagtacatgtgcacctcatcccgcccgctccataggtggtctcacagcactttcagggacactatcagctcagctgctgggcttctgctctgcaccaggtgaggtctgagtagagtgaaactcggcggttagttttctgtttcttatgagaaacacaagttgtttcacagtaagaatagcagcgaaacaatggtagtcttctacaacaaaaaacattatttgttaattgcatccttttctgaaaaaggatgctttgagtacttactccaaccgatgtcacaaaactgcagaccgcgcacttcacggaccgagccccgtactggtacatgagcagcatgcggcagttcccgcagttcacatgcgcgacttgatttgcttccatagccaggttcacagtgtggcagcaagaacactgcacgctcgtcgcgccgcgtatgtacatgaggagggtgtggcatcctccgcatactagctgcgccatctcagttcctggagccggcacggcggtgacggtgctgcagacggcgcagcagaccgacgtcgcaccagctgggtacatgaggaggttccggcacccggtgcagacgagctggctctgggccccattgggcggcgtgaatggcgccggaggagctgggtacggagcaagcggaaccggcattgccgtgccggcggctgccttatctgacgacgcacgcagctcggggaggcctcgcagattccggcggcgttcaggcggcagagaccagctgcttcgccccgcatgaaaccctagtagcaatgcttatggctgctgcatgcataagaacagttcttgagttaccacatctatctctctctctctctctctctctctctcttcccctctctctctctctcctgtctatctctctctctctcccccccggcctcgag

SEQ ID NO: 24686 - DNA, 3686 bp, Zea mays
aaggggggggggggggggggggtttttggtttttttttgggggggttgggggttgggggcccccttgggggggggggggtgggaaaaaactttttttttttttttggggtttttttttggttccgggccccccctctctttttttttttttttttttggacagaagctattaagaatgagatttcacatcaacactcctaaaggttgcagtttattttagaaaccacgaccgcgatacaatatagcaaactaaatagtgataacaataggctaaccctaggacttcttttgcagtgtagtacatacatactacgaagttagcctccacagaggtgatgtgcacggcaggaaagggggcggcaaacaagcacctggagcaacagcggtcacgatgctaaatattctacaactctcgccttatttacagagccgggctgctgatgagatctcgttagcggtcaaatgggaactcattgtcatcctctaccaccttgaatggctccgggtggcgactggagcagtaaaggttccacatcttgtagtatgccctttcaaggttgcgcacccatcgagctgtatcaaacaacgggcaggtcatacgaacttccttgagcttgttagtcagcgcttgaagcttcaccggattcagcgctagttctactgctctatcttcatacttcttcatgctgctaacaatcatctcctccccaagcccagtagctacgcagagggaaccagctactctggttgccattttctctagtggaagggtgatcattggcagaccagcccacagtatgtcagtgcctgttgtgtgtgcattgcagaggggagtgtccaggaaaaggtctgccagggcactgcgtcgtatatgctcatttttcatggcaacgtctgtgaatacaatttgatctgatcttactcctctggcagcagcatatgctctcactctagtttcaccagctgccgggaatcttaaaagccataatgcgctgttgggaacacgtttgagaatattgcaccatgtgtcaaatatctcagggtccattttgtaaagctgattgaagcaagcaaaaataaatttatcctcaggtaatccataatcagatcttttgtgtggacatactggagtgagacagtctcgatttttctgcttgtagtcattgacaaaatagcaatgaggcaaatggacgagcttttctgaatatatatgtgcatagctagatggagaaacaaactcatctgtgaccaagtaatctatgtatgcagcacccgttgttccagggaaccccatgtacgaaacttggataggtgctggctgcattgcaaaaatttcgttcctggcaccctttgtgtagccattaagatttatcaaaatttgtattttgtcttgattgataagcttggcgatattatcggaagtcatggcagaaacatcgacaaaatgttctgcctcagactgaatacgctgcctccactcagtaccatcgttttgactgagtgcatagcaaaagacctcgatattggcacgatcatgcattccaaatactgatcccatgagatgggaaagggggtgattaccaaaatcactactcacatatcctactttcagtcggcagtgtttaccctctgcttttacaggaacaggaggtggatgcacaaaaggcggcagcccaaaacgagaggcaatcaaggaacagtgggccgcatatttacggcttatttccaaagcaagcaatggatcaataggataagcaatggcatggaaaggttgaacacttggaagtactgacatctttatttgccttctaataatttcttcaacatctcgaaacatgccatctctgttttcccagtcacagacacactgtagagtatgcaggagattacaggttgcctcaggaaaatcaggacgcagccggagagcctgcttgtagctaattatagccgtttctacatgcccactgtccttgtatgctgaggccaagttggcatgggcttctggcatgtttggcctgattgttgctgcctgaacataatcctgaattgcttcattaactctgccaatctctttgaatgtgttccctctattaactagtgcatcagctgctgtaggatctatacggagtacttcagtgtaacatgtgatagcatcagcatagtttccctgttgcttgtatatcacagccaagttgttaagtggggaagataatccagatgtcacagatatagctgctttgtaaaatgaagtagcagcgcttatcatgttccactccatgtatatgtttcctaaattagtaagggcttgcgggtggtttgcttgcagtgcaaggcaggatctgtagcagttgattgcttcttctactcttccagcatctttaagtgcgttgcccatgttgttgtatgcttcaataaactgtgggtcgtagactatagcttgattgtaacaacgaattgccatatcaagctggccttgctcatagtaaatagtagcaagattaccataagccatagcatagtcaggacgtgcctgcagtgcacgttgataacacataatggcatcttgaggcattcccaaagccttataaacattcccttgattaagatatgcatcagcgaaagatggcttaagcttaacagcttccttataatacattaaagccttgtcgaggtctcctgcctccataaacagaccagcaaggtttgaccatgcaattgcaaaatgaggatcaatacgtaacgcctcgatgtagcaactgtatgcctcttgaataaagccttgagctttcatcagatttccaagattactatgtgcatcaaccaatcgaggatttatagcaagtgcctgtctacaacattgagctgcctcattcagtctccccttccttgtatatgcgctagcgagatttgaccatgcatcacagaagtttggtcgcagctgaatagcagtaagatagtaacgaattgcaagatcaatatcacctttctccttccaagcatttgccatattgccgtagcattcagcaaaatgtggatctatggcaagagcctcctcgttttttgcaatgcacatgtcataattacgaatctgatagtatatagctccaaggaggaggaggttatcagttcgacgtggattcttctcgtaaacgacattaccatgctctagagcctctcggtacttccctgacctgtagttttgatgtgcaagtgccaaatgtcgctcttcatcaacagctcctgcgagctgtgcgggcttgggattgggctcgggctgggccgccctgtcatcgagccccgcgggcggaagaaggaacaaggcgggcgacggggcattcctcgcgggctcctccaggtcggcgcggcccccgaacactagccagtccgcgcctccaccgagcaccgacggctgcggtgcgtggtggcgcgcatcgccgccggcggcgacagcgccgccgtgctgctgttggagcgagagcatctccgcccgtgcggcgggtaaggaaaagcctcccaggcgcgggcgccggccggagggcccagatcgccggacggatcaacccctcgcggcgcgagaggagagggggtgggggttctggagcctggaggcttcgagagagcagaggggggggaccgaaccccctggcggactcggaacttctcccggccggcctcgaggtacccaa

SEQ ID NO: 24687 - DNA, 1482 bp, Zea mays
cattgggtacctcgaggccggccgggattcgtgcctggcaaggctggcatgccgtcggcctccctagctcgccgcctcctctctactattatatcatctccgctgcccccctcgcgcggaaccagcaccagcgccagcaacagcaacagctgtggttttagcacaagaaggacgaggaagaagcgcagctgcgtttcttggacggtgagcgcggctactccggcggacatggcgaccaacagtgccctggcgaagctggcgccgctggaagccatcctgttcgacatcgacggcacgctctgcgactccgaccccatccacttctgcgccttccgagagctcctgcagcaggccggcttcaacggcggtgtccccatcacggaggagttctacagcgccaacatcagcgggggccacaacgacgacctcgccaggtcgctgttcccgggcatggatcaccagaaggcgatgcggttcatggatgataaagaagctatgttcagaaagttggcgcctgggcagctgaagcccgtggatgggctgcaggagctgtgcggatggatggaaggccgcgacatgaagcgcgcggcggtgacgaacgccccgagggcgaacgccgagctgatgctgtcgctgctggggctcaccgacttcttcccggtgctcgtcatcgggagcgagtgcgaccgggccaagccgttccctgacccgtacctcaaggcgctccagctcatcgacgcatcgcctcaacacaccttcatatttgaagactctgcatcgggggtccgggccggtgtggctgccggagtgcccgtggttggcctgacgacgaggaaccccgggaaggtgctgaaagacgcaggggccagcttgctggtcaaggattttcaggacccggagctgctgtccgtgcttcaacaggtggaggtcgaacccgcagcggagaatgcacaaggctgatgggtcgggcattgcggaaaatgtcatgctggacagactagccatcagcgattctttcacggagtggaatagctgtgtaactgcatcgtggaataaactaactccggtcggttcctcggcaggaacctggagccggtgcgcatggatgtgtgctgtgtgcaaaacctggcgcctactacactggttcttaacatgcaacaggcattttggcaagttcgtgctcccagtcccaggtgtcttcggccgtgtttggttcggcttcttgacttcttcacagaatgtggcgaccatctcgttccctaataataataataacaataatataggagtataaggcttttactatgtcaattaagaaactgtttggatgcaatctagttcttaaaaatccagttccgtctccagtttttatacactggtttatgaaacaaaactaggttatagtgtgtggaaccatctcagtttttataaactgagtttagttagggaaaaaaaaaaaagggcggccgccaccgcggtgga

SEQ ID NO: 24688 - DNA, 1726 bp, Zea mays
ctcgaggtttttccgggacccaccccctgtgcagtggagcctaccactaccagcctacttcgtagtagtccccgaagccgcgaggcgcgcatacctttaccgcacgccgagaaaggatggcgtcgtggtcgtcgccctcagccgccgcctcgggcgcccgattcggccccttcccgagcggagggcagcggctcgcgccgtgtccgtcgctcgtccgcggaactcccgccccgacgctcgtcctcaggccccacccggacggccgtggccatggcctcctcgcgcacaccggcccctctccctcctcgcggtgccgcgccgtcgccgccgaggtcgggggcctcaacatcgccaacgacgtcacccagctcatcggcaacacaccaatggtgtatctcaacaacgtcgtcaagggatctgtcgccaatgtcgctgctaagctcgagattatggagccctgctgtagcgtgaaggacaggatagggtacagtatgataaatgatgctgaacagaagggcttgattactcctggaaagagtgttttggtggaagcaacaagtggaaacacaggcattggtcttgccttcattgctgcttctaaaggatataagctgatactaacaatgccttcatcaatgagcatggagagaagagtcctcctcagagcttttggtgctgaacttgtccttactgatgctgcaaaagggatgaaaggggccttagataaggctacagagattttaaacaagacaccaaattcttacatgcttcaacagttcgataaccctgccaaccctaaggtacattatgagactactggtccagagatctgggaggattcaaaggggaaggtggatatattcattggtggaattggaacaggggggacaatatctggtgccggccgttttctcaaggagaaaaatcctggaattaaggttattggtattgagccttctgaaagtaacatactctccggtggaaaacctggtccacataagatccagggaatcggcgcaggatttgttccaaggaacttggatagcgatattcttgatgaagtaattgagatatcaagtgatgaagctgttgagacagcaaaacagttggctgttcaggaaggattactggtcggaatctcctctggggcagcagccgccgccgccataaaggttgccaaaagaccagagaatgctggaaagctgatagtggtcgtgtttccgagcttcggcgagaggtacctttcatctgtcctctatcagtccataagagaagaatgcgagaacatgcagcctgagccatgagggagccgtcactttaagcgggcatagtaaatgtttctgaaataagacgcgtagctagcatcagtttgctccacttggtatcatttggccatgctcactctatcctttcgctagcctctatgaccggacctaaactggtgtgtgagaaacatccacgactctcctcccaactgctttcctaaagcgaaacgataacacttcttaataattgtctatacgattgaagctgatttgattggtaattgtaaacaacttgtctttggatctttgaagtcaaacaaagtcagttggttgaatcagctggatattgtatgcctttttttttgtgtgtgtgtaccggtatcacagaattatgcatgtcagataagtgtcaatcgatggaataaggatttatgaggtaaaaaaaaaaaaaaaaagcggcc

SEQ ID NO: 24689 - DNA, 1806 bp, Zea mays
ccggccggggtccattcaccacccaccccctgtgcagtggggccttccaccacgagccgacttcgtaggagtccccgaagccgcgcggggcgcatacctttaccgcacgccgagaaaggatggcgtcgtggtcgtcgccctcagccgccgccaacgccgcctcgggcgcccgattcggccccttcccgagcggagggcagcggctcgcgccgtgtccgtcgctcgtccgcggaactcccgccccgacgctcgtcctcaggccccacccggacggccgtggccatggcctcctcgcgcacaccgcctcccctccctccttgcggtgccgcgccgtcgccgccgaggtcgggggcctcaacatcgccaacgacgtcacccagctcatcggcaacacaccaatggtgtatctcaacaacgtcgtcaagggctctgtcgccaatgtcgctgctaagctcgagattatggagccctgctgtagcgtcaaggacaggatagggtacagtatgataaatgatgctgaacagaagggcttgattactcctggaaagagtgttttggtggaagcaacaagtggaaacacaggcattggtcttgctttcattgctgcttccaaaggatataagctgatactaacaatgccttcatcaatgagcatggagagaagagtcctcctcagagcttttggtgccgaacttgtccttactgatgctgcaaaagggatgaaaggggccttagataaggctacagagattttaaacaagacaccaaattcttacatgcttcaacagttcgataaccctgccaaccctcaggtacattatgagactactggtccagagatctgggaggattcaaaggggaaggtggatatattcattggtggaattggaacaggggggacatatctggtgccggccgttttctcaaggagaaaatccctggaattaaggttattggtattgagccttctgaaagtaacatactctccggtggaaaacctggtccacataagatccagggaatcggcgcaggatttgttccaaggaacttggatagcgatattcttgatgaagtaattgagatatcaagtgatgaagctgttgagacagcaaaacagttggctgttcaggaaggattactggttggaatctcctctggagcagccgccgctgctgccataaaggttgccaaaagaccagagaatgctggaaagctgatagtggttgtgtttccgagcttcggcgagaggtacctttcatctgtcctctatcagtccataagagaagaatgtgagaacatgcaacctgagccatgagggagccgtcactttaagcgggcatagtaaatgtttctgaaataagacgcgtagccagcatcagtttgctccacttggaatcatttggccatgctcactctatcctttcgctagcctctatgaccggacccggactgcgttgtgtgagaaacatccacgactctcctcccaactgctttcctaaagccaaacgataacacttctcaataattgtctatacgattgaagctgatttgattggtaattgtaaacagcttgtctttggatctttgaagtcaaacaaagtcagttggttgaatcagaaaaaaaaaaaaaaaaaaaaaaaaaaaaaaaaaaaaaaaaaaaaaaaaaaaaaaaaaaaaaataaaaaaaaataaaaaaaaaaaaaaaaaataaaaaaaaaaaaaaaaatgtaatcacttttaaaggttctaaattttataaagcttgcttgcctgataataaatttttttttccgtcccttaaattaa

SEQ ID NO: 24690 - DNA, 4009 bp, Zea mays
  misc_feature (1245)..(1245): n is a, c, g, or t
cccccccccccaaaatacacacatacattgcatgtccattttatgaaacatctcgagggcactgaaggctgagtggtaaggtatgcaggtgttatcactaatagcacaaacgttggatagccgttataaatttgtgaccaccagacactagagaacgttagagatggcttgccatgctcctaccttagcatcacatcactacatgatagtgctcaaggtcttcatctgcagccacagtgccacttcgatggcactaaagagatcacataaacaccacatgctgcatcttgacaggattttagtaatcgcagtagttttcaaacatgataaagcaaggtggtaacttcataaacacaaaattaacttaaaagaaaaatcatagacctagtaaacatggctacacacaatgtgttgtggacgccttgatagggcgctagtacaggcgctggcctaggcgtccagcaaggcccaaatgtggaggttggcctgttttagaaagaggaatagatggatgatatttaggagattgatttgagtttgttaggaaagtgcacctagtatataaagggaaccttaggaatgtaattggattatcgaagaaggaataaacctccctaggtgggtgggtttcttttcgacggtggttgccggcgattcagcagtggtcaccggcgctgaaaccaccacagcaccacactattgcctcgctgccctctgcactcaagcttagtcccatctttccttcattctcccctttgcttttcatatcgctagcaccacatcaatttggtatcaatgacttccatgtcagcaccctgttcgatcctgtgagatgaacgccaagatcgaccgcatcttgggacagacttagggaggtaggtatcttatggagatatatagcatcaagtcgacggcacgactttggctaaggcacgtgtagatttgatctaaaagaaagcaagtgatcaaaagtaatcatatgctaatagaacagtccattaaaatcaccatgcctaaggctcatgtgcagtagtctgatttgttggataaatgatttcccagtcatataccacaataatttgtagtgttcctatttgaatgacacctaataaaaggaattgattttgcagttgcaaatccatgtagctcctgatcctagaatgaaacttgtgcggcccctttttgagctctggcaaccttgctaacatattttaaactcacacagctgcaggctgttttgatctnatgttcactatactaacttagtagcattcgaaatcaacatccctacaactgaagctatccttcagaactgtagttataggaaatgctctttctgttcagatgaattatttcactgttgctaccccctgaagctagctgtctccctattgagtacatcagaaaaatgcacaaatggctctatcagctcattgttctgtgaagagaccacaacgctctagtaaattatataggggtacgaactaagaatgtttatttgcagtcatgtctgtttatctttcaatacacttgtgaaatgagcttaaactatcattactttgtggtgctatgagaacaattcaactttcaacctaaccttattggggttaagatattatctggcaaaatttcagtccacataatattcaattgtgtgagtgttcatggaataatcagttaggttcaatttagcaaaacttcagaattagtttgaattcagtaaatatattgacaatgttcagtcagtggaatttcaattggaattaagttactaagcctatctgcaacaaacagactaatccaaaatctgcaagataaacaagaaattaaatgaacagagtgagttgacatggttttagagcacacactttgatgctgatgtaaagcttggtgacacgattgcgactcacggcgccacggtggtgacgaccacggctgccgcgctagagatggaggagatcgctgccttggcctgggcgtgtcacttggatgagctgctgctggagtgcgatgtgatcgatgctgtgacagagaactcttggaagtccaaggcactctaggggacacgagcatgatgatggcaactggcacggtccacggtacttcacgctgactgacacgggcggtggcaccctgtagatgccccacatgtacatcaaaattgcagctcaaaattttgaccattagatgccacacatgtagcaataagaagggtacatcaaaattttgttctgacgattgactgtccaattgcagctcatcggcaagacaccaatggtatatctcaacaatgtcgtcaagggctctgtcgccaatgttgctgctaagcttgagattatggagccctgttgtagcgtcaaggacaggtatccttttgtcgtcctctcctattggaagccaatcttttgctataactaaacacttccaaacccatttggtttcaggatagggtacagtatgataaatgatgctgaacagaagggcttgattactcctggaaaggtgatttgtaagcataggcacattttggcttcattcacatatttccttgcttagttatactgatatgagtagaattgtcgaaatattttatactcatcattgaaacaagagtactgaccaaatgtgaagacacatgtccaatgtggaattggtgtatagagctagccacaggtgcctcagtgatgtttctgatcactgttgaaaataggatcatgacaacagcctctcattctgcctttccttgtactctggatgacttgttttcctgtcctatgtttcttctcagagtgttttagtggaagcaacaagtggaaatacaggcattggtcttgcctttattgctgcttccaaaggatataagttgatattaacaatgccttcatcaatgagcatggagagaagagtcctactcagagcttttggtgctgaacttgtccttactgatgctgcaaaagggatgaaaggggccgtagataaggccacagagattttaaataagacacccaattcttacatgcttcaacagtttgataaccctgccaaccctaaggtacattatgagaccactggcccagagatctgggaggattcaaaggggaaggtggatatactcattggtggaattggaacaggcgggacaatatctggtgctggccgtttcctcaaggagaaaaattctggaattaaggttattggtattgagccttctgaaagtaacatactctccggtggaaaacctggtccacataagattcagggaattggtgcaggatttgttccaaggaacttggatagcgatattcttgatgaagtaattgagatatcaagtgatgaagctgttgagacagcaaaacagttggctgttcaggaaggattactggttggaatctcctctggagcagccgctgccgctgccataaaggttgcgaaaagaccagaaaatgctggaaagttgatagtggttgtgtttccgagttttggcgagaggtacctttcatctgtcctctatcagtccataagagaagaatgcgagaacatgcagcctgagccatgagggagccgtcactttaaacagcataataaatgtatctggaataagatgcgtgggcaccattagggcttgttcgtttgcgtcggattgcacccggaatcgttccggctaatcaaagtttatataaattagagaagcaatccgaccgggaattgttccgacctaccaatccgacacaaccgaacaaggccttaccttagtgtgctccaattggtatcatttggcccatgctcacgctatccttttgcctctatgcccggaactaatcaggcgtgtgagaaatatccatgactctcccaattgctttccattagcaaaatgattacacttctgaattgtctatacgattcaggctgatttgattggtaattgtaaacaacttgtccttgaatctttgaagtcaaacaaagtcagttggctgaatcagctgaatatatgttatatgcattttttttg

SEQ ID NO: 24691 - DNA, 1597 bp, Zea mays
aattcggcacgaggcaaaacgccggcccggcagcctcccaccgccggcgaggccgcgagtcacagtcacctttaccgcacgccgacaaggatggcgtcgtggtcgtcgccctcatccgccgccgccgcctcgggcgcccgattcggccccttcccgagccgagcgcagcggctcgtgccgtatccgtcgctcgcccgcggaacccccgcctcgacgctcgtcctcaggccccacccggacggccgtggccatggcctcctcgcgcacaccggctcctcttcctcgcggtgccgcgccgtcgccgccgaggtcgagggcctcaacatcgccaaccacgtcagccagctcatcggcaagacaccaatggtatatctcaacaatgtcgtcaagggctctgtcgccaatgttgctgctaagcttgagattatggagccctgttgtagcgtcaaggacaggatagggtacagtatgataaatgatgctgaacagaagggcttgattactcctggaaagagtgttttagtggaagctacaagtggaaatacaggcattggtcttgcctttattgctgcttccaaaggatataagttgatattaacaatgccttcatcaatgagcatggagagaagagtcctactcagagcttttggtgctgaacttgtccttactgatgctgcaaaagggatgaaaggagccgtagataaggctacagagattttaaataagacacccaattcttacatgcttcaacagtttgataaccctgccaaccctaaggtacattatgagaccactggcccagagatctgggaggattcaaaggggaaggtggatatactaattggtggaattggaacaggcgggacaatatctggtgctggccgtttcctcaaggagaaaaattctggaattaaggttattggtattgagccttctgaaagtaacatactctccggtggaaaacctggtccacataagattcagggaattggtgcaggatttgttccaaggaacttggatagcgatattcttgatgaagtaattgagatatcaagtgatgaagctgttgagactgcaaaacagttggctgttcaggaaggattactggttggaatctcctctggagcagctgctgccgctgccataaaggttgcgaaaagaccagaaaatgctggaaagttgatagtggttgtgtttccgagttttggcgagaggtacctttcatctgtcctttatcagtccataagagaagaatgcgagaacatgcagcctgagccatgacggagccgtcactttaaacagcgtaataaatgtatctggaataagatgcgtgggcaccattagtgtgctccaattggtatcatttggcccatgctcacgctatccttttgtctctatgaccgaaactaatcaggcgtgtgagaaatatccatgactctcccaattgctttccattagcaaaatgattacacttctgaattgtctatacgattcaggctgatttgattggtaattgtaaacaacttgtccttgaatctttgaagtcaaacaaagtcagttggctgaatcagctgaatatatgttatatgcttttttt

SEQ ID NO: 24692 - DNA, 2339 bp, Zea mays
ggctacctcaaagggccatttgacttgatccccaaaacgaaacagttgcagcccctctactcatgaattctgtccagccaccacccaccccctgtgcagtggagcctaccactaccagcctcagcctacttcgtagtagtccccgaagccgcgagtcgcgcatacctttaccgcacgccgagaaaggatggcgtcgtggtcgtcgccctcagccgccgccaacgccgcctcgggcgcccgattcggccccttcccgagcggagggcagcggctcgcgccgtgtccgtcgctcgtccgcggaactcccgccccgacgctcgtcctcaggccccacccggacggccgtggccatggcctcctcgcgcacaccgcctcccctccctccttgcggtgccgcgccgtcgccgccgaggtcgggggcctcaacatcgccaacgacgtcacccaggtcacagacaatctccagcgcctgcctgccgccggttcatgctttcatgtttcagtccttcgtttgtcgtcactcgggtagctgcttaggtgttgggattactacatatgttaggacttcagagcagtcagtgcaactgctttgatcaatagatgccacacacgtagcaataagaagggtacgtcaacgttctgttctgacgactgactgcccaatcgcagctcatcggcaacacaccaatggtgtatctcaacaacgtcgtcaagggctctgtcgccaatgtcgctgctaagctcgagattatggagccctgctgtagcgtcaaggacaggtatccttcctcttcccctccttccattggcagggagattggcctttttggttgtagctaaacacttccaaacccatctttggtttcaggatagggtacagtatgataaatgatgctgaacagaagggcttgattactcctggaaaggtgatttgtaagcataggcacattttggcttcactcacatagttccttgcttagtgatactgatccgagtacgattttcgaaaaaaatgtggaattggtgtagagaggtagcccacatgtgccttagtgatgtttctgatcactgttgaaaataaaatcatttcaacagcctcttgttctgcctttcccttgttttgcttgtctcatgtttctgctcagagtgttttggtggaagcatcaagtggaaacacaggcattggtcttgctttcattgctgctccccgaggccggccgcggatactatcaatgccttcatcaatgagcatggagaggaagagtcctcctcagagcttttggtgccgaacttgtccttactgatgctgcaaaagggatgaaaggggccttagataaggctacagagattttaaacaagacaccaaattcttacatgcttcaacagttcgataaccctgccaaccctaaggtacattatgagactactggtccagagatctgggaggattcaaaggggaaggtggatatattcattggtggaattggaacaggggggacaatatctggtgccggccgttttctcaaggagaaaaatcctggaattaaggttattggtattgagccttctgaaagtaacatactctccggtggaaaacctggtccacataagatccagggaatcggtgcaggatttgttccaaggaacttggatagcgatattcttgatgaagtaattgagatatcaagtgatgaagctgttgagacagcaaaacagttggctgttcaggaaggattactggttggaatctcctctggagcagccgccgccgctgccataaaggttgccaaaagaccagagaatgctggaaagctgatagtggttgtgtttccgagcttcggcgagaggtacctttcatctgtcctctatcagtccataagagaagaatgcgagaacatgcagcctgagccatgagggagccgtcactttaagcgggcatagtaaatgtttctgaaataagacgcgtagctagcatcagtttgctccacttggtatcatttggccatgctcactctatcctttcgctagcctctatgaccggacctaaactggtgtgtgagaaacatccacgactctcctcccaactgctttcctaaagcgaaaggataacacttcttaataattgtctatacgattgaagctgatttgattggtaattgtaaacaacttgtctttggatctttgaagtcaaacaaagtcagttggttgaatcagctggatattgtatgcctttttttttgtgtgcgtgtaccgctatcacagaattatgcatgtcagataagtgtcaatcgatggaataaggatttatgatgaaaaaaaaaaaaaagcggccaactcga

SEQ ID NO: 24693 - DNA, 969 bp, Zea mays
tttggtcatgttgtagtcccttgtcattgtctcgttgctcttccattgtctccatcagcggctttttgttttgtaagccgattttttttttttttttggttcagagggaaacgatcgatccgcgcgaatacatgcatacacattattgcatctttccgctatagacgatggcgcatgtttatctatctatctgtctgtctgtcgagacgtgctagcgcagcaattactatacgggagggagacagaaacctcagtcaccccggcgagcgccgaacgaactctgcacgtcgtcccacgccgtgggcaacatgggcgcgcggcacagcgggcaggtggccgcaccgtcgccactacggacccaagcatcgatgcaggcggcgtgaaacgcgtgcgagcagccgcacagctccacgaccgcctggaaatctccctgttccagacccgccaagcaaatcgcgcagacggccgcgccctcggcgtcgccttctgcgtccagctggacgtccgccggctgcgcaacccgccgccgcctgtaccgtggagccgtgagcgaccgcgtcacggtctcccacagcatcgcctccaggaggcgttccaagtcaacatcgttgacatgctcgccgacgccgcctaaagcctgtcctggcagatgcacctcgccctggcacggcgcgacgccgaggcggtccaggatcaccccggcgatgaagcggaggaggtcgaggaggtcgcgcagaagggaggtttcgccgcagagggagctcgtagctgtggtcgaagctggggttgctcatcggcgatacatacgcggtaggctgtggtagcacatcactgatgcctgatcgagcgcagccgcgtgctgctgcctgcgtgggccggcctcgaggtacccaatttcttgcttgcaacaggcgcttctttataagctgcaacaggcacatcaatagcggaggatcccggcccggccgg

SEQ ID NO: 24694 - DNA, 594 bp, Zea mays
taggaaaccagtcgagcagacatatgcatatccatgaatggagtctggagcaaatatgaatagtattttgttccggattagagcgcaggcgcaaccgcgcaacgacgaacgaaatgtacaggtcgcacaaacatagtacggggtgcaggagcaggactcgctcgatcactggcactgctcaggagaaagacatggaagcaggcaggacgctaggcggagaagaggccgtcggcggcggccagcgcgagcccggtcttgggctccagctgcaccgcgacggtgaatctgaccccggacgcggcggcggaggcggactccacccacgagctccacaccttggccacggccccgaagttcctcgtctcgccgccgctcccgctgccgctgccgctgtccccgccgggggcgcctcgccttgccgtcttctcgaactgctccgccaccagcaacgcgatgtccgccatcctctctctcgtatctgctgggctcgctgacgacgatctcactctgctcttgtcggttgttgctctgctctagtgctctggtgactgtggaatggatgctgtctgtgaaactgcgatggccgatggtggg

SEQ ID NO: 24695 - DNA, 598 bp, Zea mays
ggccgctttttttttttttttttggagcaaatatgaatagtactttgttccggattagagcgcaggcgcatcgacgaacgaaatgtacaggtcgcgcaagcatagtacggggtgcaggagcaggacccgctcgaccactggcactgctcaggaggaagacatggaagcatgcaggcaggaagctaggcggagaagaggccgtcggcggcggccagcgcgagcccggtcttgggctccagctgcaccgcgacggtgaatctgaccccggacgcggcggcggaggcggactccacccacgagctccacaccttggccacggccccgaagttcctcgtctcgccgccggtcccgctgccgctgccgctgtccccgccgggggcgcctcgccttgccgtcttctcgaactgctccgccaccagcaacgcgatgtccgccatcctctctctcgtatctggctctctgctgagctcgctgacgacgatctcgctctgctcttgtcagttgttgctctgctctagtgctctggtgactgtggaatggatgctgtctgtgaaactgcgatggccgatgatcccggccggccggccccggggtccca

SEQ ID NO: 24696 - DNA, 1139 bp, Zea mays
ctagagatggccatttatgtgttctaccaggcccgtttccagacgaagacgtaaccagaatcaagtaagaggcgaccgacactcccacagagagagacccatcacgaagcagcggggagagcggcccaggctcctccatcacgtcatctggacggccgaaaaaggccatggaaagttcgtccaaaaaggggtcggtggggatctcgaggagcagcggggcaggcgggaaccccaggaaaagaagatccaaaagctcatgtacgcgcgcgtgatacagccgctcattactcaactcacccccagcaaagtttcaacccggtatttcttttcaagtaccggtcaaatggaattggcaagcatcgtgcccacacacaaaaaaaaagttgcttgcttctcatcaaaatcacatgaactttaacggaacggttattcagaccttctcagcgatccgccagggatcatcggaaatcagcgccgactgcttcctgcacagatttgaaaccgtctctttccaaacattctgctagctcagcctttattctgggtataagagctggaccaccatatgcaagagcagtataaagttgaacaagtgtagctccggaacggatcttcttgtatgcatcctcaccgctgctcacgccaccacagcctatgaggggaatcttgccccgtgtaagcatatacatgtccctgagaatgttagtagataagtccaacaaaggcttcccacttaatccaccagtttcctgagccaatggatgtttatctgcaggtgatggtctggaaactgtggtgtttgatataatcaggccatccaacctaagagcaagagcaaccgcagcaatatcctcaagatcctgcttagacaagtctggtgcaatcttcacaagcaatggtggaggtccatcttcagcccactgcatctcatctcgtgcagcttgcaccttcttcacaagatctttcagttgttttctaccttgtaatttgcgaagaccaggagtatttggggaagaaatatttatgaccaagtaatcagcatattgtgacaatgtatgaaccccttgcacataatcagcagcagcatcttcactagtcttgttcttgccaagattgactcccaagattccagctcctgc

SEQ ID NO: 24697 - DNA, 2779 bp, Zea mays
gcaatctgttggctggagtaagtttctagccatagtcgctccaggtgttggctgcgcaccagttgttgctatagtgttttgaaccacagcagcagccgttcgtcatcagcggtcagaatcccattagcttatacgtacatggttcgattttgcagatctgtgtcccattctctctatgctttgtgtttcggaaacgctgcaggctgcaccacctaaagttggccttctccgtcagaagtacacctcatagaagcacaatgttctgaacaacaggagacactgagagttgtttttttttttttatggcttatgcaagtcccgggtcagtgcattactaatgtggatattgttttttttttctaaaaaaaaaggttctagacaatcctgtatctgaacatcagtacaacaacgaaaccgtaatcgtggaccagagatttattggcactgacaaaaacaagacccactaattcagaaagaggaacttacagaagctgtcctgctgctgcacaatacaaaacctcggtggcatatagaactaagagtacaagaacgtagatacgaggaaatgctctctgcatgcttgcttgaagcggaccccctatatccgcttcagaaccttctcagcggcctcgacggtcttctcgatgtcctgggaggtgtgcgccaagctggtgaaccccgcctcgaactgcgagggagcgaagtacacgccctcctccagcatgccacggtagaacctcccgaacttctcggtgtcgctcttcttggcgtccccgaagttgtggacgggcccgccggtgaagaagaagccaaacattcctctgatatgtcctccgcacatctcatgccctgctttcgcaccgacgtccagtatcccacggacgagttcgccggtgatcttgtccaagtactcgtaggtgccgggctctgtcagccgcttgagcgtgtggatcccagcggtcatggctagagggttcccgctgagagttcctgcctggtacatcggccctgcgggggcaaccatctccatgatgtcccttctcccaccgtaggcaccaacggggaggccacccccgatgatcttgcccaaggtcgtcacgtcaggggtgatcccgaagtactcctgagctccaccgtaagacagacggaagccggtcatcacttcatcgaagaccaggagcgcaccatcctgtttggtcaagtcgcggagagcgttaaggaaaccaggctgtggggggatgaaaccagcgttgccaacaactggctcgaggaagacggcagcaatctcccccgcgttgtcctcgaacagtttcttcactgccgcgacatcattgtagggtgccgtcagagtctcgtaggtggcccccttggggacgccaggggagtcagggaggccaagggtggcaacaccactgccggctttgacaaggaaggaatcggcatggccatggtagcagccttcgaacttgatgatcttctcccgcccggtgaatgcgcgcacgaggcggagcgctcccatgcaggcttctgtccctgagttgacaaagcggaccatttcgatacttggcacggcagagatgaccatctcagccaatacgttctccagcaaacatggagcaccaaagctagttcctttcttcagagtttcaatcaacccagcattgacctgtcgcggtcttcatatagtacggtgatttaaatttagctttgtcaattctcaagccagcttaagccaaatgttgccgaatcaaatatagtatttttccaatattccacagtggttcaaaaatcacactataagttgacaaatatttgaagttgaagtaaagctataaaccgtcatggatttcaccaatttgatttacaaaatcagaccaagaaaattttatgatacatatagaggttcagaaattttagaacaatcacaaatgggatggagattagtctaattaatcaactattaggccccgtttgtttcctttcatttcgaggaattggaatcttactaatggaatagactatttttttagaatatgacattccaccactttccaaagttatcatataagcctacctcaaattcatgggttgagagatggaaattgattctatagatttacatgatattttccgatgtacaacttatatcacattcttctacttgcgcctttataacataaatgtagtatataactatctctctcacatgatttaggataatatacaaatatattatatatataaatatataaacttaattagttatgtctaaaatataattattaaaatggaattcaattccaacgaaacaaacgggcccttataggaaatacaagtatgctactccatcaactatcatgaaagaacaaagagataggaaacagaagcagacccatagattaactaacaaaataattatgatgaaatacttcatattcacataaaacatattggccagaaccaacataatcaattatgtaccttatcatctgcatggccgatgattgcaggaccccaggaaccaacgtaatcaatgtactcattcccatcaacatcccacatacgagaaccctttacagagtcgaacactactggctgcccaccaacagatttgaaggcacggaccggcgaattaacacctccaggcatcagctcctgagaaagtgaaacatcagtcaatgaaacatccaaaaccatgggcaaaaatgatgacaagatgactgagatctcaaaaggtgaaagatcctaacactggtcattgtgataatagtcccaccaa

SEQ ID NO: 24698 - DNA, 1815 bp, Zea mays
ggtttatgcaagtcccgggtcagtgcattactaatgtggatattgttttttttcttctaaaaaaaggttctagacaatcctgtatctgaacatcagtacaacaacgaaaccgtaatcgtggaccagagatttattggcactgacaaaaacaagacccactaattcagaaagaggaacttacagaagctgtcctgctgctgcacaatacaaaacctcggtggcatatagaactaagagtacaagaacgtaaatacgaggaaatgctctctgcatgcttgcttgaagcggaccccctatatccgcttcagaaccttctcagcggcctcgacggtcttctcgatgtcctgggaggtgtgcgccaagctggtgaaccccgcctcgaactgcgatggagcgaagtacacgccctcctccagcatgccacggtagaacctcccgaacttctcggtgtcgctcttcttggcgtccccgaagttgtggacgggcccgccggtgaagaagaagccaaacattcctctgatatgtcctccgcacatatcatgccctgctttcgcaccgacgtccagtatcccacggacgagttcgccggtgatcttgtccaagtactcgtaggtgccgggctctgtcagccgcttgagcgtgtggatcccagcggtcatggctagagggttcccgctgagagttcctgcctggtacattggccctgcgggggcaaccatctccatgatgtcccttctcccaccgtaggcaccaacggggaggccacccccgatgatcttgcccaaggtcgttacgtcaggggtgatcccgaagtactcctgagctccaccgtaagacagacggaagccggtcatcacttcatcgaagaccaggagcgcaccatcctgtttggtcaagtcgcggagagcgttaaggaaaccaggctgtggggggatgaaaccagcgttgccaacaactggctcgaggaagacggcagcaatctcccccgcgttgtcctcgaacagtttcttcactgcctcgacatcattgtagggtgccgttagagtctcgtaggtggcccccttggggacgccaggggagtcagggaggccaagggtggccacaccactgccggctttgacaaggaaggaatcggcatgcccatggtagcagccttcgaacttgatgatcttctcccgcccggtgaatgcgcgcacgaggcggagcgctcccatgcaggcttctgtccctgagttgacaaagcggaccatttcgatacttggcacggcagagatgaccatctcagccaatacgttctccagcaaacatggagcaccaaagctagttcctttcttcagagtttcaatcaatgcagcattaaccttatcatctgcatggccgatgattgcaggaccccaggaaccaacgtaatcaatgtactcattcccatcaacatcccacatacgagaaccctttacagagtcgaacactactggctgcccaccaacagatttgaaggcacggactggcgagttaacacctccaggcatcagctccttggcggcgttgaagatctcctcggacttctgcaccgtgtacgccttctcgcccttctcgagggatatcgcggcccgcaccaccgacagccgagcgcggcgtcccgcagaagccctcatcggcgcggccggccgggccgagaccccggacgccacggcggctgctgctgctccggccatacttgggcttgctcgtctcgcgcgaggtcggaggtggagcagatgaggggggataagaaattccggaggggtttgcggcgattgggtccggacgcgtggg

SEQ ID NO: 24699 - DNA, 2208 bp, Zea mays
  misc_feature (2196)..(2196): n is a, c, g, or t
gccggccgggtcgggggcacggcgacacctcagccctcaggtagccccgtagccgcctagcagggccgtgctcgagaaaattaggagaccaacagcacgaagggggaaaaaaggagagcagaaatccccaatccctcctcacttcgacccttgctcggaatctccccgcagcgtccggctgaatccattcgattcactcatggtaggcttcgtcttcttctgctgattcgctggatcgtctccaccgacgcggctgcgcccacacctgccgtcacagccatggagccgcgcatcggcaacaggttccgcgtcggccgcaagctggggagcggctcctttggggagatctacctcggcaccaacgtgcagaccaacgaggaggtcgcaattaaactggaaaatgttaagacgaagcatcctcaattgctttatgagtcaaaattatacagaatacttcaaggaggaactgggattccaaatgttaagtggtttggcgttgagggtgattacaatgttttggttatggacttactgggaccgagtcttgaagatctttttagcttttgcaacaggaagttgtccctcaaaactgttttgatgcttgctgatcaaatgatcaatcgagttgagttttttcattccaagtcattcttgcatagagatatcaagcctgacaattttctcatgggtctcgggaaaagagcaaaccaggtttatgttatcgattttggacttgcaaagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgcgaggaagccttccatggcagggcctgaaagctgggaacaaaaaacaaaagtatgaaaagatcagcgaaaggaaaattgctacttcaactgaggctctctgccgtggatatcctaccgaatttgcttcttacttccattactgtcgctcactgcgtttcgaagatgcaccggactatcagtacctgaagagattgttcagagacctttttattcgggaaggttttcagtttgattatgtttttgactggaccattctaaagtaccaacaggcacagatgaccactgctccacctcgtgcaattgctccagcagtaggacaaagctctgggatggctcctgtggcaaacaacaatagacattcaggcactgaagagggaaggagaagcgggtggtctgacatggacccaatgcgacgccaggctccaccaccagttataaatgcaggcagcctagccaagcagaagtcgcctgttcggcctgagacatcaacatcgaaagatgctgtgttctccagttcgacttttttgggacgttcaagcggatcgtcaaggcggcctgctgtatctagtagccgagagctaagcactgaagcggagcaaacacgtagccgcacaactgacgcgagcccaggggcattccagaggtctggagctccacggtggagcccgcagatgcctgattcctcggacggcaggcgttcgtcttccagcaggcgccactcatctaaccccaagaactacgagtctaccattaggggcatgcagggcctaaactttgatggcgatgacagggtgcactattagcatctcatctgtctgggagggtgcatcgcctcccctccccatagatggatgtaccaaggacggccagataataagaggtttgggtgagtgagcccgagcagtccgggtgacgtctcgtaggaactgtgtatgctgcttagcctctgttgttgtacaggcttgtcatttgtttggtctgcgcttaccggtagggcgcgccttgtccggtgaacgatgatggtgtattatgagagggatttcttaaggggttcacgtttggtgtgcttgggttgctttgatagaaacatttgggagaggtttatcgcgcctgctctgctctctcatgtaactccagattgctgagctggcacctgctctgctctctcatgtaatgtaactccagattcctgagctgctatgttttttttttaaaaaaaaaaaaaaaaaaaaaaaactaaaaacaaaagaaaaaacatattacaaaaaaaaaaaaaaaactcgagggagaggggncccgggtaccca

SEQ ID NO: 24700 - DNA, 2051 bp, Zea mays
  misc_feature (2032)..(2032): n is a, c, g, or t
  misc_feature (2046)..(2050): n is a, c, g, or t
ccggccgggcacaatgacctcagggacaacaatgacctccaagacgagcggcagcataaccaccaacctgagcaccacggggaagctctcctccgtgggcagcagcttcatggcgtctgccggcagccgcagcaccagcggcggggtttgacaagggggccaagtactccgacgaccagatcctcgaggcgcccaacctccgcaccttcacattcatagagctcaagacggccaccaagaacttccgtccagacagcgtcctcggcgaaggagggttcgggagagtctacaaagggtgggtggatgagaagaccatggcgccgaccaagaacgacaccggcatggttgttgcggtcaagaagctcaactcggagagcatgcatgggtttgaggaatggcagagatcgtgagtcagagcgcaaggatcctgattatgacagaagctatgacaggaaacactaaatcttgtgatgtactccctctgttcctaagtctccagcgtattagtcatctgcacagtgaccaaggagcgctgatatgcttttactcgcagtctttttaaccgtgcactttcgaataaatctgcaattttggatcgtttcagagatgcagtgtttaagaaaggtttccaggccagttatacatggtcatataccaccccgcgtgccccgcgccgccagcccgcgcctccaccccgtgcgatctctgtttagatcaatcgagttgagtttgttcattccaagtcattattgcatagagatatcaagcctgataattttctcatgggtctcgggaaaagagaaaaccaggtttatgttatcgattttggacttgcaaagaagtacagagatacatcaacacaccagcacattccatacagaacaaagccggagggatgacatggaataaaaaacaaaagtattcgggaaggttggtttaatacactgtcagccttctatggtagggcctgaaagctgggaacaaaaaacaaaagtatgaaaagatcagcgaaaggaaaattgctacttcaactgaggctctctgccgtggatatcctaccaaatttgcttcttacttccattactgttgctcacagcgtttcgaagatgcaccggactaccagtacctgaagaatttgttcagagacctttttattcgggaaggttttcagtttgattatgtttttgactggaccattctaaagtaccaacaggcatagatgaccactgcaccacctcgtgcaattgtctgtacaaggaataaacttaccctcctaccttaagtagtagtagagattgtattgggtatagaaatgtacttcttttgttatgttatatttcattgccccctctctattttggttcctggccttggtttttgtttcttgtattttttttccatgtcgtctagctactgtagttgcccatcgtcaaagttttgtagagtggttagtgttcttggttgacagacattggtgctagatttgggatcagccttcctaaacagtaccatttactttagctcaatgatatgcatcaatgcttgttgtagcagtggacatattgctaagaatctgccacattatgtttgcttgaggtattaatttatccaggtgtttaatgctggagtacagttagaagatccctaatcaattgcttctcatttcagtcgtgtaactttattcatgctacaacaacgactttgagcgaacatgagaccactgagctctagagtgaatgaaggacgtcgtctttggaagtcagacatcacctagagctagggtgtccattcttgacatgtttctcttagtgataggtggatactgtctagttaggaacagagtcttgagggattgatggacgcatgcatcttcaattcctgtgtgttgtattactactggtacaatctccaattcttgtgaacttatgtatttggacttgtgtgaatttgtgatatgaacatatatccatgtgtttgaaatctaaattggatgtgatattttgtgctgcccgtggtattatgtttgtctggnaaaatataataaannnnng

SEQ ID NO: 24701 - DNA, 809 bp, Zea mays
gcaaaaactaaggatacccatgtaaaaaatctaaattgaaccccatgtaaaaatacggttgacaaactagccctaagtgtttgttagaggtacgccgattcgaaccatccagtctccgtgtccagtcgagtctcagcaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatattgaaggacaacatcaaagccataaatgaggccatcgaggaaaatacatgatggttgccgccaagcagtcacgtgacgggcgagcttttgcttcttctctgtttgaggcctgatgtacggaagtagtttttgttgcccatatgctgccgtgttgcttttgtccatttgaccacctgctgttgtaggtggccgcatggccgaaaggtttggtttctgccccgtgctactagtaaacttaaacgtcggacggatgacgtaacttctcactattatcttgtagccaaaaacagcttgttaggattgcagaactaagatttagtgtaaaaatgatccggtttctttcttgctttattatgagatcatcgtgagagtattttgccaaaaaaaaaatgggcggcgcggcc

SEQ ID NO: 24702 - DNA, 1366 bp, Zea mays
gagatctctgactgctctgttgcgtcatcgaggtggaagttagagatctgattccgccccacagcatacctctcacggtctccgttcccctgccgacgagtgggcggccgctgccgccggcttacggaaggttatttctttggcgcactcatgatttagcaccagccaaattgacctttaactctggtgacataagctgttgctagggtagcaaatcaagagctaagaatggcagattcaatggtagcaagcttctgggggcctgtgacatcaacgactgagttgtgcgaggagaattatgcacactcgtcatatatcgcagaattctacaataccatctctaatgtcccatgcgttcttttggcacttattggattagtgaatgctttctgccaaggttttgagaaacgatttagtgtcctgcacatatccaatatgatacttgctattgggagtatgattttccatgccaccttgcaacttctcctacaacagagtgatgagactcctatggtttgggagatccttctctacatgtatgtcctctattcaccggactggcactacaggagcacaatgccaactttcctgttcctgtatggtgctgcctttgccgtagtacatttctttgcccggttccaagtcgtattcaagctgcattacgttggcctctgcttgctctgcatcccccggatgtacaagtactacatacagacgaaagacgtgggtgcgaagcggctcgcaaaactgtgggtccttacactgacccttgggaccctctgctggctggttgatcgcgtcttctgcaagaagctttcgcattggtacgtcaacccgcaggggcacgcgtggtggcacgtgcttatgggcctcaactcgtactatgcaaacacgttcctgatgttctgccgggctcagcagcgcgggtgggagccgcggatcacgcacctccttggattcttgccgtatgtcaaggtccagaaaccagagaagagggaatgatttctgtctctgcttgaaaactgatgatattcagtcggccaccagtaagctaatgcccccaatgtgtgctcagacaagtccgtggcactcttgtatatgggcgcccaaatgattacggacttcaaatgttctgatgtcgcattagattttgtatcatacttaaatcatcgaacagagattgtcctagttttggccacctttcttttggtttcttcgcaattaccgtttggtggtaaattaggactgagttatttatttatttgtttgtcgttgaatggagtccagttgtactagttaccactgcacaagaagatacattcatccacatgatgacatgttaattaattggcttgtgttgctgccc

SEQ ID NO: 24703 - DNA, 2250 bp, Zea mays
  misc_feature (2211)..(2211): n is a, c, g, or t
cgaaaaacagccgtttcctgcgcccgtccctcaccttcacgtcggcgaccgaccggcagaccgacaaactcgaggcaggccccaatggcgttggctcgcctccgcctcctcgaccgctacggtctcctgtcgccggcgctctctgcgacggcgctgcggtccttgggagacctgcgcgcgctctgcacgctctccaccacgctgcggtccggcgccggcgaggacgagatcgagcgcatccgccgcgagttcgatgacgccaagcgcaactacctcagcattcccgccgccatcaaggacatgcccaagatgaatccgcaaggcatttacgtcaacaagaacgtcaagctggacgacctccaggtctacggcttcgactacgactacacgctgtcgcactactccgagcacctgcaatgccttatctacgatcttgccaaaaggcacttggtcaatgagttgaagtatccggagagttgcttgcagtacgagtatgaccgcaccttccccatcaggggtttgtactatgacagacttaaagggtgcctactcaagcttgatttcttcggctctattgaaccagatggttgcttctttgggcggcaaaggctgagtttgagtgagataaaagagctctatggcgcaccgcgtggccgcccgggtcaagctcgtcatcttgttgggctgatggatgtcttctgttttagtgaggcatgtctgattgccgatattgttcaacactttatagatgcaaaactggagtttgatccatcttacatatacgaggatgttaatcaatcgattcagcacgttcacagaagtggtttaattcacaggcaaattctttccgagcctgagaaatttctgataaaaaaaagccaggtgttccgtttcttgaagatgctgaaagagaaagggaaaaagctatttcttcttactaattcgcctttctactttgtagatggagggatgcgttatttgctagaggaccaacattttgatggaaattcctggagggaactgtttgatgttgtgattgcgcaggcaaataaaccaactttctataactcagatcacccattcagggtgtatgacactcaaaaggacaccttaacttttactgcagttgacaagtttctgccagatcaagtatactatcatggctgtttgaaatcatttctacagatcacaaaatggaaaggctcagaggtgatatattttggtgaccatcttttgagtgacttgagaggaccttcaaaagctggttggcgaacagctgctgtaattcgagaacttgaggatgaaatagaaatccaaaacggtgacagctaccgattccaacaggcaaaattgagtataatacatgatctacttgggaaagtccatgcagctgttgttagcaccgagaaaggccaagtctataaagcattgctcaatgagttgaatgcagaaagacgtcaatgccgatctgggatgcgagatttgttcaatacctcttttggtgcaacatttcttacagacacgggaagggaatcatcattttcctatcacattcatcaatatgccgatatttacacgagcaagcttgagaacttcttatcatatgcccctgaatcttggcttcatccacctcatgacataaagatcatgccacacaatgcgaaggtcccagcgagccttttcagtacctcctagttcatcctttctctatttcggtggagaaccaagccgtagtacccccacctatggtttctgtgcgtgaccacgtgacaggattgtggactgctgctgcattcgcttgcgttatactataactgaagcaccatatgatgcatcaatccagcagaccagcaagttagcattctctagaattgccatggaattatcagtcatgtgagtagttaaccgactcatttgcctgtatgacgaagcctctgttttccgtttaaaataaaaaaaggaagcatctgagaggccgcatacttgtgttcccatgaaaccctaccaacctgtaatggccgccaataaaacagtcacacgcaacccatctcgtttccccattttattcgcattctgctacactctttgctgcactcatgttacactgaactcgcctggtggcatctgacaagttttttgggatgagcagaagataatttgggttcgggcaacggataaattagaaaaaaaaaaaaaaaacatgtctaaaanaaaaaataaattaaataaaaataaattaaaatataaaaa

SEQ ID NO: 24704 - DNA, 2195 bp, Zea mays
gcacgagaccattacctagaacatcctaatcgaaaaacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgctgttcacggccacccacacatggcaagcgatccgggagcagagcgtgcgcgtgacggagccgaggctgtcgccggcggagcgcgtgcaggaggccgtcgcctgcgtcccagctgctgcccaggcccagctggagccggcggcggggtttaggcgctggacggtgcgggacttccacagggcgtacagatcaggacaggctacccctaccatggtggcgcggcgattcctggcagccgtggaggaatgttcagggccggacctgaacatgggcttcttcatcagctgcgaccctgcggacgtgctgcggcaggccgaggactccacccgcagataccagcaaggggcgccgctgtccgccatggacggagtgctggtcgccgtcaaggacgagctcgactgcctgccgtacccgaccagcggcggcacacggtggctggggtcggcgcggcggtgcgcggcggacgcggcgtgcgtggcgcagctgcgcgcgtgcggcgccgtgatggccggcaaggccaacatgcacgagctgggcgccggcacgagcggcatcaacccgcaccacggcgccacgcgcaacccctacaacgtgggcagggtgtccggcggctcctcgggcgggtccgccgccgccgtctgcgccgggctctgccccgtcgccctcggcgccgacggaggcgggtccgtgcgcatgccggcggcgctctgcggcgtcgtcgggttcaagcccaccgccggccgcctctccaactccgggcttcttcctctgaactggaccgtcggcatgccggggatcctagcagcgacggtcgaggacacgctgatcgcgtatgcggcgattgctgatcagtcaaaaccaagccctttgcagcagcctgaactgaacctgcccatgctgacacgcacgaggtccatgcccagcatcaggctcgccaaatacgcaaagtggttcgacgacagctcggaggacatcaggagcctctgcgggaaggcgctgcagatgctgcgcacgcactacggctgggagagcgtggacgtcaccgtccctgagatcgaagagatgcggctggcgcactacgtgaccatgggctcggagtgcactgcctccctcgccgccaagtacctggacagcatggacaggtccgaggtcgggtgggacgtgcggatcgcgctcagcgcctacgggtccttcagcagccgagactacctcagcgcgcagcgtctccgatgccggcagatgtacttccacgagaagatcttcgagactgccgacgccatcgtcacgccgatgacaggggtgacggcgtacgcgctgcaggacgacgcgctgagaacgggggagctggactacatcaacggagctgcgctggtgaggtactcgatcgcgggcaacttcctggggctgccagcgatcaccgtgcccgtcgggtatgacaggggagggctccccgtggggctccagttcatcggccgcccgtggtcggaggccacgctgctgcacctcgcctacgccatgcaggaggcgtgcgggaagaaggtgctccggaagcccaaggtgcactacgacctcctcaccaaagagtagctccagcgagcatcgatccggcagattgctctctatgaggcgcgcggttgctgattgcatgcacctctagtgtgattgattgtttgtttgattgattgagcttgtgatgagagagtgggggaagttgaatggaatgccgtcaatgtcggacaactctcaactaggagaagaaaaaaaaacatggttgccagcaccatgcatgtgcaccaccattcgttttttaatgtcgtcctcattgaaacattatgtaagtattgtgtatacgtgtgcttttaaaaa

SEQ ID NO: 24705 - DNA, 892 bp, Zea mays
aggtggggtgacggccagggtttttaccatgtcgcggacaataataaaacgaccggccaggggaggcgcgacttaatacagactccactatagggacgaatttggttcccgggccccccctcgggggtcggcggccgctttttttcttttttttttttttttatcatcattaattgcttatttatgatatattattccatcaagatcacatttttcacggtagccatacatgaggtcctcctttttttaatggtgtactagtagcttagaagctaacaccaaccaaggaaggacaaccaagaagctaaggcctggtttattattaactggaaacataaaataaaaagtagggtttgtttattgcatttggtatgtatcacccaactgtcggagtcatggcgacggtgtcaacgaagatacggacgcggtcggggcgaaggtccagcgtcacgggcgacccaacaggcagcacctggatgtacgcgttgggcatgtccttgagaatagtctccgtcgcctccttgatggacatgcccaccacctccggccacgacgtcttcttctcgctgctgctggtagcagcagcatccacgacgacggaactcatcatctccgatccgacgacgatgtgtttcgttatgcagtcaacaatgtgatgaagcatgcatgtgagacctaactcccctgcttgtcgacgaagaagatggctatgctatgtgagactgcccgccgagccgggactagtgcgtatttatggacccatccggccgggcagagagagctaggagagagtgcaatgatcagcatgtcgacatgtcctttcggcgttaacttgctgcagccatggccttccatatgcgccaaatgccctatctacgaagatcccggccgg

SEQ ID NO: 24706 - DNA, 761 bp, Zea mays
taggggcctttttgggtttttttttttcatcattaattgcttatttatgatatattattccatcaagatcacatttttcacggtagccatacatgaggtcctccttttttttaatggtgtactagtagcttagaagctaacaccaaccaaggaaggacaaccaagaagctaaggcctggtttattattaactggaaacataaaataaaaaagtagggtttgtttattgcatttggtgtgtatcacccaactgtcggagtcatggcgacggtgtcaacgaagatacggacgcggtcggggcgaaggtccagcgtcacgggcgacccaacaggcagcacctggatgtacgcgttgggcatgtccttgagaatggtctccgtcgcctccttgatggacatgcccaccacctccggccacgacgtcttcttctcgctgctgctggtagcagcagcatccacgacgacggaactcatcatctccgatccgacgacgatgggttttgttatgcagtcaacaatctagtcgctcactgcacaccgagcgaggtgaactccctgcttgtcgacgaagaagatgtctacgtgagactcccacccgggccggcactagtgcgtatttatggacccatccggccgggcagagagagctaggagagagtgcaatgatcagcatgtcgacatgtctttcgtcgttaacttgctgcagccatggccttccatatgcgccaaatgccctatctacgaagatcgcagcccggccggc

SEQ ID NO: 24707 - DNA, 1857 bp, Zea mays
ttttttttttttttttttgacacataaacacaatacagcacatttccttcttttagtttcagcagttagaacaacttacagggaagctggaaacataagaaaattggcgatgcggaataaaaggccacacaaggcacaacacaccacagcattacacaacagaaatatgaatcacaacccaaatctagctgcatgatatcgtttgggaatgttacgttatgggcaacctggagaagcacactttaggatggcttgccgacgtcaaattggaggaatgtgttatcaggcctctaactcatcaccctggttaggagagtccgcccgtgcttttggagcagacctgttaagcgaattcctgcgggttggtcccttccctgattctctgccaacattatttgggagggataaccgcttcttggctggtccattcacttgcacaagcttatcttttgaattgtgcacatccttagaacctatatctgttggctgggagctgacttcctcaaaaacttcacccacagcctttgccttctgtttggatgatcctaaagatgtggatggtaatacatttgctggtcgtgcaaatgaagtacaactaacatctgaatatgactttttgtggttaacacctttcttcttgctcagaccaggagtatttgaagttgacactttaccctttggtgtgatctgagaatttgcttcctcatccttatcttcatgcgttggcagactctctttggcattacagtcaagtaacctgttctcccatggacgtacagccatccacctgtctaaccaatttgactcccagtggttctcaccaagttcaagaccttgcaggctcaaagaattttgttgcttggaaccagcttgccgctgatgagtcaaagcatatgccattgccctctcacgcttagcagcagcttctcgtcttttcagtgctttagcttgcatttcctccatggaaccaatactgccacaccagcctccctcgacttctcggacatggttctcatgatcatcttgttcaggaatctttttccgtgccacttgattttctaaggcaacacgaacttgtcttgctcggacacgagcttttgcttttaccagcgcttgcatacactgaagcgtctctgctgtctgccttctaacagaatggcccctaataagggcttgaagtagaactattcctttcaaagctcgtaaagcacgcctagccaagaacgctcgaaacgcagactggacaacagttgcggccaaatcttcgttactatgatgttcagcctgagaaatgtgcacatcaagcggtgtactgtctgaaaaaaatgaatttgaaaccatttgtgcgcttttgttatcagtcaatgcttcactttgtactgtaatttcttcgactgcaagtgcagctccgggatccaaagaatgtttccgtttgtgcagtgattgattagcagagctcttagtttcactgctctcagcgttccaccctttttcttgcttttctgcattctgcgctttttcttgcttccttatgccaaccaaggatttaatccacttggatgagatgcccatgataccccctccttccctttcaccaactcaatgacctcaggccagtatgttgcagtgattggtgcactgagcggaagaagaggagagagcttttgcttgagacgggactgccgggacgagagagaccatgccctctccccccacgcgctccctcgtgtctgccctcttctcttttggttgcgcttggattccgatttctctctcttgtctgcgcttttcgtcccttcgaaggaaaaaaaatggctaaaaaaaagaaaggtagtgcattccccgccggctcgaggt

SEQ ID NO: 24708 - DNA, 958 bp, Zea mays
ccgggctcgagttttttttttttttttttgctgcaagtgtaatcattattcatttctcatttctcttccttctagtatgatctgaactttcatttctgcctaaccctagcaaattatttacacaaatttcagctcaagcggaagtccacaaatcctaataaaaccatcgcgaagtaaagagaaacatcctaataagaaaaattctgatcacacgagaaccggaagagcagtgaacaagaaggaacagagaaaccgcaagcacgaagcgcacgcacggacgggtgtgtccggacggacgagtcatcaaggccggaagagcgccccgatgaagctgaggcagccgagcagcatgcggcagagggagccgcgccagcggcggccgcggcggccggggtcctccctcgcggacggcgtcatctgcaggtacgcgtacgccgcgtgcttcacgagcgggtgccggatcatgtgtatgtccccgcagctgccgcacccgccgccgccgcaggccccgggcgagccgcccgccgcggcgtactccggcgacgacaggatgtcccggaggctggtgtacccgtgccccccgccgccgccgctgctgttgctgtcgtcgccgtcgctgccggcgccgccgttgggtatctcgatcaccggcggtggcgcccactgcggcgccgcgcgcttcttgggcgtgcgccagtgccgcagctcgaagtcgccggcggccaagccgttggcgagcggcgagcgcggccggcggcactgctgcgtcggcggcgtcggcgtcagcgaaagcttctgcggctccggcgcgacggcggctggcgccggcggcatagcagaagcggtgggggagggggggggcggtcgagtgaagcggcgagggcgcctcgtgctggccggagaagtcgaccaggactccgcttccgctcgctggaacggtggtgtggtgcagactgca

SEQ ID NO: 24709 - DNA, 2347 bp, Zea mays
gtacgaggttttgtaaaagggaaaattaaaaaaatcgaggcacagggcatacgcttatctaagaatacttttgtatttagatggcaacactgacacgggtgcattcacgcagcttgtacgccaatttcaggagccaggagggataaaaaaaacctagctaacatcatgtagcataactttttaatgacacaatctaatgaaataatctcaattcacattggagtctgcttgccgaggtgacggctagcaaagcattttgattctccatgccgtgaggcaacaggtggagccgtgcagagcctacttcatgctattgtacataccgtcaatgatggtctgatagtgtttcagcagctgtggccgcttcttcttgtacgtcggggtgataaggtcgcgctccatgtcgaacggtgcggggtccagatgaacagccctgatgagctcaaagcctttgagcttcttttctttacccatctttgtaagctctcccaagatgaactctctcgctctagggtcttcgcatatcgtggcaaattctccagttaccccgttcgactctgcccagcgctccagtgcttgcgtgttggggttcacaactgctaccaggctcgactcgaagctgttgccgtagacccaaatcgaatcaacagcaggagtttgaccaaagatgttctccagattctcaaccgcaacgtactctccctgtgagagcttgaagatgttcttcttgcggtcaatgatcttcatgcttccgtcagactgccactcaccaatgtctcctgtgtggaaccagccatcgaccaagacttctttggttaggtcctctcgcttgtagtatcccgagaacaaggtgtcccctctgatgcaaatttccccacgaggcgtctcgctcgacagtgcatcataacccatctcagggacagactccaggcgtacttcgacatacgggactggagggccgacagttcccagcatggacatgttgttcggcagggaaacaaaggacccagcgcaggtttccgtgagcccgtatccttgaaggacatgggagcatgttaccacacgcagatactcctcaacatgtctagataggggagctgcgccagatagaatcagccgaacccttccacctagtccccgtttcaccttggtgaagaccaggcgatcaaacatggcagcagcctcttcatgcttgtttcccttcaacatattgccttgtttgtatttgtaagcaacattgaacaaggttttctttaggaaaccaccagctgtaattttatcttgcaatcctccataaattctgtctagaacacgtggaacagcacaaaaaactgttggtttgagttctccaatgtcttcaaccaagagtttgacatccccacgccaaaatccaattgaagcaccatgacgaatgaacacctcctcaatcacccggtcaaatatatgagcaagcggaagataggaaatgtaaacgtcatccatgttaagctgctcgtttgagttgctgaggaactcatctactgctgaaacaatggtaacaatgctcttgttcgagattagtactcccttaggatcaccagttgttccactggtgtacattattgtacatatgtcatccttttccttgggtggaagttcaaacttctctttacctcccagttgcagaaactcttcccatgagtagatggacaagccattctgttcaactatttccttgtgcccaggatcaaccttaccgaagcttacaagtgttttcagatatttggtcgcattgggaaatgtcttgagcatctctccgatcttcttttcctcaacaaaagcaatctgtacctctgcatggcacaatacgaattctactgccccggcaccaagcgtgtcatatagtggcacacagtagatgccatgggcattgcaggcctgcatactgatgacccactcaggagaattggctccatagatgccacaccggccgcccttgccgacgccacagctccggatggcagacccaacatcgagcacggtgccgggggcccccgggtaagtcagccatgtgtagctgccagcctttccgtggacaatttcgcggcggcccagcatcttgttgtcggggcacttctccacggacaagcggaatatgtcccagcagcactcgagccccggcacggcgggcggcgacgcggcgttgccaccggccgcgcatcggtacgtgggccccgccgatggcgccccgccctccgccgccgcctcccttgccggctccacctgcacgaggtgcttcagggatcccgcgaccatgtctgtctgttccctgtgctctcggctctcggcctctccctccctcctccct

SEQ ID NO: 24710 - DNA, 1852 bp, Zea mays
ctgcaggcgatctcaagatgtatgggtttaaacaagtatcaagagctaaaacatcatatttttcttgaatatttcactattttttaatcctaaaacaaaagtgttgtggaaaaggcaattgttgttcttctgttttgtttgtatatataacaagcgaacatttcccttgtctgaattcagagcacgacatagacgtaagatgtgatcgaataaagcatcgttagaagcctgtcgagtggctgctggatatgcattacacacaacctcacacagaaattcaaaggaggagccgacaaggaattatcaggccagatgcctggaggcttggcagtaaactatacactgccccttcatcagttacagctctgatctccgatgccgtgttcgactccagtagtggtagttggtagatcacagtgtgcgatgtcatgcttgaacatctacacacacactatgacatcgactacttcacgatcgagtacgtacaataatctttcttccggatccatcttcgtgagatcaactaatcttcacctgctggtcgcgcatgcagtttatgacagaaaggtatatatatatatgcaattgcgatagatccatatatacatgcaaataacctgctagttcatcagcactttgaattatgagcatgcatttcttcaagccgacgccggatgctgagaaaaccacaacggtggatttgtgcaaacaccaggaattaaagaacaagactgtgagagcgtgtgtgctcctgtcctacgtacgcatactaggaccatcgtctacgtgctcagatttacctcgatcgagatcgcaagtgaagaaggaacacggcacatagacgacgtatgcatggaagagtactaagatattggcacggctcaatcagaaacagcagcggcatagcacatgatctcgcgcgcgtacgtcgtctgagtgagccgagccaacatcatagctactattccatttctcctcaatttccttttcgatgccatgcagagagtggggtgatgggtagacggcggaatgggagcatgcatatggaggaagggaaagggagcatgacagccatggccatgcagaagatgaacagcaagcagtatagcttagctatcgggtggagaaagaggacggaggtggtggagaagaaagcagctagagctagacgagagcgaggaggaggccggagaggcgatggatggggagggagaggaggaatggaggaagcgagggctcccctccaactttttatgcagctgggcggctgggcagctctctctctctctctctctctctctctctccggtgtggtgcgtgggtggggcattcaagtccctccggctaccaaatgagtaagacaggctgcagcattaatggaaaccatggccgccctgtctctctccatcatctccagcacaagagcaccatggggatggaggaggagtacgtacatggatgcatatgtaggtgcgacgacgtaaatgagattccccggccgggccacccacgcaatttgcattgttgcccgatctgacccctccctcccgcagaggcagagcttgcatccggcctgatgagcgagtgtgtgtgagccccggccctgctgcatgtgtccgtgtctctctctccgtccagctctgagctgctgctgagctcgtctcgctagctcatctatgcgcaacgcaattgcaagccccacacggcggccagcaacagcgactctgtctgcctgcctgcggcggtgctagctagctagctagctgtgtctagcgtccgcgagtgagaaataaaccctagctagaccgcgccccaggctagctgaggatgatcggacgggaagcgaagaacg

SEQ ID NO: 24711 - DNA, 4588 bp, Zea mays
taagaaagatttcctattaaaaaacgtgttttttttcataaaaatagttttaaaaagtacatctagtgcaacgagaactttatgaaactccaagtcttcctaccattacatttctttttttcgtatgtatgctatttattagtggcaatattttactagcagatagcctgttcgtttaactttaatccgtaccgatttctacgggttttatagtatttttatctaaattgatgctgcaacagttcaaacatccgaactttaatttaattttatctttttttgcaaagaagatttacacatttttatataagttccaacagcaggtttaaacttttttttttcttcctcaggaatattttgcgaagcgacgcatgtgcatcccctggcccgtgggtcgtgcatgcctgcagagaatccgttctcaaatcctgcaatcctgtgtgcccagcacaggttccattttcttatcgctgctagggttagaccttgtatcagcacttcagcagcgaccacttcaaccgcccagctccattgaccaccaccagcatgcaggtagcagcagcaacggactactaactttattccaaattaagtatacttataatacttacatttttaaatagttttttttgctactttctttacttgtacaatgtaatcgttacatgttgagatatttttttaatgaagtaaacatatagtttttagataatattgaccgccttttaaaagtatgacatcttggtgaaaccagcagccaagcacgagtgcggctccggtccgccgaaaagacgcttccgaaatagtcaaaacaggcaaacagcaacgcgcagaggcgtgcggtgtgcgcgactagccttcagccttctccagttctctcctcctcgtcccccccccccccctcacgcctggacggaactgaagccagccagcctgcccagccaaggtgaccggagacaagtaaaaatctcgccggtcttctcacagaccacaaacattgcgcttgctgcccagctataagtactcgccggactaggcggccaactcatcccatcccatttcatccatctcggagcagaggcaacgcaatccggcaaaaaggcgcttctttcttgccctgttcgggacaggacacagacacagagccaggagaaggaaccgccggaggctaagcttcttcgtcgtctttcctggtaagaacgagatccgccctgattcgtcgcgttctcctctgcgaattgctttcgcgaggtcactggcatggggaatcctctgcgcatttgcggcgtatctcctgttagcgttcgcctcttcggtcgtaatgcgatgacattgcggtcgattgggttcaagattcgtctgttctatcattcgtttagctagcctaatcagccgctggctaacgtctcggtgctcgcgcgcctgctgacggtcgcagggcgcgctcaagtggcgatggcatttgcggtctccgacgagctgctgggcaccttcgtgccgattgcggtgtactggctctactcggggctctacgtcgtcctggacgggctcgggatggacgactacaggctccatcccaagggggaggaggaggccaagaacatcgtttccaggtcgacggtcgtcaggggcgtccttgttcagcaggcgtttcaaatcgctgtctcccttcttctcttcacggtaatcactctttccaacatctaactgccaaaaaaagtgtgtgattagtatttggtactggactactggtattttgttagttattttctagacggtgaatttggtaagtaggctgctgtttacaaaagatggttttggtttgtttcaacagcaaagcaagcagttgtggatccgaatcgattgaccttttcacatatatcctttgcttgatgaatttcttaggtttcttgtattttttgtcatggtaattgatggagggagaatcggtagattcagaaggaatggctgagattaactaaggacctgaacttgtctcgagcttaattgttcctattaagtagcttcgtttaatttcacatcggcacttggactgttacttggagtgattataaaagtaaactgagttgatggcattgaaatttacaagccactaaagtttgacctagtgcactgtatttattaataacattgtagaacttcctcctcctagttttgaccaacattggttctagatgctgcttgtggacttgactttgaaatttcacctgtgaaaactggacttacaaccatgaaatttcctgaaactgcaggttcttggtgatgagaatggggctgtgaggaagcaacctccggctctggtattggcgttgcaatttatcgttgcaatgttcgtcatggacacatggcagtatttcatgcacagatacatgcacatcaacaagttcttgtacaagcacgtccactctaagcaccacactcttgtcgtcccctacgcttttggagctctgtacaaccaccccctggagggactcatcctggacaccatcggtggcgcgctctcgttcctcatctctggcatgaccccaaggactggcatattcttcttctcgttcgcgaccatcaagaccgtcgacgaccactgtggtctgtggcttcctgggaacatcctccatgtattcttcagcaacaacagcgcttaccatgacatccaccatcagctctacggcaacaagtacaacttctctcagcccttctttgtcatgtgggacaagatccttggaacatacatgccttacactctggagacccgcaagggaggtggtctcgaggcgcgcccggttaagctcaaccaagcacagcagaccaaggctgattgagcagtgtggtttctcctgtttatctactacttcccctgattttttccccttctgactgcatttgtactgtagaagtatttcctgtccatatagtaaaatcatttaggcaaatgccatgttgtacccaacagatatagcaaataaaacatcttgttaatggagatccattgatgtttgttacaaaaaaaaaaaaaaaacctctgggttgcatctgtgtgtgacaaggagagctgatattggcagcgtatgcaacagcgagctggccatcacactctggatgctgatgctttgcggttttagaatttgaaagggagcagtgagctgtgcctacggtcctggctgtcggttggacagtgccagcctgaaacatggttctggctgctgtccagcatctggtgaccatgaagtgatgggcaccaagcagcatttacccacagaggaatgtagtcttcagtgtacactgaatgatctgtagcaaataaagcaatcacaagtcacattgtcacaatcacttggagaataaagatttatcatgagattcagtcatgccacaaagtggtgcctagttcccgttgttgaggcgaccacagaggtccttagagcctctttcaactaccctctttcctaagtgaccacaaatatcaagctaggatttccactagaataaaagggtaatacaaactttctgggcgtcttttgcaagcatgaatcaagggcatcatctggcaaaacctagccagctagggttccaagaaccaaagagtaatggaataaaaatcaattcaccaatgggtgccacaattgctcaagagatagatcttacctctagagtcgaattcaatgaagagctcactcaaatctcactcacaaagatggggatctaagtaagagtgggatattctgggagtttgagagagagagagagagagagagagagagagagagcatgtcctcaagttggcaagagagtgaatgaataagtgagagaggtgttggccacccaaatgtcagccaagcctctgttgatagttggagcatggtgataccccctcccccaccgcaccagaaattctagccatctggcctagaattcctagggcggggtggcggttcttacgcaaacaatcaaacggaggataaaaaccctaattgtgaataatagactcaaacttttgcatagaagggagggaaattctggttgaactatagtttccaacagagacaagatgctcggcaatttctcgggttagcttagaaatgccaagtaattttttagttgggggaaaagaaaattttggtggggaaggaaaataggacaacatcaaaaaaaggtatgatttttgtggggtgtctaagaaatttgtgaagatcaattcagcacttatgacacctctggtaatgagatttctatccacctttgtactatgacatcttataacttaagtgaagtttaaataaatttgaagtaaatgacttttctttcattcgaggatgacaccatagcttcctttgaactaatattgaggagtctcatatttcatatgtattttcacataagatatcactaaaaaatctcacgaaatatcgttagttttttatatgcatcatcatcatcattaccatcatctatttatagaaatcaacaaatagaattgatgtacctacatagaacatattcgaagaaacaatttatgtacgcatatattcaatttctattgcttacgtatggttcctgctttaagccgcac

SEQ ID NO: 24712 - DNA, 1862 bp, Zea mays
  misc_feature (1778)..(1832): n is a, c, g, or t
  misc_feature (1852)..(1852): n is a, c, g, or t
gcagagaacccgttctcaaatcctgcaatcctgtgtgcccagcacaggttccattttcttatcgctgctagggttagaccttgtttcagcacttcagcagcgaccacttcaaccgcccagctccattgaccaccaccagcatgcaggtagcagcagcaacggactactaactttattccaaattaagtatacttataatacttacatttttaaatagtttttttgctactttctttacttgtacaatgtaatcgttacatgttgagatattttttttaatgaagtaaacatatagtttttagataatattgaccgccttttaaaagtatgacatcttggtgaaaccagcagccaagcacgagtgcggctccggtccgccgaaaaggcgcttccgaaatagtcaaaacagcaacgcgcagaggcgtgcggcgtgcgcgactagactagccttcagccttctccagttctcctctcctcctcgttttttcccctcctcaacgcctggacggaactgaagccagccagcctgcccagccaaggtgaccggagacaagtaaaaatctcgccggtcttctcacagaccacaaacattgcgcttgctgcccagctataagtactcgccggactaggcggccaactcatcccatcccatttcatccatctcggagcagaggcaacgcaatccggcaaaaaggcgcttctttcttgccctgttcgggacaggacacagacacagagccaggagacggaaccgtcggaggctaagcttcttcttcgtctttcctgggcgcgctcaagtggcgatggcatttgcggtctccgacgagctgctgggcaccttcgtgccgattgcggtgtactggctctactcggggctctacgtcgtcctggacgggctcgggatggacgactacaggctccatcccaagggggaggaggaggccaagaacatcgtttccaggtccacggtcgtcaggggcgtccttgttcagcaggcgtttcaaatcgctgtctcccttcttctcttcacggttcttggtgatgagaatgaggctgcgaggaagcaacctccggctctggtgttggcattgcaatttatcgttgcaatgttcgtcatggacacatggcagtatttcatgcacagatacatgcacatcaacaagttcttgtacaagcacgtccactctaagcaccacacccttgtcgtcccctacgcttttggagctctgtacaaccaccccctggagggactcatcctggacaccatcggtggcgcgctctcgttcctcatctctggcatgaccccgaggactggcatattcttcttctcgttcgcgaccatcaagaccgtcgacgaccactgtggtctgtggcttcctgggaacatcctccatgtattcttcagcaacaacagcgcttaccatgacatccaccatcagctctacggcaacaagtacaacttctctcagcccttctttgtcatgtgggacaagatccttggaacatacatgccttacactctggagacccgcaagggaggtggtctcgaggcgcgcccggttaagctcaaccaagcacagcagaccaaggctgattgagcagtgtggtttctcctgtttatctactacttcccctgattttttccccttctgactgcatttgtactgtagaagtatttcctgtccatatagtaaaatcatttaggcaaatgccatgttgtacccaacagatatagcaaataaaacatcttgttaatggagatccattgatgtttgttnnnnnnnnnnnnnnnnnnnnnnnnnnnnnnnnnnnnnnnnnnnnnnnnnnnnnnncggtgccgtaccaaatcaanccctggggct

SEQ ID NO: 24713 - DNA, 1116 bp, Zea mays
gtaaaaaaaaaggtcttttttttttttttttggtgaaattcaaaagatagatgactgtacagtttacactggagcagttcaatatggcctagcactctagcagttagcttggataaggcgctgaatatttctggtgcctacatgcttggtgaaaaaaaaaccatggagattccagaataaatatcgatgcaaatgaataagaactagaggcttgcaagtacatacgattgcgtgtctccacacttacactcatccttaacccgtgattgtggtttatagatatagttctatcttcctactgcaagctgagttcactgcatttccaagattctcaattttttcatattccacttcgaacatgaccataacggtaccatcttttccagtgtcatagtcctgtttgatatcttcagcttcgaaatgttgtagctgatgatagactgttcccaacagattaaatggtacttccatacccacacgagcctttggtttcacaagacaagtaggagcatctttaagacattcagaagcaaccccaccataagccctcaccagtccaccggttcccagttttatgcctccaaaatatctaatcacaaccaccatgaccttatcaatgccagaggaaatgatggcagagtatattggcttcccagctgtactagaaggttcaccgtcatcgttgtaacggaattgatctcccagcttgtatgcccagcaattatgggtagcacgtggatccttgacctgatccaggaaggccatggcggcacgctcgttggggaccggggccgcgatggcgatgaacttgctgcgcttgatctcgcgctcgcagctcacgcgcccgacgagcgtcgtgtacggggagggcgtcgcggatgaggaggacggggccgccatagcccgcgcgggtgcgggggcttgggaggcgctggcgcaggcgaaactacgccggactgtagcggcgtctggctgggagagcaggaggggaatggagcggaggcgtggagatacgcgcaggcgcaccaccgccatgtcgcggggcgcgtcgctttggtggaaaccgtgggtgcccggattccgtgtaccggccggagctcccggccggcctcgagg

SEQ ID NO: 24714 - DNA, 2157 bp, Zea mays
cccgataggacaaattcctctggaatttggttgatgctgaacattttttttctgagatgatgaactgtatgtacaaagtacaatgacgaggcattgatcagtatgacatcacctggagactattcgttgggaaaacgtagatggcccgattggggcacagatcagaaaacgaacacgtctttacattacaatgacctttgttctttagatgccttatagcaaaaaaaggtgatattctatgtacagttgatcatcggccacaagcttcagcctcaaagtcagggaagacgacaaacgcaatggtcagaggagcaacatagattggcgagttaactgaaacttccactggatacaatgaagggatgccaccatcttcagtgagctcaagaggggctccattcagcagcatggtccgggcaaaagggttcccatctttcgacgagagatggtactcttccctcttggaaaacccatcggaggctttgctcccgacccaagaaaccgtcctcttcaggccatggacaaaggcactgtccctcctgatcccttgcccttctgcgaggttgacatttaggtcgttcctgactgagaccatgaagcccatcgttcggtgcaggttcagcaagagaagagtgacgccacccttttgcttggcgcaatgcacgtaggcgcgcaagtacgaagaaccactgatgtctacagaaagaactcctgtccccatgagctgatgccacaacaaggcactgtagtaatccgggtttggtacgaaagtctcggtgtcaagaaggccgtaattgccaccaatcagcgtctgtctgcagtagaccttggtgtcatactttgctgactgacccagctgatcaagataccagaagctattgagaaaagtattggacacgagccggctgccactgttatatgcaccaccagattcaccaacccatggagcagaccatggtccatggcgctgtatggtgagttggagacttctgaatgtgtcggaagtccggctcagatactgcgggttcaaaattctgtttggaacctgtggatcattaccagcaccaagattgtaaatatgatgagtcattgcgttgagaacatttggcccggagacatcgaggagctgagcaaaccatttctggtcataaaatcctcctggggctacaaccagtggtttgttggaatctccgtatagctcgctgatgatggtttggagttcaactagatcttttccatattgttcagctgacacactcgcaccaactccacttccgctcaattcattcccaaattcccaagaatcgataggatagttctttaaaacggtatattcaatgaattctcgagcattgctagaattccagggaccaccccagacaccttttcttgtctgctgtcttcctcgaagcgcgttgagaccgaatgtaacaactgcaccagttttcaggaacatatcattaatatcatcccatctttccaatgttatgcatccttgagaaaacccaaaaaggccacttgaaacctttgtaaatgggtcgcatggcaatcctaaatttggtgtgccatataacacttgatcttgtaaggagcctccaactctgatgcgcagcggactgaaggcttggatagctttagccagcaaaggattagtcaagtccagatttaagacagaagccctttcccatggacactggtcgtagttacacttctctggaggccaccaatcaatggtggcgcaaacaaactcatcactggtcgaagcaatcgtctcagagcctcgaacaatgacagttgcatccgcgtaatcctctgatcgaacccgcgcaggtagacagagcagaggcaagagaaagagagaccataacctcatgcttccagaacctgaacagacgcaacgagcccaagaacgcccgcgagtcggctcaggtactcctccccagaacgtccaagaaaaggacctcctctcgtcccaatgcaggcggcagggcaaatcaagaaaagctcgagcctttcgccgctgtcacgggtccccgtcgctcgtggataaagagtgggtgcggggaagaagagactggagattctcccgggccgcccgcgggggctccgcgtcgctttgtactgtatccactctgcccctttcttccaagctactcc

SEQ ID NO: 24715 - DNA, 1400 bp, Zea mays
gcaggtcgagctccgggaacgccgactcgttgaaagatcacgccgggcacttgggcccgctgtcgtgcacgttcacgacgcgcagcgcccgcacgcccagctcccgctcgaaccgcctccggaaggcgacgttcccgacgcgcgggccggcgaaggagaacacgcacaccggcgccaccctgtcgcccggcgacacgttcgcgcgcgtctccgcgatgtcgaaggcgcacagcatcgccagcgcgctgcccaggctgtggcccgtgaccgtcacgctcacctgctcgccccgcccgtggtacagatccaccagcttgcgcacctcggccagcacctgctcccgcgccgagtaccggcagaagcggcagccggcgcccttgtccgtgtacagcgccgcgaaccctcgctccaccttcacgtcggggtccgggcaggggacgcccgtctcgcgcagggggatctggttggccgtcagatcggccacccactcgaggcgggtgagggtgccgcgccacgccacggcgatgtcccggcggccgagccgcgccgtctcatcgtcggatggacacggccacgtacccgatgaacgtgccggactcgctccacatcttggcgttggcggccgtcttgatgccgaagttggggaacttgaggtcgttgcaggtggcgtagaggtagcgggtgacctcgtagccgatgccgccgaggccgacgtcgtggaagaaggtcttcgccgggtacttgcagctgccgcagtagggggagaagcggtcgtagtcgaagctgtcgtaggtggcctgggcgaactcgccgtagcggatgagctcctggaggagcacgccgtcgatggggtccagcaggccctcccagttgttgctgccgtggatctccggccaccgcgcggcgagctccccatcgtcgggcgccgcctgatgagagctgaggtccacgtcctcgatcgtcacaggggcggcctcctgttcggctctcgtcgccgaggcgacgacgacgagatagcggcgagaacgacgacggcgctgaagcgtgttcgtcagtgccacagcggggaacccgccggcccggtggtgcacggtggggacgaggctcaggcaggaagatacggtggccgccatcggctgcttggtgctgcggtcaccgtagttgtcgacgcggtcagagatcacgcagcacgccgctgtgtgtttgttttgaatgtgagtgtagtctagctagactactcgtgcgcgcggtggctagctacagtcttatctttcttgctttcttgatgtgtgtttgagctcggtccccggccggcctcgaggtacccaatgatatatggcgatgcgtgcatgggatgagaactgacaagtgctccccggccggcctcgaggtacccaatg

SEQ ID NO: 24716 - DNA, 2082 bp, Zea mays
gcccctctctcgagtttttggcggccgcttttttttttttttttttgaaagatgaaaatcgttttttttttggcgctgcaagcagcagcttttctgggtcaatttacaaaaataagtagagagaattacaatccaagacgacctttctgcagccacacgaacgccaacggtgcgagcttctcaggcagcgacgtgcccatcccgcacgtcacccgcatcatgcacgccatgaacgcgccactgagctgccgcgcgcggcaacagagtaaccgactgccccgcgcacgtacgcgaacgccacacgcactaattaacgctactatcagagtattgctgagcttcacgcggtgagaccgagccgctggaggtgatggtcagtgtcctccgggtggtcgtcgagcaccctctgccgcggcggcagcacccaccggccgtcctccgtcctcaccatgcccttgttctccgcctggtaccacacgggcggcaccatgtggtcctcccggaggaagtcggtggacttgttcaccagcgcggggtccctcccgcggggctcgaaccccgcgccggagccgcggaagccgtccagcaggtgcaggtgcgcctccaggttgtggtagcacgagaggtccagggtctccttgaggaacggcgacaccttgtggtccagctgcagcagcacgcccaggtgcgtgtacacgccgccgaggcccagcctgtccgccgcccgcaggacgagctccgggaacgccgactcgttgaagaacacgccgggcaccttgggcacgctgtcgtgcacgttcacgacgcgcagcgcccgcacgcccagctcccgctcgaaccgcctccggaaggcgacgttcccgacgcgcgggccggcgaaggagaacacgcacaccggcgccaccctgtcgcccggcgacacgttcgcgcgcgtctccgcgatgtcgaaggcgcacagcatcgccagcgcgctgcccaggctgtggcccgtgaccgtcacgctcacctgctcgccccgcccgtggtacagatccaccagcttgcgcacctcggccagcacctgctcccgcgccgagtaccggcagaagcggcagccggcgcccttgtccgtgtacagcgccgcgaaccctcgctccaccttcacgtcggggtccgggcaggggacgcccgtctcgcgcagggggatctggttggccgtcagatcggccacccactcgaggcgggtgatggtgccgcgccacgccacggcgatgtcccggcggccgagccgcgccgtctcctcgtcggtggacacggccacgtacccgatgaacgtgccggactcgctccacatcttggcgttggcggccgtcttgatgccgaagttggggaacttgaggtcgttgcaggtggcgtagaggtagcgggtgacctcgtagccgatgccgccgaggccgacgtcgtggaagaaggtcttcgccgggtacttgcagctgccgcagtagggggagaagcggtcgtagtcgaagctgtcgtaggtggcctgggcgaactcgccgtagcggatgagctcctggaggagcacgccgtcgatggggtccagcagaccctcccagttgttgctgccgtggacctcccgccaccgcgcggcgagctccccgtcgtcggccgcggcctgatgagagctgaggtccacgtcctcgatcgtcacaggggcggcctcctgttcggctctcgtcgccgaggcgacgacaagatagcggcgagaacgacgacggcgctgaagcgtgttcgtcagtgccacactgctggggaacccgccggcccggtggtgcacggtggggacgaggctcaggcaggaagatacggtggccgccatcagctgcttggtgctgcggtagttgtcgacgcggtcagagatcacgcagcacgacgctgtgtgtttgttttgaacgcgagtgtattctagctagactactcgtgcgcgcgcgcggtggctagctagctacagtcttttctttcttgctttcttgatgtgtgtttgagctcggtcccggccggccggggtgcccgcaatcgatgtatgccgatgcgtgcatggga

SEQ ID NO: 24717 - DNA, 864 bp, Zea mays
ggtgatgtccccgcccccacgccacggcgatgtcccggcggccgagccgcgccgtctcctcgtcggtggacacggccacgtacccgatgaacgtgccggactcgctccacatcttggcgttggcggccgtcttgatgccgaagttggggaacttgaggtcgttgcaggtggcgtagaggtagcgggtgacctcgtagccgatgccgccgaggccgacgtcgtggaagaaggtcttcgccgggtacttgcagctgccgcagtagggggagaagcggtcgtagtcgaagctgtcgtaggtggcctgggcgaactcgccgtagcggatgagctcctggaggagcacgccgtcgatggggtccagcagaccctcccagttgttgctgccgtggacctcccgccaccgcgcggcgagctccccgtcgtcggccgcggcctgatgagagctgaggtccacgtcctcgatcgtcacaggggcggcctcctgttcggctctcgtcgccgaggcgacgacaagatagcggcgagaacgacgacggcgctgaagcgtgttcgtcagtgccacactgctggggaacccgccggcccggtggtgcacggtggggacgaggctcaggcaggaagatacggtggccgccatcagctgcttggtgctgcggtcacgtaccgtagttgtcgacgcggtcagagatcacgcagcacgacgctgtgtgtttgttttgaacgtgagtgtagtctagctagagactactcgtgtgcgcgcggtggctaactacagtcttttctttcttgctttcttgatgtgtgtttgagctcggtgtcccggccggcctcgaggtacccaatggcccccctcgagggtcccaa

SEQ ID NO: 24718 - DNA, 965 bp, Zea mays
ggtaggcctataggtaatgaacaggttaccagcatgcggcactacaaagtgctcgaggcctaaatctctgaactttcagcgaaacgtaaccttaagcgatcatatatagctttacaaacgacatcgaccacaaagctattttgaaccaatcagatgcacatgttactctttcattgcaacaaaatgcaatatggaaactgaattcatccctgaatgaaaagtagatgaataaataagggtaagatgaaatagaccacgagtactttgacacgcgacgacaggtgcacgcacgcatgcagcagcaagcacacgcgttccattcgatgacgacggaccaagacgacgacgaccatgcataccggcccagcctgcactgtattgtctcgagaaacaagttaaccgctgccgccgagcacactcttgagcttcttcacctgcgcgtcgtccaagaaggtgaccttctccacgacggcggacgggaggttgttggcaaagagcgcaaagtcggtgatctgcaggccggggttggggctgctgaaggcgacgaggcccacggcagcgccggtgccggcgttgtactggtagtggagcaggccctgcgggaacaccatgatgtcgccggcgtacagcgtcttggtgtagacggtgttggagccggagctgatgaagccggcggcgacggtgccctgggtcacgaagaggagctctgagcccgccgggtgggtgtgcagcggcacgacgccgcccacctcgatgtcgagcctggccgcagagatgccaagcccgttgacgcccgggaactggcccacgaaggccggggtcacggcggccttgatgagtgggtttattttgccctggccggcctcgaggtacccaatgaagtcgtggcggtgacgctggacttgccgggtacccagccggcgtgcgtcaggcaggcgcacgcaaatctgcgtcagggcacggag

SEQ ID NO: 24719 - DNA, 734 bp, Zea mays
cattttttttttttttttttagatgtgagatgggataagtatttcaatagtaggacttatatgtaatggaacagattaacagcatgcggcactacaaaggggtgtatatataaaacactgaacaaacagcgaaacgtaaccttaagcgatcatatagctttacaaacgacatcgaccacaaagctattttgaaccaatcagatgcacatgttactctttcattgcaacaaaatgcaatatggaaactgaattcatccctgaatgaaaagtagatgaataaataagggtaagatgaaatagaccacgagtactttgacacgcgacgacaggtgcacgcacgcatgcagcagcaagcacacgcgttccattcgatgacgacggaccaagacgacgacggcgacgatgcatacccagcctgcactgtattgtctcgaaaaacaagttaaccgctgccgccgagcacactcttgagcttcttcacctgcgcgtcgtccaagaaggtgaccttctccacgacggcggacgggaggttgttggcaaagagcgcaaagtcggtgatctgcaggtcaggtcggcgacgcagaagtcctgcgtcagggctagggaggccaagggcatcaggaggaaggagacgagcacgcagagcaacaccattttggccatggcagcggcttacagcagctagctagctcgagatagctttacccgagtgtgtgtgtatctgttccgcgaaa

SEQ ID NO: 24720 - DNA, 1988 bp, Zea mays
tactataggtgagcgagccaaagggcatgtcataaattgcagattagaatcatagactagtgtgatacataaaatcaatttccactccctcatcgtatgaatttgagatagtcttatatctaaactttagaaagtggtgaaatgtcaaattccaaaccaaataacctaccatattaagaaaatttcaattcctttaaaatgaagggatccaaatggcccctaaaagatttgtactagcggttttgttacaacaaccgatactgttatttttcttagcttaaccgatagtggaaatcgatttctactggagattctcaattaactacctgtgaaaagaaacatttttattaacctctaccactagcggttctaaaaaacgacagtacaaataggttaataaccgcctctacatgacttcttgtactagtgacagttgcactcgttgtgtgttgggttgtgtatttcaatagtgggactatatgtaattgttttttttaacagcatgcggcactacaaagtggtgtatatataaaacactgaaaaaacagcgaaacgtaaccttaagcgatcatatatagctttacaaacgacatcgaccacaaagctattttgaaccaatcagatgcacatgttactctttcattgcaacaaaatgcaatatggaaactgaatacatccctgaatgaaaagtagatgaataaataagggtaagatgaaatagaccacgagtactttgacacgcgacgacaggtgcacgcacgcatgcagcagcaagcacacgcgttccattcgatgacgacggaccaagacgacgacggcgacgatgcatacccagcctgcactgtattgtctcgaaaaacaagttaaccgctgccgccgagcacactcttgagcttcttcacctgcgcgtcgtccaagaaggtgaccttctccacgacggcggacgggaggttgttggcaaagagcgcaaagtcggtgatctgcaggccggggttggggctgctgaaggcgacgaggcccacggcagcgccggtgccggcgttgtactggtagtggagcaggccctgggggaacaccatgatgtcgccggcgtacagcgtcttggtgtagacggtgttggagccggagctgatgaagccggcggcgacggtgccctgggtcacgaagaggagctctgagcccgccgggtgggtgtgcagcggcacgacgccgcccacctcgatgtcgagcctggccgcagagatgccaagcccgttgacgcccgggaactggcccacgaaggccggggtcacggcggccttgatgagtgggtttattttgccctggccggccaggccgtggaagtagaagtcgttggcggtgacgctggacttgcacgggtaccccgccggcgtgtcgctgcaggtcaggtcggcgacgcagaagtcctgcgtcagggctagggaggccaagggcatcaggaggaaggagacgagcacgcagagcaacaccattttggccatggcaacggcttacagcagctagctagctcgagatagctttacccgagtgtgtgtgtatctgttgcatcggcgactcgcggccgcggcctcgctatataggaagaaggaagaagggcgtagtgtatcagtgattcagtgtatgtgtatatgcacgcagaggaaaaaatgacagcgcgcgtacgttaactgctgttaacgtacgtgagtgaaatttggttaggatgagaggcatgcggctagtgttcgtcggcatggcgctgctagggatatttggacgaaaggaggcaatagacaagcgttgccagctggtgcatgcaatgtcctccaggatggaagaaatgggaccagagctttgatgagcaaaaggcctcgtcttgctctgcattgttacattgatcgggacgggctatggataggacacgcgatacatttttttacgaagatagcgatatgctcccgactagaccagcactctacagaaaaacg

SEQ ID NO: 24721 - DNA, 6010 bp, Zea mays
tttttttttttttttttttttagcagcaactgttaagcaataattttacaagccaattggtcattaataacagagggttattgtacatggctacaatttacagcccttatacagccactcatttatctacattgaacatgaaataaacataagacctgatacattctgaagctgacaagattggccttccattacgccttaaaaaaaaggaagcggcatgaaaggcacgtcgttagtcgtcgatggttttcgctctcatgcaaccacaaggcgagttccgctgctgtttgcgactgtcccgccgccggccgtagagatactccacgagctgcactttggaccgccgctgcagggcttttgaggtactcctggtactctgctcctcctcgtatttgagcagagcctgctggaccttctgcatttccacctccagcctcccgatcttctcggacatcttccttgcacgctccaagatcttacgctgatgcctgctcctcaagtcactgttctccgcatcggggccatcgggagacgtgaactcctcggccttcttggatagcttactgttggtatcgatcagctgcatgatggtaccctcagcttctgttatttggtacctgacactcccgagttctacctcttcggatgtttcggcgttcgttttaagttcttggatgctggactggagggcactgagtctctgggcatcagaagccaacctttctacgaccttgtttctccactcctcgtgtggctccatagcaagcgacctcggtaactcttgcttgtcaatgctgagctctttcacgaccattaaattgttctctctcccaaatgactcactttgcggcggtcttaggtcgtcagccacatgtccatggctcggcccaatagaaccgcgtgagtttaccatcttgtcatctacttgtgctacatttttcttttcctgaccaaacggactggttttctggcctgaagaagtttgaatgaggtcaagctgtatgtcttttaacatttgctcgtagttcatttcaattatatcatcatccaagatctccttgagctttagcacctcgatctgcttctttgcttcttttaaattggcattgaaatcaagcctctcttgttcaaggaggacaccagtatctgtgaccaccttctgaagggctttgattgttccatgcaatttttgcagctccatccccttcaccatcctcaatgcattttcttcgccactggatcttgttgtggtcttcacaaggtgtggagataatgcattttcctaaaagacaaacaagcatataaattcagttctcgtgattagattttttagctagaactgtaaagccctgtaatcaactagtactgtaaaaaagtttactgtgccaagtcactagtagagaaatgtaaacttgttacaatatagctatatataaatttataccaggaacagtatgacccttataactggaaataaacatgaaaaggagaatattttacctccatcctgagcttatttgtatgcaagtggtcgttagcgagagataaggtttgctcctccagggcactgacttcagtctgcaatgaccctaacattgtgaaatcaccatttaggtcgaccttcagtcttctgttttcaatctcaacagcattttggttgtccttcagctcatctacatatgaatttctttgtatgatttcttccttcagaacctccttctgtaccatggcacttatctcaaaactctcgcatgttatgatgagctcaagaaccttctctttgaacagagctgcattcatgatagccatttgcatgttagccagcaatttcatgatctcttcatcacaggatttgatgttgaacacagccttctccttgctcctaagcatttccacttcgctccttaacttacggacctcatcctgtagtgtttcatttgactcctgaaaatcagcattgcaaacttcctcttgttccacctccagatttacatgacaatcttgttggattttcctgtttgaattcagaaggttggcatctcttcgccctggatttccttttcctgttgctgtttgcacaatagatccaccataaacactcatagttctacttagttctttgccaaggtacttgttctccatttctatgtctccaagcctcttgttcatcatcttgatctcctgataaagctcaccgcctgctgtttgaagacagccaaagttattatgcaaagacttcagctgcaatgtcctctcttcatgaaggcttctaaagatcacactgaggatatctttactaactgcttcactaacaagattgctgaaatcatgttcaaacctcttctgtttttcaatggaatcatttagttcatttgatagaaaagagttcgattgtaatagcttggtgatctcgctttgcaatgacctcctagactcttgcagttcggagaaccttacaaccaagaacttcgcctcagcctttagctcatccactttgtggttacgagcctccacctcttccaagaattcatcacttatcttcataagttcctccttttctctctgcagctggagcagttcctcaatctttatctgctgatcttgcctcaagacattccgctctgacctcaagtcagccacctcttgcccgaaatgctccagaagtgtaactacaagtgatttctcaacaagctccttctgcttcacatcctgggcatcagatatgttattcagcaggcagctgatctcatttaagatgagctgcacaatgatttcaagcttcatttggcctaaggattcatacttatgatccagatgcaatactctcactactgaatcaatcccttcagttagtttctgattatgctgtgataagctgtagatttttccctcctggaccttgcatatttctttattctttcgcagttgttctgcgatttcagaatttacttctgtcatgtcattcaaacactgctgcaagacaaatatctctatctcagctttgacaatcttgagctcctcctcaccaagctgcacctctctactcctgccctcttctagcaatagactaatcttcttctgtagagcatcaaatctaatgttgcttgactgtgtacaatcttcatgctccttcctctcaagccttatctgttcctgtatcttgatcacttcatcaagcaccaagtccttctccttctgcagatctgagtgccgccttccgagttctttgtattgcctttccaaattcagcagagttacagtgatgccctcaacctaaaataacagtgtaattactgagatggaccgttttttctgagagctggaaaatagtatctttttagcctactaaaaggatttgttgctgttagaaaaatagtaattttttagtagtacctggtggacaagagttctcttatcagattgaagtacagaattctgattttggagtgcttctgaagattcttttagttctttgaacttcattcttaaactctcaagttcagcattagcgtcagataaggaattctccaagaaaacattcttctccagtagctcctccatggtctgagaaattacctcaatctgcgctacaagcacagctcgctcagactgatgagtgttaatcgtggatctgaagtgcatgcatgattcttctaatgccaccttgctctccctcagtccctcaagctcagttgttgcagctgacaaagacttctctaaatgtgcatttgtctctgacatcctctccaactttcttaggttatcgatatgcacaagttcaatgctctcatggttcttgacaatctctttcagctcaacattgccatccctcagctcttgtgctagtgcttgtagagattccaaattcaagttcatagatcctatctgttccttgattgtagagtgtttcctctccaagtcactcctatcctctttaagataagaaagctcatgttgaagtgtcttcttttcctccacatgctgaaaaatctcttcctctaatcttcgttgcacatttttcatggaaattatctcatcctgcagacgaattatcactgctgaagaagagtgactttggtcattcaacctttggttctcttcaagaatcttctccagttctttctgaatcacaactttgctcgtttcgacctcctttatcttgtgtgcttcaacctgcttctcaagagtcaaatgcctcagtttgtcttgtgccagtgataactgtttttccaaagaaagctgtgccatttctgcttgcatacgcttgagatgctcttcttctgtagagatatgaagcttttccaactcatcttgcttttcatttacttcgccatgcttctgtttcaacagaagtttcaggttatctagctccaagtgcaagtcctgattagctctttcaagtaaaaataaatgttcatctcctttcctcaaaggttgtagttcagtttgcatctcttctttcagcctgttgaatttctcctgggtatgcataatttcagacttcaggttttgtagtctagcagttgattgctggcatagtgaaactgcagactccttttctgcttcttgttgagcaagggactccttgaggcgaaggatctcgcactcagccttgttgccttgctctaacatggacgagatcctgtccttgaggtcttggttttcctgtgacaagcttgctaggcctgcctgcagtctctcaaaatcttggtcatctgcaagagcacattttgtatgacatggattgtatttattttacattcacgacagaaaatatttgtagcttacctttagcattccttttcaaatcactagcgttgatgaaagagaggaaatatggagccatgtctggattgtccatgtcagtttcaatggaagcagtttctgctggaaggtcatcatccaagtccattagaacctgatcaggaaatgcttctgctatttttcgatgtgcttgacggagttctcctgccgcatggtcatatctttctgctaaagctcggtatgcacggtacagctcctcaagtaaggtcatcagctcaggccgccgtcggtagtacatttcagctctttttgcaaatgattcagcatcttcttcaatgatcttgatcatcagcttaattttactatccatatctgaatttaccaacattcaagaaaagacaaactctttaaaaagtaagaataaatgaaaggttaaccatgctataagcagacataatacaagctcaaactattatgactgatcaattccccagataaatctgtttaaaagtgtgctctcttttaactgcctaagataggcaagcatcatatgggactaagtactacaacctagagaagtagttcttctagcctaagtctcgctaaattttccaacatagtggtaacaattgcacatgaatgataatgaggtgcctgctctgcatctgaagttcatatggtctatcacagtgcttcgctgctaagctgatatgaattaagtgattgaatcagactagaatatggtcataccttgcagtacccccgccccccgaaggagaaggctgaagtcctaaattgtatgttatatgccagaattaaatatgcccatgtgctttgtcaatattcttatgacttctctactggtaccttatcagtgcaaagctattttaatatcatatttaaaaggagctccaaaaacaatatttttcattaaaaaatgaaaaaaaaaacctctcaaacttatacttggaaccataaagtgatgacagattggtaataagcaaaaaatgatttgaggctgcctactgcttttagcaagtgccacataaagtgtaaacaagtgtcatagatttaaatgctctgaaagtctgaaagcaaaattattcttttacgcttcaaaatgtgtatcaaaagactaaatatcttgatttcaaatttctaaattagaaatgagaatgttggatcaccaataacgaccaatctagagatttttttttaaaaaaaaatcaatctgcaggcatgcaag

SEQ ID NO: 24722 - DNA, 3875 bp, Zea mays
tcggtacccctggcggtgccacccctggggctactccttctggggcttgggacgcgactccaaagctgcctggtggtgtcacgccaacccctggtaagaagcagagatcaaggtgggatgagacaccagcaagtatggggagtgcaacccctggtagtcttggtgctgcaacacctgctggttatactcctggtccaacgccatttggtgcagagaaccttgccacaccaactcctagccagattgctcgtggaccgatcactccggagcagtaccagctcatgcggtgggagcgggacattgaggagaggaacaggcctctcactgacgaggagcttgatgccatgttcccgcaggagggctacaagattcttgagcccccggcttcctaccagcccatcaggaccccggcaaggaagctccttgcgacaccgacacctctggggacaccactttatgctattccagaggagaatcgtgggcagcattttgatgtgcccaaggagctgcctggtgggttgccactcatgaagcccgaggattaccagtactttggaactttgctgaacgaggaagaggaggagcagctatcgccagaggagcagaaggagaggaaaatcatgtaactgttactcaaagtgaagaatggcacacccccacagcgtaaaacagcacttcggcaactgacagacaaagcccgtgaatttggtgcaggaccgttgttcaacaaaatactgcccttactcatgcagccaacactggaggaccaggagaggcatcttttggtgaaggtcattgacagagtactttataagctcgatgagctggtccgtccttttgtgcacatgattcttgtggttattgaaccactgttgattgatgaggactattatgctcgtgttgaaggcaggcagatcatctcaatccttagcacagcagctgggcttgctactatgattgctgctatgcgacccgacatcgataacattgatgagtatgtgagaaacaccactgctagggcgttcagtgtggtggcttctgctttgggtatccctgcccttttaccattcttgaaggctgtctgtcagagtaagaagtcttggcaggctaggcacactggtatcaaaatcgtccaacagattgctattctcatgggctgtgctgttttgccacacctcaagtcactagttgagatcattgagcatgggctgagcgatgaaaaccagaaagttcgtacaattactgccctttctcttgctgcacttgctgaggctgctgcaccatatggtatagaaagttttgatactgtattgaaacctctgtggaagggtatcagatctcaccgtgggaaggtccttgctgccttcctaaaggccattggtttcatcatccctcttatggatgctctgtatgctagctactacacaaaggaggtgatgcaggtcctcattagggagttccagtctccagatgaagaaatgaagaaaattgttctcaaggtggtgaaacagtgtgtcagtacagagggtgtggaggctgattatatccggaatgacatccttccagatttcttcaagcacttctgggtgaggagaatggctctagatcgcaggaactataagcagcttgtggaaactacagttgagatggcaaacaaggttggagttgctgatattgttgggagggttgttgaggatctgaaagatgaaagtgagccctacagaagaatggtgatggaaacaatcgagaaggtggtagccaacttgggtgcatcagatattgatgctcgtctggaggagctgcttattgatggtatcttgtatgctttccaagagcagactagtgatgacgcaaatgttatgctaaatggttttggagctgtggttaatgcacttggacagagagttaagccctaccttcctcagatttgtggtactatcaagtggcgattgaacaacaagagtgcaaaagttaggcagcaagctgctgatctgatctccaggatagccatagtaatgaagcagtgccaggaggagcagcttatgggtcacttgggtgttgtgctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacctgcccttatgaatgagtaccgggtcccagagctcaatgtccaaaatggtgttctgaagtcactctctttcctctttgagtatattggtgagatgggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggcaatgtttgtctgattaacgtgagtcttccttactcccaaatttgtttacaatgatattaacacatctgttttgagtttttttttctgtatccttagatcgtagagtgtaaatgttttgggctgctggtcgtacacacttgactgtttggggcacttgctaccatttcagcaagcattatcaaccagtagttgatctgtattgtgtttactttgtcttctgttttctcctgctccttatctatgcaaaggaagaatctgatatgcaaacacattgacaggctggatgtgcatgtccatgtgtcttcatccatattcttatgaagcttgaactgggtggtactctgagttagagctttgtattttacttggtgacacctcttgtgatgcatgtaattgaagttgcatctatttttttgtatttgcaggattgttccttctgaagggggtgcaatgtttaggaattttttttcctggtttactataatgcaactcaaaatctctatcatagtctggtcttactaacgatttgggaactgttttgttttcagggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattaggcgttgggcatttaccgtgttttaaaactttgtattacacatggatgttgtattatgtggtgtggacaatggaacgttgcaagctgacctgaacctgattccttactgtattactgagatgttgatatgcatgtcatgttagtgtac

SEQ ID NO: 24723 - DNA, 1163 bp, Zea mays
aacatatttcgagacatctccccatgttataaatgctgttatggaggcaattgagggtatgagggttgcgctaggtgcagctgtgattttgaattattgcctgcaaggtctcttccatccagcaaggaaagtacgtgaagtttattggaagatatacaactctctgtacattggtgcacaggattcacttgttgcttcttatcctgccctggaagacgatggggataacatatttagtcgcccagagttggcaatgttcgtctgattaacgctggatgtccatgtccatgtatcttcatccatattcttgtgaagcttgaactgtgtggtatttgagttagagcttgtatatttaagttccctcttgtgatgcatgtaattgaatttgcatctgtttctgtatttgcaggattgttccttccgaagggggtgcacaatgtttaggaatttttattatggtttactgtaatgcaactctaaatcactatcgtaatctgatctactaaccatttgggaaatgttctgttttcagggtagtccgtgttgaagctgctgaagagttccgctggattgaggaccgatttcgaggctgcagaggaccctttaattaatccatcatgatcctatgttttgaaggagaaatgtcgatcctagcgtgttgtcttaatattagacgttggcacgttctgtgttcttgaactttttgtaatagccgtggatgttgttattatatataggtgtggacagtggaacattgcgaacccctaaaaaaaaaaaattccctcgctgtattaaaaaaaacaaacaaaacaaaaaaaaaaaaaaaaaagaaaaaaataataaaaatgggggggccacgcaaaaaaaagaaaaaaatttaaaaacacgggaattgaaccaccaaagggggggggcccttcaaaaaaaacataattttcaagcgcgggtgttgaaaaaaataattttcttttaaaagggcccccaaaaattaattctctggggcccccttttataaaaacccccgggggggggaaaaaacccctgggggtcccccaaaattaattccccccctttcaacaccatctcccccctttttctccccacgggggggggaaaaaaaaaaagaaaaaagaaaccccccccccccccccgagtctcccccc

SEQ ID NO: 24724 - DNA, 1568 bp, Zea mays
ccccgcgtccgcccagcgtccgcccacgcgtccggcagactagtgatgatgcaaatgttatgcttaatggttttggagctgtggttaatgcacttggacaaagagttaagccttaccttcctcagatttgtggtaccatcaagtggcgattgaacaataagagtgcaaaagttaggcagcaagctgctgatctgatctccaggatagccattgtcatgaagcagtgccaggaggagcagctcatgggacacttgggtgttgtgctgtatgagtacttaggagaggagtatcctgaggtgttgggttcaattcttggagccttgaaggctcccggcgtccgccccgcgtccgctaaaatgactcctccaatcaaggatcttcttcctcgtctaacccccatcttgaagaacaggcatgagaaggtccaagagaactgcattgatcttgttggtaggattgctgatcgtggagcagaatttgtgccagcaagggaatggatgaggatttgttttgagctgctcgagatgttgaaggctcataagaaaggtattaggagagccactgtgaatacatttggttatattgcaaaggctatagggccacaggatgtgctggccaccctgttgaataatttgaaggtgcaggagcggcagaaccgtgtctgcacaactgtagcaattgccatagttgctgaaacttgctcgcctttcacagttttacctgcccttatgaatgagtaccgggtcccagagctcaatgtccaaaatggtgttctgaagtcactctctttcctctttgagtatattggtgagatgggtaaagattacatatatgctgtcactcccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgagggtatgagggttgcgctaggtgcagctgtgattttgaattattgcctgcaaggtctcttccatccagcaaggaaagtacgtgaagtttattggaagatatacaactctctgtacattggtgcacaggattcacttgttgcttcttatcctgccctggaagacaatggggataacatatttagtcgcccagagttggcaatgttcgtctgattaacggtagtccgtgttgaagctgctgaagagttccactggattgaggaccgatttcgaggctgcagaggaccctttaattaatccatcatgatcctatgttttgaaggagaaatgacgatcctagcgtgttgtcttaatattagacgttggcaccttctgtgttcttgacctttttgtaatagccgtggatgttgttattatatataggtgtggacagtggaacattgcaaacccctctgtgaccttgattcctcgctgtattcctgagatggctgttattagcgtgccttgaccaaatagcttgtgtaaaaagcggcc

SEQ ID NO: 24725 - DNA, 2193 bp, Zea mays
cgcccttgccaagccaatcaacctgatccttctgctgatgagcagaaaaagaaaaagagacgcctccggcgagtatccagtttggatcgggacgttggtgcttcggttcctgatgctgaagaagtgcctgtgactgaatttattgacgctgaccctaatgggtgtgcccaatctgctgctgatcccaatgtgggtgctccatctgtggctgatcccaatgggggtgttgcctgtgttgctaatgaagacgacagggaggaagaggatgaagttcctttgactcggaaaaacagtcggcagttcatcgctagtggtgaaagtagtggagttccttctcctgctttgtctgctctcattggtctgccagaattgtccctggcgaattttgatcagactcttgaggatatggttccagaggatttgttatcagagccagcagatgatggtgtgatggaggtttgtgctgatgtgcttgatgctgggttgaggtcatcccgtgcctcgtcgaccttagagcgcgatctcgagggtcaggagactgacttggatcgtcctggtcccatggaagtaactgagggcccatcagccttagaggtggctaccgcagagaacttggaccccaaggatggtgttgacacttgcccagcccccgaggatgttgccggggatgacttggttcgggtgggaagtgcaagccactgcccagcccccgagggtgctgccggggatgatccggctcaagtgggcagtgcaaactatgacccagcccccgagggtgtccgagcggggtctccctcttgtacttccatggacgttcatgcgggatcgcctccgcactccggctgcatggtggtagcccaagctttggaccagggagtcgctttagagggcagcgtccccgctgaccaagttttgggctctgttgatggcactgagttggttcctgctggttcgttgcaagctgcttcgggtggcggccttacgcccggtcatcaattgatctctcatgatttgggggtcccttcgttcttttccaacctccaggtactgtggtatactttagcttgatttttacaccgcatgaactgctgtcattacactcatctgctctccttatcaggctttggtggacgggatggctagccagctgaggttacagggtgctcctgttccagaagtagcttcgtctcttgcacgttggaatccagtgttacttcaacatcgtgtctctgacttggaggcgaccaatgctggttagtgcttttttgcttctctttgtcttcactattaaactgctttacattctgaccccttttgtttggttgtctcctgctaggtatgactcggcagatttccactcttgaagaaaaacattctcgagatcaggctgaattggtccagcggtgctctgactttgaagaaaagtattctcaaagtcagactgaactagctcaggtctctgctgccttagatgacgccaatgcactgagctcttcccttcacgctcagcttaactctgaaaaggtgacttatgaaactgtgccttgccttgttgtgctcctattacctgcttgatgtttgaggaagttgacttttgtttgcaggaagaaaaacgtatccttgctgcttctcgtgacagtctcgacagattgtatcgcgattctagcaactcgctgaccatcctggagaggagtcatcgcttcaccatggaagagttagacaaccaacgctgtaagctgcaggaatctacggatgaggtgacccggctcaagcagttgatatcagcgaaggacgctactatcaaagaactccgagcttccaagaaatccatcgcccaggagttagaaactgctcggctggctgccaaggtgccgaagaaacttccgttactctcagagcccagcgcgacagagccatggataaggccattcgggcggggcgaatcttgatgaggaggcccggcatggttgtccccgaagatataagggctgacgtgaatgctgcccctgattcctcgagtcgtccttcctcatcgattgctcctgagaaaaatatcacaaaatagagaaacattttgcgtgctttgagcgcgcagttagcatggtcagacatttgttagaggacgtcatttcagtacttgaacgacattgtcattctcatattgtttcagaattcatcagttcgtaaattgca

SEQ ID NO: 24726 - DNA, 979 bp, Zea mays
  misc_feature (2)..(35): n is a, c, g, or t
cnnnnnnnnnnnnnnnnnnnnnnnnnnnnnnnnnnttttttttttttttttttaatcaatcaggatgcactcattagtcatgatcaattagcatctttggatcaggattattaggacacaagcgccacctagaacatagcaaaaacaaacaaaacaaaaactagtgactactgcttctacaacacaacgcaaaccaggtacaatgtgattgattgatcgatggacatggacggcgagctgcagcttgctgctgcagcctgcagggtttcatgtcatcctcagggtgaggtactgccggcactgcagcagccacggcgcgtgctgccgcatcatcatgctttcttcaaggtcaaacgccacggccctctggcacggcggcggcggcgcgtggaacgccgccgcaggcccgtcatcggagcagtactcggccgacgaaggcgacgataggacgctcgcgccggagcagtcgggcccgaagggggaggagacggcgccggcgtcgtcgcgaggctctgctgcttgcctcctcctcctcctcctgtcgctcttgcgacggccgtcgggtgagcagcgcccgccgacggcgagcgtcagctccagctccgtgccggcggcggcgtcctcgtcctcgtcggcgctggctatgtactcgtcggccgggagctgcaggcccagcggcagcgcccgccgcggctgcttgctgcgccggcggggggtggtcaccggcttggctccggtcaggtcgtcactcgtcgtcatcatcagctccctctgtatacggtacaggcgatgcagctcgtggacctgctgcctgaaggtttcttcgtgcttgagcatggccatcttcatgacctcaatgtcgcattgcctcacgcgctgcctgtccaccatcatcctcttacggtcttacctatagctagcccgctctcgcttaatattggatgtaacaaaacacacgagagcagctaggagcaggttt

SEQ ID NO: 24727 - DNA, 566 bp, Zea mays
gaaaatgataccagaaataatccagtttattttttcgaataaagatacatgtcaggaagattgacgccttggaagacttaattaaataactaacgaaatgtcatcttctgagcatctttgctaccaccaccatccattccacgccatcgcgcccttcacagcatgacgatgtgttaagtgtagcaggaaatgtcaagatgcttgatcttagttggatcgtatttctgcaggtctccagcgtttagtagatcggcgatgcacttcatctgcatacccctgtgtaccctctccagctctctcactgccgcacagcatggcccagtttgggatgggagctgaacgagggttcctctctggatgtacatttggcacaagctcacaatctggttcttctcctgagcgttacatcgcgacccagttacggtgttgacggaaattgttgcgatcaacaggagtaagactgctgctactttgcaggggggcatctttttgatgatttagctggtggttacgagctgggtgaaggaatcacgagtgagccagtatatatttgatgttcttccacc

SEQ ID NO: 24728 - DNA, 727 bp, Zea mays
ccgggcccccccttgaggtcgacggtatcgataagcttttttttttttttttttggttttttttttttttttttttttttttttttttttttttttaccagaaataatccagtttatttttttcgaataaagatacatgtcaggaagattgacgccttggaagacttaattaaataactaacgaaatgtcatcttctgagcatctttgctaccagcatccattccacgccatcgcgcccttcacagcatgacaaacgatgcatggggaggagaggaatgaaactaacgatgctaagtgtagcaggaaatgtcaagatgcttgatcttagttggatcgtatttctgtagatctccagcgttcagtagatcggcgatgcacttcatctgcatacccctgtgtaccctctccagctctctcactgccgcacagcatggcccagtttgggatgggagctgaacgagggttcctctctggatgtacatttggcacaagctcacaatctggttcttctcctgagcgttacatcgcgacccagttacggtgttgacagaaattgttgtgatgatcaacaggagtaaggctgctgctactttgcaggggggcatctttttgatgatttagcaggtggttacgaactgctgggtgaaggaatcacgagtgagccagtatgtatttgatgttcttcgaccgaaaacttgtgtgtgtgcttgcacctatatataggat

SEQ ID NO: 24729 - DNA, 689 bp, Zea mays
aaagtttcccgtccttttatcctgtggttttttttttgttttttttttttttttgataccagaaataatccagtttattttttcgaataaagatacatgtcaggaagattgacgccttggaagacttaattaaataactaacgaaatgtcatcttctgagcatctttgctaccaccaccatccattccacgccatcgcgcccttcacagcatgaccttacaacgatggggaggagaggaatgaaactaacgatgtgttaagtgtagcaggaaatgtcaagatgcttgatcttagttggatcgtatttctgcaggtctccagcgtttagtagatcggcgatgcacttcatctgcatacccctgtggtaccctctccagctctctcactgccgcacagcatggcccagtttgggatgggagctgaacgagggttcctctctggatgtacatttggcacaagctcacaatctggttcttctcctgagcgttacatcgcgacccagttacggtgttgacggaaattgttgcgatcaacaggagtaagactgctgctactttgcaggggggcatctttttgatgatttagctggtggttacgagctgggtgaaggaatcacgagtgagccagtatatatttgatgttcttccactcaacacttatgtgcgtgcggacgctgagtcgacaccggg

SEQ ID NO: 24730 - DNA, 812 bp, Zea mays
tgggtaccgggcccccccttcgcttttttttttttttttttttttttttttttttttcgaagagctgatcctttgaacaaagattgggctcaactgagcaaccaactcatcatgagagttattacaattcgtcaggtgggggagaccgaccagtaaactgggcactagatgtgactatactcggctaaacaaccattacctgccgattccccaaaaactgaagcaccgaagatggcacctccaagactagaaagaaaagcaatctgtaagcaaaaccaaccgttgctggatcttaaaatcgcatggcaacatttttctattgccagcaagatctaatctaatgatgttaacaataaagtatatcgatcaacaccatctcatttatgctaatgagaaatcacatgtactcatcttatgggccactcagtgagatgttatatacggtttccatgctatccccacggttctctaatatccttcgagcgcctgctccctttctgcaaacatgacaaggccctctgccatcttgtttcgtgttcaaggacccagcaacttcttccaccaggcatacccaaacaagaggatggtgatcacaaagcagccggatgaggtgcccccgacaaatggccagaagagggtgttatcggtgttgtacagagagctcgggatgttcattgcaaaagctccaacaatgaaagtgttggcagctatgccaaaggatgcaatggtcagtgtaagctggagttggattagttcattacgctggttgtcaagttgaatgttgacgtagtcttctgtgtcatcaatatact

SEQ ID NO: 24731 - DNA, 1279 bp, Zea mays
tttaaaacggcccgcccctttttttttttttttttttttttttttttttttttttttttttttttttttttttttttttttttttttttgtctgtcgcatcacatctcctagtagggcgctaacaaaaattgcagcttactcgtttcacatgaatacggtatacaagtaaagcagtaacgagctatgaacaaccaagacagcacaaactaacaaacaaacaaattgtgtaacaatgcacgtacagcgaaactatgctgtatttcccccaaatatctgattacacaagtctaacggagctcatattatacacacaaaagaatcaatacacaacgtccgaccatggtttcattaggaaggtcctacaaatatttcgtggtgtatctctgttcttcaaggaagtccaagcaacccatcattggatgctacatggtattttccaacttcgtgtatagaaaacacaacaatgatgtacgaagtgtcaataaaatcactctttcccagctgtgactccaactacaacgctgctgacaagttttcccttgtcatcaactgtcatagggttctcaacaacaacagttacattctgagattgagatttaggagcagaagtagatgagccactatatgaagacccatctgatgttggcctcgcagatggggtgggtgccacagtatttactccagtagctgtgacataattgcatacggcacattttactgaaggtgcgccgtatggatacatcaaagttgtccggcactggccgcagttcacatgagctatattattcactggtctaacaaggttcactgtgttgcaacatgaacaccttacggtgtctgcactgcgagtatacatcagcaaagttcgacagccaccacatataagctgagccatctccaatcctggtggcggcacggtggtgatggcctggcaaaccgcgcagcagacgctggacgcgccacgcgggtagagcagaagggtccggcaagcatggcacatgatctggttctgcataccggcgtggaacgcgctaggctgtcctgacgtctgtggctccggttgctccgggaagagctcgaggcgggaggaaggcgaggagggacgcgttgtcgcttatctctgttcttccttcctcttctaggcgaggcgagggggagatgatttcggattggatttgcccggggcctggcccggccggctagagaagaggaaggaggggaccagtcgagacgctgcggtccggccggcctcgaggaacccaatcgccctatggagtg

SEQ ID NO: 24732 - DNA, 2677 bp, Zea mays
attgtgttggcggcgctccacgcgcccctgcagaaggcggcggcggcgcaggcgaggggcaaggccgaggaggaggacaacgtgggcgccgcggcggacgacgccgggtcctgcttcgtcgacccggacagggtcgtggaggtcgccccgccgcgcccgctggccaggccgtgccggacgtgcgggcagcgttcggcctccgtcgtgctgctcccgtgccgccacctctgcgtctgcgccgagtgcgagcccgccgtccccgctgccggcgccgtcgcggctgcctgccccatgtgccgtggcgcggtgaccggcaccgtgcaagtgttcttctcctagcaagctttaggaaaggggaaaatgctaaaagaaaaagcaagacaaaatcgttgctcctgccaaaaggaatgatccgtgaaaatggggaattgttcatgatagtccgttctctgcttcttttttttttctctccctctctcagttgtttattataatccttctattagtatataagtcgatctcttctagtactgctaggaataggattaggttcctgctttattttcccttggtttcttctggaaggcatatgatcgaccatggaccccagtacgtacattttggaaggcaatgaatgattgtgcaaaattttcacttttttaccgcctaattaatggctttatcgcgcactagtagtctagtagtacacatctggccctgcagttgctggtaccctcctgctccgtacgtgacatacacacagtgcaacgcttgaacgctacaggggcagcagcgtcttggggacgatgcgttttaaaggcgaggcgcggattcgcgtgatgcgtggtggcgggagacgcggccagtcacgtgacgaccacgcccgatcgccgaatcgccatcgtacatacgctggcgtcgccgtgcgatcctgatcgggcgcgcgtcgcggctgccctgtcggttgttcgccgcgcaggcgcagcattcagtcagagagaggtggtggtgggagcggggtctttcttggaggaaaggagatgggggtgcgcggcggcgtgcggttgcatggctttttggccaacaattgaattcggcgcgagggcaaccgcaaccgtccatggcgggatgaccggatcgcgtgatcgcgagaagttcgcaaccggtcaccagatctcagtctttggtgagaggttgggccgcgcgagcccacctgcactgatgggctgattcaaagtagggtcggcgtctggcggggcccacttctgccgcgggagaccgttggttcccgcgtattctggcctctggttctgtgtgccggggccggatgggtgtgccggaagactacacgagttattgatctccctgatcgtcacggcgtcacgcaacactattgagtggtgtgcaattccatactatgccacacgcccccacacaaccatcactgcataaagcatggcaccacggttgactgcctggcttgcacttgagatatacgtcctgcagctagcggtggccggtggaagggaggcatcaagccgaaatagcgcagaccaaaaaaagttacctatgtaaacccgatttatctaaatccaaattaccgatcactaattccgatagcaagtctgaaaacccgatttagtttggataatacggactgtgagtttgggtacccgatttatccgaaccattgtattattgtattatgattgcaaatttatggtgtactaatatataaataatgaacaccaatcaatatgtatgagacttatgagcagtgtagtgtgtttgatgaaaaaaaaatatattattttgttacatgtaatatttactttaatttcattgtctttactacttgatattacaaccgggtaattcggggaaacccgaactcaattttttgggtacccgaaatttcgggtagagattgtgaacgggtatatttcggatcctgattcttattacccgatttttaaatatccaaattacccgacccggaaaaatcgggtaactcgaacgctaggcctaatctagaatataggaagagataggattgcgagccacagtggggtgtgttcggctgaccattctgttgctcatgctggttatagctgctacggtgctatggtacctcgtgagtaaggatgcagtcaacgacgacaactattgaacattttatatatgaaaaaatatttataatattattaacatgatttaaaataaaaaatttattgcaaaaagcaatatatatgaagaaactagtgtgctaaaaatcatctttgccactattatccacctacagttgcgggtatctaagacaccgtagatgtttctctctctacacgcatgatggtagcacacatgcgtcatggtatttttattcttacacttgtagataccataaagatatgttgccacggtgttaatcagcaacgaaattaaggagaaagggtgaaggtgttgctgctgatggtacatgaaaatgtgtgactacttccactatataaatgtgctcttattccgttgtgttgtgtgtgtagttgtaacgatcaatgcttctttactcactaggtatatgcccgtgcattgcaacagagggcacttgtgcacgcgcaggtcattatttagtgatgctatcaagcatcaacataataatcataataaatgttgaagtcta

SEQ ID NO: 24733 - DNA, 795 bp, Zea mays
  misc_feature (105)..(105): n is a, c, g, or t
gagtgtcaataaaatcactcttccccagctgtgactccaactacaccgctgctgacaagtttccccttgtcatcaactgtcatagggttctcaacaaccaacagnttacattctgagattgagatttaggagcagaagtagatgagccactatatgaagacccatctgatgttggcctcgcagatggggtgggtgccacagtatttactccagtagctgtgacataattgcatacggcacattttactgaaggtgcgccgtatggatacatcaaagttgtccggcactggccgcagttcacatgagctatattattcactggtctaacaaggttcactgtgttgcaacatgaacaccttacggtgtctgcactgcgagtatacatcagcaaagttcgacagccaccacatataagctgagccatctccaatcctggtggcggcacggtggtgatggcctggcaaaccgcgcagcagacgctggacgcgccacgcgggtagagcagaagggtccggcaagcatggcacatgatctggttctgcataccggcgtggaacgcgctaggctgtcctgacgtctgtggctccggttgctccgggaagagctcgaggcgggaggaaggcgaggagggacgcgttgtcgcttatctctgttcttccttcctcttctaggcgaggcgagggggagatgatttcggattggatttgtccgggatgtgagaggaagaggaagagaagaggaaggaggggaccagtcgagacgctgcggtggggcccccccccggccggcccaatg

SEQ ID NO: 24734 - DNA, 1398 bp, Zea mays
cctaaccctgagcctatccctatggcctccatgccctaggctgccacctcatgacatcaacaaacatccactgtcatgcaatctatgacattgtgtgagcctaaatttttacatatgaattgacccaataataatcatgtaaaccagacaacataaaaaacaaggctagcaaacttctcaatacatataggggttgttcgcttcagattaaagccagtttttcggattgctgcagatgtaatctgttgagtttgtgatccaaattctacatatggaggctgtgttggtgagcggagcggaggcccgtcaccgagaggcttgagccaaagcgtaattagggttttttgtgctacgcattgttttctggtcgagcgaccagctagtcgacctaggggtccgactaggcaactaatctcgattaatcgacgattaggtcgactaatcgacctctggtcgacctggtcgtatactagtcgtcctgttcatccaagacatatgtatatagtatataactaattaactatatacggtatataactatatataaagggtagggtaaacatgacatgaattctgcaatactgatcaaaggaataaggattcagaggatggcaacatgaacaaggatggcaatatgaacagaatctctattctctaatatgaactgagtcagaaacatagaaggacagaacacaatacagaatacagaagtaaatatgactatcactgaatctagggccttgcgttgcgcgccgaggaagacaaattggggccaaggttttttaatacatcgactgtcactgaatctgtgcaccggtgatcaacttaccaggaggcaagagccttgtgcagtgccccgccgggctcaaacagaacgccatagcgcacgtgactgagagagagaacagaagggaggagagagggcctcgccggcgaccttcgctccggccttgatgtgggtgcccagttcctcgctgggcagtgccgagcgtacaccgagaaggtcgcgctctcgccggtcaagtctggaggacgagctgctcagaatgcgtcgtcagcattgagagaagtcatgggctcctacacaaatgcaatccgccgtcgtctacgtctcgaccaacgcgtgaggttacgagccacctgaagaacaagttggtagctggaatctcaagtcccaggtcaagaacaggtaccgcaggatgaggcgcttggaggatgctgcgatgtgttcgtgagaggtctaggtcgtcgtctcccagtcaactttgggttgctggaccgttgtctccatataatgtaataatttatttactttgtacagaactccgattatatagtaaagatgtgacattcgatcctaaaaaaaaaaaaaaaaattgccgcacaaaagtcgacgcg

SEQ ID NO: 24735 - DNA, 680 bp, Zea mays
cgcccgtatctgcgggtagctaggtttgttgtgatccgataaatttggccgacgctatcctaaagccatgtgtctctcctataaaacaaatccacccagcctccgccgcggacccagccggaacgccatagcgcagctgagagagagaacagaagggaggagagagggcctcgccggcgaccttcgctccggccttgatgtgggtgcccagttcctcgctgggcagtgccgagcgtacaccgagaaggtcacgctctcgccggtcaagtctggaggacgagctgctcagaatgcgtcgtcggcattgagagaagtcatgggctcctacacaaatgcaatccgccgtcgtctacgtctcgaccaacggtaggaacaatgccctgccgtgcgccgcatcgcccactccgatgtgtgcgaacccctgtctccggccggcgtcgcgctgcctaggcgcatgccccagccattaccacgaagacgcctgccctcacttttgcctgcatgccgccatgcatgtactcaatgaagaagaaatatcatgcgtcttcgtgggattggaaagtggacaaccgtaggaaatgtaatctgctaggcccacctgcatgcatcacgatcccactaaaaccaagttgttgcatgcggcacaatttctttttctccatacgaccaggggatctcta

SEQ ID NO: 24736 - DNA, 3166 bp, Zea mays
ataaatagatatgcttccctattgtttggacatataagtttgtagatacattttctaggtctctaaatattttattaagatttgcggtgacctaatctatctcgggattttctagaagcctataggttttcttttgcgagtgtgtggtttcaaagttttatcacatatttataaatagaataaagctgaaaccgcattggaaaccacttctaccaattcaagagagagagtttaatggtgtgagagataatttaaatggtttggagagtgttaggggtcacatatttggttttgcagttttttcttgtgtggggtagtataagaccatggcagtaacaaaaattggagaatatatctcgtgcacacgtgagtttagtgcatatataaaattatcatcattcatgtcagatttaacgtctctagttacttgttgtattttacaaataacaccttctgtcactatagtccaccacttcggagggtgctctttgtaaaatatacagaataactataaacgttaggtctaagatgagcgatgataatttaattattttttgaactaatcttttatgtgctagatatattctttaaatttaaaagttgaagacaaaaggtattttttttcgccctcgccattccgctactcctgtgaactgtgatgctgtacgatgcgtatcgtattcgtatccaatagattaacagcggcaggcgtgaatatccattaccatcgccgaccgctactacagtctacacgaatgctacatgtccgccgcgcgcttcttgagctccctgaccctgtccctgctggccgccctgccgtgggagcgtcgcgggctcatccgccgccgcagcgcgaagcggaggtgtccggtgtccttgaaccgcctgcgctccgactcgacgacgtcgcactcggggaacgcggcggggtagcgcagcgtgtcgtagcagtaggagtagaccatgttgcgctcccggaacctgcgcatggcttgctgcttctccaccgtcatgacggccacgtccgacgccctgagtgcctcggcggctgcggcgcaccgctccgccgtcgtctgctggatgggcccgtcaacgcggcagccgaggagggccaggtcggtgaaggaggcgacgaagggcccgtagcggtagttgacgcggtaccggcccccggcggtggcccaggtggaggcgtcccacacggtggcgtacacggacatgggcttggaggggaagtccccgcccatggcggccgactgccgcacctcgcgcaccggcacgtcgtccacgtagaaggccacggcggcgggcgtccacaggatggagtagcggtggaactccgtggtggggtcgaaggggagcacgtaccgctcctcccggccccggcccacgcttccgtttccgtacacgttggtctgcacccgccatggcttgccccggatgttgcccaggaactcgaagtccagctcgtcgtgccgcttctcgaacacgtcgccgttggacgcctgtgggagccggccgggcatcacatcatggagcaggcatgaagcatatcatatatacataaaagggaggatagactcacgcacgtagaaggcgacgacgacgccggcggtgtagtcggaggggagcttgatggacgcgctgaagaagccgtgctggtacatggacgacgagatgaaaccggaccctaataaataaagcaaatccaatccattttcaatggctcgctctcattgcatgcatgttttcaaatttgaatatatgtagtttgtactgatcgatgaacgcgatgcatggacaaggcgtcgtccacgcaaatatgaaaacaaacaaacgaagcatatatagcatgtatgtaagtaaaaccaccggtggaacggtcgaggaggaggctgacggtgcggtggtcggcggagcggaggatgttgccgtgcccgaacagcggcgcgtacccgtcctcgaacgccatcgtcgtcacgttgatcgccgggagcgcggacacggccgccgctaggacgacgacgagcagcagcagcgccgccgccgccggcgtcaagcaaaccatgtatgcacgtatgctccgctcgccgaccggcggtcaaattcgatcgccggcgagccagcaggcgggcgcggcgatggtaatgatgctgacgccaggcggggccaatcgctgattattattgcgttgccttattttgaggtggtgattcaaatgaggagagctccagcttaggaaatggccgccgcggcgcacgcgctatatatggggcgggccagagacacagacacctccatctccatgctgcgcatgctaggacacgctggggtagtggggtggcagtggcattatttcgaggctgatttggatcttgcgggtttgtttgtatccaaatattagccgtggattctcggattaaatccagctgtgcactgctgcagctgcagagacaaaaaataatctagaagcagtagaaaccgatatagatttattggaattcaatggaatgatatcagtcgctgcgatggaggatgggttcggtatagacctgctaatggcaaaaaatccaacccacgcctaactcatacccaaatctagtacatttgatatccatctcacatccatccaaaaatataagaaggaaattaaacacaactcatccaataatattattgatcccaaaccaacccgtaattggatggaaacccatgaaaccgtgggttaagcttgttgtctcacatcaagccaactgcatacactatacacaatgacaattttacaggtagcttcagtcataggcggagctaaggcccgggcagggtgggctgttgcccgggcttaatctccagcaaaaacctattatatcttggtatgttgtttctttttttccttggcagccgtccataatttctcatctggtcgcatggtcatgtgtatccgctgccgctgcttgctggatgccatgcttacaaacagattctacaccgccaaaggttgtatggcctaacttcattttcttttcatatgggttgttgtacgagagcagactccgcccccactcatgcacattttttgtttgcgccagaaaacaacaacgataatgtcaacagtcatctcatttagctcatctccacgataatagcaatgttgtcaatgccgacc

SEQ ID NO: 24737 - DNA, 1374 bp, Zea mays
gaactaaacttttatgtgctagatatattctttaaatttaaaagttgaagacaaaaggtattttttttcgccctcgccattccgctactcctgtgaactgtgatgctgtacgatgcgtatcgtattcgtatccaatagattaacagcggcaggcgtgaatatccattaccatcgccgaccgctactacagtctacacgaatgctacatgtccgccgcgcgcttcttgagctccctgaccctgtccctgctggccgccctgccgtgggagcgtcgcgggctcatccgccgccgcagcgcgaagcggaggtgtccggtgtccttgaaccgcctgcgctccgactcgacgacgtcgcactcggggaacgcggcggggtagcgcagcgtgtcgtagcagtaggagtagaccatgttgcgctcccggaacctgcgcatggcttgctgcttctccaccgtcatgacggccacgtccgacgccctgagtgcctcggcggctgcggcgcaccgctccgccgtcgtctgctggatgggcccgtcaacgcggcagccgaggagggccaggtcggtgaaggaggcgacgaaggccccgtagcggtagttgacgcggtaccggcccccggcggtggcccaggtggaggcgtcccacacggtggcgtacacggacatgggcttggaggggaagtccccgcccatggcggccgactgccgcacctcgcgcaccggcacgtcgtccacgtagaaggccacggcggcgggcgtccacaggatggagtagcggtggaactccgtggttgggtcgaaggggagcacgtaccgctcctcccggccccggcccacgctgccgtttccgtacacgttggtctgcacccgccatggcttgccccggatgttgcccaggaactcgaagtccagctcgtcgtgccgcttctcgaacacgtcgccgttggacgcgtagaaggcgacgacgacgccggcggtgtagtcggaggggagcttgatggacgcgctgaagaagccgtgctggtacatggacgacgagatgaaaccggacccggtggaacggtcgaggaggaggctgacggtgcggtggtcggcggagcggaggatgttgccgtgcccgaacagcggcgcgtacccgtcctcgaacgccatcgtcgtcacgttgatcgccgggagcgcggacacggccgccgctaggacgacgacgagcagcagcgccgccgccgccggcgtcaggcaaaccatgtatgcacgtatgctccgctcgccgaccggcggtcaaattcgatcgccggcgagccagcaggcgggcgcggcgatggtaatgatgctcccgcccggcggggccaatcgctgattattattgccccggccgg

SEQ ID NO: 24738 - DNA, 2980 bp, Zea mays
ctgcaaaatgctccatgtggggctccctccataaatctactcacatacccaactgaaaaagcctaatccggtcgggtattgaccagatacctcaattttcccaccaagctcctgtattctgttgcatctacgcaggggctgtcatccttcctgctcagcttcagctttgcctgcattggtacatcacacgagttgcagtctgcaaaaccacttagatctagtatcttatttgcatacctctcttgagaaagggtaattcccagctcatcctgcttcacttcaatgcccaagtaatatgatagtaaaccaagatcactcatcttaaataccttggtcatttctgccttgaaagtctggatgctgctgctgctagtgcctgtgatcaccagatcatctacatagacacctacaactagtctctctgcaccttctcctcgacagtaaatagcatgctcagatggacatctagtgaaccccagaacacccattttttcatccagtttttgattccaggcacggggagcttgatgcaaaccataaagagctttgtgtagtcggtataccttgtgttcctgtccaggttgagcaaatccaggcgcttgctgcacatacacctcctcctggaggtcaccgttcaagaacgccgtcttgacgtccatgtgatggacttgccatccctcctgcgccgccaacgccagcagcagccgcaccgcttccaagcgagcgaccggtgcaaacacctcgtcgtagtcgattccttggcgctgagcgtagccttttgcgacgagccgtgccttgtgccgtaccacggcaccgtgttcatccttcttgactttgaatacccacttgagcccaatggctcgctgcccagatggcaactcagtgagtgtccaggtgtggttgtcctctatggcgcgcagttcctcctccatcgctcgtcgccagcatgggtcttgcccagcatgtgcaagcgacccaggctcctccgcactcactgcaaagagttgctcgttgtacagtacgcgcacggcgtacccaggtggcgacgcagctccggtgacgtcctccactgttcggaaccgcagtggtgcgttgtcgtcgtggtcggcgtccaggtcttcgtctaacgcagcaggtggtgtggcgaactgcacacccggagaagctactccggcctcccctggcgttcctggtggcgtcatatgctgcatagcagccaccggtgcccccgcctggagacctccttgcccctccaccaccccaaattggatggtgaacgtgtcgtcgccgccatgatccgcgccagtgccggccttagctccctccgaccagtcccactgggcggactcatcaaagaccacatcgcgcgtcacgtgcacgcgcttcgtggccggatcgtaggctcgatatgccttagacccgcgctcgtacccgacggaaatcatcttgcggccacgatcctccatcttcttcaggtgcggtgtcgtattcttgacatagacaatgcacccgaaggtcttcaggtggtgtaccgccggcttcttcccgtaccacgcctcgaacggagtcttgccttctactgccttcgtcggtacccggttcaggagatacacggcagtgttcactgcctctccccagaaccaagccggcagcccctttgccttgagcagacagcatgctgtgcctgccaccatggcgttccggcgctcgacgacgccgttctgttgtggggaatacggcgctgtcagctgccggtgcacgccgtccgccgcgcagtactccatgaactccttggatgtgaactcgccaccacgatccgtccggagcgccagcagcttgcagccggactcagcttctgcacgtgcctggaactccttgatggcagccgccgctcgatccttggaccgcagcagcgtcagccacatgtagcggctccgatcgtcgacgagaagcaggaagtaggtgttcccgcttggtgtcgccggtgtcacgggtccacataagtccccgtgtaccagctccagtgcgcggtccgcccgccactgtgtctggtcagggaacgccgtccgtcgctgcttgccggcgagacacgcctcacagagttggtccacctgctcgatggacggcagtccacgaacgagctcctcccgcgccatcttcctcagcgccggcatgttgatctggccgagcctggcatgccaccgccaggcactttcttcgccgcgcgctgccaggcacaccggccgtgccacgtcgacgttgagcacatacagccggttgcctgcgcgtgggatcctcgccagcagtcgcccctcaggctcccgaatctccatgccaccgtgcccgaggtggacgtcgtagtcggcctcctccaactggccgaggctcacgatattcgccgtgagtcgcgggatgtagtaaacgccggtgaaagagcgatgctcgccattcttgcacttgaacagcacggtcccgcgcccttcaatctccgccatggagtcatcgccgaaccagcaccgacccagacaccgccgtgtccagatccgcgaacgccgcccgagaccccgtcatgtggttcgtggccccggtgtcgcagatccaggacgtagggtcccgctgctccttcgcgccgagctgcacgaacacctttccctcctgtagctggatccgcccatcagagctcgccgccgtggcctcctgcgatgaacagctcgccactgcactgggcgcgccgaggacctcatcatgcggaggtggagagtaggggctcgacggggatgaggtgcgcgacggggctggagacaccggtggcggcgcagtggcggatcccgccggcggtggtggaggcgcggatccggccggtgggggcagtggaggaggcgcggatccggccggtgggggcagaggtggaggcgcggatcctcccggcggcggtggagtcgcggatcctcccggcggcggtggagtcgcggaccttgct

SEQ ID NO: 24739 - DNA, 1863 bp, Zea mays
cattgggtacctcgccgcttggccccgtcgccccgcccgcgaccagcatctataacagccgccaccttcccccttatactcgccggaggccaaccagtactcgtgccacgactgccacccctcctcttccttgtgatctccgaatacccatctcagattccaagggccgcgccgtgtaatccccggctctccccacccaccatatatctagtatccgcgcctcaaatccctcgcgaaacgccccgccgtaagcagttgttgtctgccgtgatttgagccgggcggacggattgatcccgggacgaggtgtctcagctcttgatcttgatcctgatcctgggaggcgttcctggtttattggtgggagcgaagaagccatgataccttccgtgaggctctctcctggtcctgcagccttctcaggctccagcctacgctcaaaattaccgtcaattccatccatctccagtctcaaaccctccaaatatgtggtctcctcgctgaaaccactctacctagcaccgctagatggtccgcgcactgccgagcttaagtctcggagacagccacttgagttccgttgttctgcttctgctgctgatgacaaggagtcaaagactcaggtggtgccagttcagtcggaaggcgcacagaggttgaagatctccatctatttcgccacctggtgggcgcttaatgtgatatttaacatttacaacaagaaggttctcaatgcattcccttacccctggctcacctccacactctccctcgcctgtggctctgctatgatgcttttctcgtgggccacccgtcttgttgaggcccctaagaccgacctggacttctggaaagttcttttcccggttgctgtggcgcatacaattggccatgttgctgctacagtgagcatgtctaaggtggcagtgtcattcacacacataattaaaagcgcagaacctgcattcagtgttttggtgtcaaggttcttccttggggagacgtttccaattccagtatatctttctcttcttccaatcattggtggttgtgctctagctgctgtcacagagctgaactttaatatggttggatttatgggtgccatgatatccaaccttgcatttgttttccgcaacatcttctcgaagaggggcatgaaggggaagtccgtcagtggcatgaattactacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatgaagcgtatatcagtgattgtttcatcaatcattatcttccacactcctgtccgcgctgtcaatgcactgggagctgccattgccatccttggcacattcctgtactctcaggcaaaggcgtgaggcgggccatgatgacgaacgtctgcagaatcagtagcaagcactaaatccaattttgcttgttccagtggcatgtaaatatcgggttaggttttccgtatgagagtttgtaataatggatgaatggctctgctgtttcgttcttgtttgttggccagactcaaatccataggccatgaactgcggtcgagtgtacctgaataatactgtaacggagaattcgccgatgctgtttctttatgggtatatatatagtccaagccggaatcccgtttttaaaaaaaaaaaaaaaaaagaacacctgcggcaaaccgccgctccc

SEQ ID NO: 24740 - DNA, 2052 bp, Zea mays
ttgggtacctcgaggcccccgcgcctcttcagcccagcttttataaaacacgcaccggcacctaccagccgccaccttcccggctcctttactcgccggaggcgaaccagaactcgtgccacctcctcctgttccttgccatctccgaattcccatctgaaattccaagggccgcgccgtgcaatcgaggctctccccgctcaccatatatcggaggctccgcccccgcgcctcgaatccttcgcgagaggtgctgttgtttgccgtgatttgagccgggtggaggtgtctcgcttcttgatcttgagaggtgttcctggttgattgttgggagcgaagaaggcatgataccttctgtgaggatctctcctggctatgcagccttctctggctccagcctacgcttaaaattacattcaattccatccatctctagtctcaaaccctccaaatatgtggtctcctcgctgaaaccactctacctagcaccgctagatggtccacacacttctgagcttaagtcttggagacaaccacttgagttccgttgtgctgcttctgctgccgatgacaaggagtcaaagactcaggtggtgccagttcagttggaaggcgcacagaggttaaagatctccatctatttcgcgacctggtgggcgcttaatgtgatatttaacatttacaacaagaaggttctcaatgctttcccttacccctggctcacctccacactctcccttgcctgcggctctgcgatgatgcttttctcgtgggccactcgtcttgttgaggcccccaagaccgacctagacttctggaaagttcttttcccggttgctgtggcacatacaattggccatgttgctgcgacagtgagcatgtctaaggtggcagtgtcattcacacacataattaaaagtgcagaacctgcattcactgttttggtgtcaaagttcctccttggggagacgtttccagttccagtctatctttctcttcttccaatcattggtggttgtgctctagctgctgtcacagagctgaactttaatatggttggatttatgggtgctatgatatccaaccttgcatttgttttccgcaacatcttctcgaagaggggcatgaaggggaagtccgtcagtggcatgaattactatgcttgcctgtcaataatgtcgctggtcatactgactccatttgctatagctatggaaggtcctcagatgtgggctgctggttggcaaaaggctgttgcagaagttggacccaatgttgtctggtggatcgctgcacagagcgtgttctatcacttatataaccaggtgtcctacatgtctctcgatcagatctctccattgacgtttagcattggcaatacaatgaaacgtatatcagtgattgtttcatctataattatcttccacacgcctgtccgccctgtcaatgcactgggagctgccattgccatccttggcacattcctgtactctcaggcaaaggcgtgaggctaaagctttggccaaaggatcggagccagtagcaggcactggatccagttttgcttgttggagtggcatgtagatataaggttcggttttcgtgagagagagggtaataatggatcagtggctctgctgttccgttcttgtttgttgaccagattgaaatgcacaggccgtgacatgaaccgtcgtcaagtgtacctgaataacaccgtaacgaaattcaccgatgctgtttctttatggtattttagcagagctaagctgcgagccatgaccatgaccatgagcgcttgaacctccctacctttctggcgtttgagcatcatcagaagttagcttgaacaagcaagagtgaagatttcgaaggcttgaagaatgttctctgcatcagtgtacaaatatattgcagggctagtacaacaaagtagaatgtgatgttatgtttagctgcattgtgattgctttgccagtttacatgtaacaaaaagatagctgggacgtgaaaaaaaaaaaaaaaagtgcccggaaataataaataagatag

SEQ ID NO: 24741 - DNA, 1850 bp, Zea mays
ccgcccggcccccgcggctccagcacagccgccaccttcccccttatactcgccggaggccaaccagtactcgtgccacccctcctcttccttgtgatctccgaatacccatctcagattccaagggccgcgccgtgtaatccccggctctccccacccaccatatatcctagtatccgcgcctcaaatccctcgcgaaacgccccgccgttagcagttgttgtctgccgtgatttgagccgggcggacggattgatcccgggacgaggtgtctcagcttttgatcttgatcctgatcctgggaggcgttcctggtttattggtgggagcgaagaagccatgataccttccgtgaggctctctcctggtcctgcagccttctcaggctccagcctacgctcaaaattaccgtcaattccatccatctccagtctcaaaccctccaaatatgtggtctcctcgctgaaaccactctacctagcaccgctagatggtccgcgcactgccgagcttaagtctcggagacagccacttgagttccgttgttctgcttctgctgctgatgacaaggagtcaaagactcaggtggtgccagttcagtcggaaggcgcacagaggttgaagatctccatctatttcgccacctggtgggcgcttaatgtgatatttaacatttacaacaagaaggttctcaatgcattcccttacccctggctcacctccacactctccctcgcctgcggctctgctatgatgcttttctcatgggccaccggtcttgttgaggcccctaagaccgacctggacttctggaaagttcttttcccggttgctgtggcgcatacaattggccatgttgctgctacagtgagcatgtctaaggtggcagtgtcattcacacacataattaaaagcgcagaacctgcattcagtgttttggtgtcaaggttcttccttggggagacgtttccaattccagtatatctttctcttcttccaatcattggtggttgtgctctagctgctgtcacagagctgaactttaatatggttggatttatgggtgctatgatgtccaaccttgcatttgttttccgcaacatcttctcgaagaggggcatgaaggggaagtccgtcagtggcatgaattactatgcttgcctgtcaataatgtcgctggtcatactgactccatttgctatagctatggaaggtcctcagatgtgggctgctggttggcaaaaggctgttgcagaagttggacccaatgttgtctggtggatcgctgcacagagcgtgttctatcacttatataaccaggtgtcctacatgtctctcgatcagatctctccattgacgtttagcattggcaatacaatgaaacgtatatcagtgattgtttcatctataattatcttccacacgcctgtccgccctgtcaatgcactgggagctgccattgccatccttggcacattcctgtactctcaggcaaaggcgtgaggctaaagctttggccaaaggatcggagccagtagcaggcactggatccagttttgcttgttggagtggcatgtagatataaggttcggttttcgtgagagagagggtaataatggatcagtggctctgctgttccgttcttgtttgttgaccagattgaaatgcacaggccgtgacatgaaccgtcgtcaagtgtacctgaataacaccgtaacgaaattcaccgatgctgtttctttatgggtatgtaatccaaaccggaatcctggtttcaatagaaatagtttctgctatcaaaaaaaaaaaaaaaaaaaaaaaaaaaaaaactcgagggggggcccggtacc

SEQ ID NO: 24742 - DNA, 1247 bp, Zea mays
ttgcatgcctgcagctgcatcaacaacttctccaacctgcttggcaaggtgtggatgtaatagctcatctactttaattttaaccttcggagaatgctcaacaattggtgactgcaagattgaatagaaccagaaaagaattagcaaacttagagaaatggatttacgcttttagcacaagaaaaccatctatccgtgccaaatgcttcaagggaggagatgcatgtcctcgtttgacaggttcacagcttgcatttgctgattcatgtgacataacttcactagaccttgaactggaggaaatatcactttgctttgagtcgtcagatgagcgttctctattgctaggtgaatttagctttacacggctagctctaacaggagaattgctttccctaaatttgctctcctctcttagagttgttagtatcttcttaattatctttggttgcttattctcatgtccaggatgttgattatcttgtacggattttgatgaatcttgtctcttgagtccaggacaagcagtatctttatgtctctgaagttcagtagtttcagcaccctcggtatcaatggtgttgctggaacttgaagctagtcctgacgtgtttctttcatttgattgtatgctatccatatcactgccagttccagaaatgctactacactgactcccagacatacttttctggaggctccgtgtttcggtgcctggtttctctggcgatcgaccaggatgtaatatattagcaaatggacggtattgatttacataaggttggaggtatggattttttataatctcggatgcctgtaaacaaaaatgtaacagatactctaagaatctaataaatgtgcgtgacaaacaagtattgcagttgcaggggaggtatatctctttgcttagtagcttacagtaggccgatgttcaggactcttcctcaacatgcttttgataagtgttttcatagatgaagaatagaaggtaggcaaagggccaatggaggagcgatttatcttacttatcagtccagccatatcaaaagccttgaaagcaggtcgatgagcagccatctcatacatacaacatccaagagaccatatatctgacttgaatccatagggaatgtctgtaagcaactctgggcacatataatttggggttcccacaaccgaagaggctagatcatctgcctttaaaggcttggccaggccaaaatctccaagacgaatatccctggggc

SEQ ID NO: 24743 - DNA, 900 bp, Zea mays
acgcaagctgcgtggtagtgatgcatgcacggcaacgttatcatagtctctcggttcctgaaagttgacaggcagatagggcagtcgtcatggtttgttttccgggagaaaaaccctgatgccttgtacttccatggctgcaggtaggagatgagctcgtcggataagcctctgtcctcagaccccacagactctacaagtgcctgtctttgctcataagtcatgttgtctggatcatcatcatcatcaccccaccaccattaccatcctcctcatcctcgtcctcttcgtcgtgatggtcgtgcccgtcgtcagagtcggacggagacggcacgcagctgataccgtcgccgtcgtcgtcgacgctgaggccctccatctcctgctgcagcttcgtggcgtactcgaagtccgaggcgatctgggcgtcatccgtgcctggattcctcctggacgaagcagctgctgccgcagcagcggtgctgctctgtgcatggtattcctgtgacggcgcactggatcctgcgcctctcatatagttctcctggttgctgccgtgtgctccttccaagatcgactggtgtaaaccctcctggccgggaagaagatcggcgagcacaaactggagcagctcgtcgtcgaggtcgtcgaggctcacctctaccaccgcgccgcgcgtgggcgagctggcgtagtgcacggtgacccttctcagggccccggactgccccacggtggccatgattagccggccaccgcaccgagacaggcgtgagccggtttgcctctgttcgttggtgtctcttgttgtctgctctcttctctctctctcgactcgaggtttgttgaagggatgggtgctttgttaatcccggccggcctcgaggcgccctacccaat

SEQ ID NO: 24744 - DNA, 958 bp, Zea mays
ggtccctcgggccggccaaaaaaacactgggggcctcggcgccggccccgaagaggccaggacaggtaggcgcacatgccacatcccccgcgagcaactactaccatggcatcctcccctcaacctcctcctcatcctcctcctcgccaggaagaggaccagcaacgggaagaagggcaccaccatggcgacggaggcgacgacgaccagatcaccaccccgctcctggtggaagcggcgacgacgtcgtcgccgtcgccgtcggagggagacgatccagagaactcgccgatcgagcaggtggcgctgacggtgccggtgggcgacgacccgtcgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctgatggcggcggcgctccccgcgcgcgccgtgctccgcggcacccgctgggagttctcgctcaacccgggccccttcagcgtcaaggagcacgtgctcgtcaccatcttcgccaactccggcgccggcaccgtctacgccatccacgtcatcaccgccgtccgcgtcttctacggcaagcacatcaccttcttcgtctccctcctcgtcgtgctcaccacccaggtgctggggttcggctgggcgggaatattccggcggtacctggtggagccggcggcgatgtggtggccgtctaacctcgtgcaggtctccctcttcagggcgctccacgagaaggagcggcgcgtgaagggaggcatgacgcggaaccagttcttcctggtggcattcgtctgcagcttcgcctactacgtcttcccgggctacctgttccagatgctcacctccctgtcgtggctctgctgggcgttcc

SEQ ID NO: 24745 - DNA, 5885 bp, Zea mays
tctccccctggcgtagcgctccaccttcctccccagcgcgagggccccgagcgcagcgcacgcgggcaggacgctgctgacggtgagctcgttgggccgcaccccggccccgtcccacatgtccaggaacgtgcgcaccgcctcctcgtgcctcccgttctgcgcgtagcccgacaccatcgcggtccacgacaccacgctccggtcgggcattcccgcgaacagccgctccgcgtcgcccacgcgcccgcctcgcgcgtacgccgacagcatcgcgttgcgcgcggccgcggccccggccccggccccggcaggcagctcgtcgaacgccctgcgggactccgccagcagccccgccctggcgtaggaggagacgagcgcggacgcgaggaacgggtcgccgggcgccgccgcggcgtggccggacttggccagcaaagcgtgcgcgcacgcggcggccgtggcggtggcggaggagaggagaagcgtgaaggagagcggggtgaggacgcggaggcggtgcgcgcgcgcgaagcaagggagcagcagcgggtggcgcgcggcggccagcgcgtggagcaggcggttgtggagcggcgcggagggcggagacgcggggcaggagccgagaaggcgcgcggcgtagcgcagttcccccgccgccagcacgcgcaggagtagcgcctgcaggcggcgctccccacggcggagcaggcgcgcgtgcagccgcttggcttcctccatcgtcgccgtcagaggggttctgccgatgggccccgcctctcgtccctgctgtcatcatggattaatcgcaccgagatctgagtcttagcccatgggccgagcgtgttgtacgactccattctggcgtcctgggcctgggccttgtctagtgagtggtctcgtctcgtctcgtccatgagttatgagtatacgattgtaataattgtactagtttatattttggtccatcaaaataaaactaggtcaagtggcccatggccattcattagctagcgctggactgacagggaccgtagcggcaagggccctccctagctgcttcaacgattcagagattccctccccttgcttctgaattctgatggcaacgaggaaccgtccaaaagggcatattcatctctcccttctccagctagtctgatgcgacgcaattgttgtgacacgacggcactgaagcgtctgaattgtaaactactacggagtaccaatgaacctaccaaccacgagcatattaaataaattcaaattcatagaaaaatagagacgttgcttcatgatgtgcacatgtgagaggagacggcatcacaaggacctaacacgcgataggtagcaagaatatgagcgagttggcacgtagatatttccatagacatccctgtcccacaaaaaaaatgcagaaacagcaaaaaacagtggtgccagcaagttttagcagacagcaggggtgtgcatgtgaccccaagaggccaggacaggtaggcgcacatgccacatcccccgcgagcaactactaccatggcatcctcccctccacctcctcgccaggaagaggaccagcaacgggaagaagggcaccaccatggcgacggaggcgacgacgaccagatcaccacaccgctccgtaagcacctacgatcctcctcgtagttgattggttgattccctgattcccacgcttcaccctgctaactaacgatcgatgttgcagtggtggaagcggcgacgacgtcgtcgccgtcgccgtcggagggagacgatccagagaactcgccgatcgagcaggtggcgctgacggtgccggtgggcgacgacccgtcgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctgatggcggcggcgctccccgcgcgcgccgtgctccgcggcacccgctgggagttctcgctcaacccgggccccttcagcgtcaaggagcacgtgctcgtcaccatcttcgccaactccggcgccggcaccgtctacgccatccacgtcatcaccgccgtccgcgtcttctacggcaagcacatcaccttcttcgtctccctcctcgtcgtgctcaccacccaggtaggtaggaaagctggtgcaaggggaatgcgtgtgtgcagtgcgcggctagctagcgccactgtccatatgtttggttcacggatacgtagagcctgaccacatgagcatatacgagaagaaccaggctcctactaaacaggctaaacatatacaagagactcttgtttggttagctgtttagattcatacagaaatgtgtgttcagactcacatatgcatgaactcagcctgtacatgcagcgatgctcctcacgcgcgcaccgagagagcctggctgggagttaagttttgcatgtctagagcctggttggtccatgcagcaaaccaaacaagagatgctttaagtatccgcgactgcatatacttggcagatgcagggaaccaatcatacgatgtgtgtgtctctcgtcacgtacgtgttgtgtgcacgcaggtgctggggttcggctgggcgggaatattccggcggtacctggtggagccggcggcgatgtggtggccgtctaacctcgtgcaggtctccctcttcaggtacaccacaactccccaaccgtttctggccaatatgtgtgttatacgattattttaattttggagcagagggaatacgattattttgtatcagctctctgtttttttatttgttacgctttagataaaaaatgaaccagcgaataacaaatattcgagaacgaaaatagtagaagctatcattgattagttgattgtgtactgcttgattggatctacaataggggtgtgagcgaggagagatgtggtaagcaatgtgtgtgtttggcgttctgattcagcataaagacataaggacgtcgccaaggtagacaatggcgcgtggatcacgtggcatgggatatgccacgtcggcttggagctcgcttgcatccaaggccgaaaagggactattcaagattcttacagattcatacggatgtacattatttgttttgttttgccactaaaaactccagtggggccctgggccgccgcacaaacacactggcctccgctccgcacgtgtgtgctggatcaccagggcgctccacgagaaggagcggcgcgtgaagggaggcatgacgcggaaccagttcttcctggtggcattcgtctgcagcttcgcctactacgtcttcccgggctacctgttccagatgctcacctccctgtcgtggctctgctgggcgttcccgcgctccgtggtggcgcagcagctggggtcggggctgagcgggctgggcgtgggcgcggtggggctcgactggtccaccatctcctcctacctcggaagcccgctcgccagcccctggttcgccaccgccaacgtggccgccggcttcgtcctcatcatgtacgtcatcacgcccgccgcgtactactggctcggcctgtacggggcgcgcagcttccccatcttctccgacgggctcttcaccgccgccgggcagacgtacaacatctccagcatcgtggactccaacttccggttcgacaccgaggcatacgagcgcaacggcccgctctacctcagcaccttcttcgccgtcacctacggggtcggcttcgcgtccctcaccgccacggttgtgcacgtcttcctcttccacgggagcgagatctggcagctgagcaggtcagcgttccaagagaagaaggtggacgtgcacacgaggctgatgaggaggtacaggcaggtccccgagtggtggttcatctgcatcctcgtcgccaacgtcgccgtcaccatattcgcctgcgagtactacatcgagcagctccagctgccctggtggggcgtcctgctcgcctgcgccatcgccttcttcttcaccctcccgatagggatcatcacagcgacgacgaaccaggtaacccaccccgacgatctcttttatattagcactacatgcatatatacagctaggtgaggtcatcaattggagtatgcacgcacgcacgcacgcagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaggtggtggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatcttcggcgacctcggcacctactcggcggtcaactggttcttcctgggcggcgccgtcgcgcccctcctcgtgtggctcgcgcaccgggtgttcccgagccagagctggatcctgctcgtcaacatgcccgtgctcatcggctccaccggcatgatgccgccggccaccgccgtcaactacaccacgtggatcattgccgggttcctgtcggggtacgtggtctacaggtaccggcgtcactggtgggagcgccacaactacctgctctctggcgcgctcgacgctggcctggcgttcatggccgtgctcatctacctgtgcttgggcttggagaacgtcggcctcaactggtggggcaatgatctggacgggtgccctctcgcctcttgtcccactgccaaaggtatcgttgttgagggctgcccggtgtatacatgaggaattgagaacccatgcattcggagaagagaacatggcaatgcaagtggacaagtgtctcaagagcaatgtaaataatttatcttttcaaacaatttagggatgggaaattggtgttcctttcattgtaaaatggctggtaattacggctattccagctcggaatcaaatttattccgtggtacaacaaaacataatttattcaaaaaagcgatctcgcatgctcaggaacgctggtgaaaaaaaaattctatcttcctctagttctggtgggcactgatgcatgcaccggtcgtgtgtcgtcgggacgacaggtgctgcatcgctgcaaatatttctgctaataatttctgaagtctaagaccccgtttgactaccctcattatataatctagcctaaataagttaagagctaaacaaacaacatagattattgagtggattatgtaatctaaataactaaattataataatctataagcgggtcaataggggcttatataatacataagctagatcatataagatgtgtttggttgcctggcccagcctgagtctggctcagtgagagaaccaggctcaagggagcccgcatgtgcaaagccaataaacaatgtttggttgcctggtcaaaatgaaccaggcttatatgatacattgtttggttctcatttttgtagcttggcccaattaggttgcctccaattttgttgtgtaaaatgaagctcccgccaaattttaaaattttaagcgctattaaacaaattacaacaaatttgaactaaaaatatgattttgacccataaatatgatttacaataatctgaattaaacagatcctcctgctagtgatttttctcattgaaataattacaatcattgaata

SEQ ID NO: 24746 - DNA, 1251 bp, Zea mays
ttttttttttttttttgtttttttttttttttttagaaaaaaaaaaaacaagcttctaaacaaatataagaccgtgacttacgtacatttccacaagccaaaggaaagataaaaaagacataaatttcagtttttttttcttctttttcttgtgtgatcaagatctacacttcctaacttttttcccttctctttttggattgtttttcattttcttttttcttggtgcaaaacaaaagtagacgatgcaaccagccgggtgtgagtgtgacgccccatcaccttgtcttaccagctccattgtcggatgctagcaaggtccgaacagttcatatttgcatacagggcatgtcttgttgaccctgagccatttggtgacgcaagctgcgtggtagtgatgcatgcacggcaacgttatcatagtctctcggttcctgaaagttgacaggcagatagggcagtcgtcatggtttgttttccgggagaaaaaccctgatgccttgtacttccatggctgcaggtaggagatgagctcgtcggataagcctctgtcctcagaccccacagactctacaagtgcctgtctttgctcataagtcatgttgtctggatcatcatcatcatcaccaccaccattaccatcctcctcatcctcgtcctcttcgtcgtgatggtcgtgcccgtcgtcagagtcggacggagacggcacgcagctgataccgtcgccgtcgtcgtcgacgctgaggccctccatctcctgctgcagcttcgtggcgtactcgaagtccgaggcgatctgggcgtcatccgtgcctggattcctcctggacgaagcagctgctgccgcagcagcggtgctgctctgtgcatggtattcctgtgacggcgcactggatcctgcgcctctcatatagttctcctggttgctgccgtgtgctccttccaagatcgactggtgtaaaccctcctggccgggaagaagatcggcgagcacaaactggagcagctcgtcgtcgaggtcgtcgaggctcacctctaccaccgcgccgcgcgtgggcgagctggcgtagtgcacggtgacccttctcagggccccggactgccccacggtagccatgattagccggccaccgcaccgagacaggcgtgagccggtttgcctctgtttgttcgtgcctcttgttgcctcctctcctctctctctctctctcccaactcaaggtttgttgaagggatgggtgctttgttaat

SEQ ID NO: 24747 - DNA, 4233 bp, Zea mays
  misc_feature (2264)..(2264): n is a, c, g, or t
tttaccatttgttctggtaagggaatttttgtgtgcttttgagaactatatacttgatctttctatgtagcattcaattgattgttgtagtcggtgatggccagaactcagaagcactggagcttgcgtgctcccctgagatgacgtgcacttctaggcagcatccctccaacgatgttctcagcttttgtcttctccagactccagaaatgtttatgcgcgtgatctctgtcaaatatcgagggccgcatcatggctctccattgcgattttcactatattattccgaagcggtctgactgcctctgtgtattgcctaggtctggaaaatccgctcggctcggtggcttagcgagatagactcggtttggctcgatagcattgtgacttgtgagttaagagattaggctcggctcggactattttaggtgccaacaactcctactagtagctttgttgtcggcctggctggaacgacacgctgttaacgataaccacgccactgattcgccgtatgtgtgttaacggacatgacgtggcgtagacgtacgtcgtatggtgtacagtacttctgtttcaccatttttttattactacaggtttcctgctgctttcgttcccagtgttttaatttggctgtgctatacttatgtcacagtgagatggattcttgaataatccaaaactaacagcgtcgtccccaagagcttccaaaacaaactctcgatttcagaacttttggggacttcaaaacgagcatctgtaactttcgaccttagctcgtttgacactcgaccttgtgcgcaggaaaacacgcgctactagaaagtctcgatcggggggggggggggggcggcattcttgtccgtcacgtacgggtcacggctctgcactggcgcgtaaacgaacgtcgtgctcgtgcatgctggcaggtgacatcacgcggaggtggccaacgtacgagtgcgtcgaggttgcaacgcttttttttatatatattaggagttgatgtttatgagctgtcgaagaagaaatctttttttttccaacgctttcaaattttttttgtgatacttggactttgcaatatcagctgcgtggacaagaaatgacgacatatatagccgccaaaaagcaggcgtggtttgaatgaataaaccgaaggggaagcacttgaagcaaaaacagacgattggcccactcacacgcccatattgccccgccgtcgggtgactcggatgatttgcttttgaacggagcggtagcacgatacagtgtgatcataatcgtcgtagaccaagtcatgagcgaagccttcgtgagaaaggaacgcgtaatgaacgaggctttttttgtgttaatgttgtgctgtaactttaaaaaaagattaataaacgagggctctatctagcctgtttggttctacagaaccagctagggcaggacgctgacccagtcgatcgagcacaaaattaaatacaacgcaacttagatctatttactttttttcccgttattattatatactcttacgtagtacttgtaatacttattagatctctatttacttattattttgtaacctgccaaatgaggaggcgtccgcaaggcaagatccttttgacgtggagcgagtgcacctgggcatgagaatcgcacccgtcccgtggttcacttctccctcacgagaactaagatgacaattattattataaaaaacgatcgatctacgtctgctacagtgtgtttttgtgtttgtaagcggcttcgttatatgatgatgatgatcgtcactgctgactgcatggctttatagaccatgcatgagttccatgcatgaccatggagagtgagcaaacgacgagatgacgcgacgcgatcaccaatgcatcacgctttggttgtctctgtgagtgtcggccgaggagagccgtgccacgttcggtttttttattatttacatcatacatatagtctgttggtccagcagcttccattaccatccatgacgcgagacgtgcatccatgaaacgggacgggcgtggtccgacgatcgacgtgtctctcgatctcatccatcgagtttgagggacgggtaagtttcgaggaagcattcctgagccctcgcgcgcgtctgtgtattctagtttgggcattttggcttcttgcgaaaattcgtccaacttgcgcggaacaaactgttcagtccagtgggattgggagcttttcgctcgagaggttccgtgtgtcgtcgtctgtgcttngctgcttgctttgcattgcatgtctggttcgagtgactagtaccgaccaggataaggagattcgagtgtactatctgatcacgtacagtagtgtttagtatgtctaaaggggtattttacaaaaaaaattgtagagtcgtatctccgtgaagagacgcctgtagcttttaaattaaatagtaatagacgtctcacttctgctggacaaatttattatctgttctatcgacttgatactgtacaaacacatttacttctatatttattaataaattatatttatagatactctattatatagtatagtcttttaattgtttcttttgcttgaagaaatatttcgatgtctcttccatatacatacgctaaggagatcacgtggtcctttttgacttcttcttcttctttctttgtctcaggtgactaggtgaggagtgctctgattcgccagacggtttccgtggatgtcactggtttgacagtacagatgcccgtccgtccgactcggcgttggtggaaattttggaggcgctgcatgtcgacattaattagatcatctccctctattatttccacatttctgcttatatagacaaacatatgagatctacggtttatcagtttcatatcaactgtaaccaaacaagatttaacttttaaaacatacaactcacaacaggttaaactataagactatctccattaactaaaacggtgttttataaggtgaccgtaaaaatgaaccactatgataaacgctttttacaatgcaatttgtcctcctgcaacacacggcaccttattttttttcttcttctcaaatcgagcgccacgatgtcgcggcgggacccatcgctatccacgcggccacgccgtccatctggattctggaagcatttctgtagagaatgcgccgtccttctgtgtcttatttatcttatataaaaaaggtcccgcgcccgccccggttctctcctcctggctcctgggtctcatctcctcccttcgcttcgcaaggccaacaaggaactccaccacgcacggccgcacccgcacccgcacccgctctctgctgccatggcgtcgtccttcgtcgcgctcaccgttatgttcggcttcaccgcagccctgtgctgcctccagctcctcggcgcggacaccacggccacgaccacgacccagagcggtctcgcgcgcctggccgcggcctccctggtcccggcggtcctggccgccctgacgctgaccccgctgctcgcgttcgcgcgcgtgcacgcccgtgccggggcggagggggcgctcgtgtcgggccttgccaaggcgaccctcctcgcggggacggtggctctcgtcgcggcggccgtggtgcagctcggcgccgacgggcacctcgaccgcggccgcgacgacgtcgcgcgcctgaacgtgaagtgaagcaagaagcaatccccccctccttcttctcctgactataaaaataacctgcgccaagcgtcggcgtgtcgtcgctgcaggcgtctggacgaccggaccactgctaggtcctcgctctgctcgatccgttcggagctcagcgcgtctgggctttctgatggcggcggcgtctgaaggagaagggggtgattaatgtttggcgtgcccccgtggcccgtgccggtaaaaaggaggatacttttattttgttttcctccgtatatgttggcctagtgcttgcgcttctggatttgtggtaagctcactgtctatgtaatcccactgggactgggatttcagtttgctctttcatctcctggacggtcttgtaaatatatatatatatatactgtgtttcagttaaaaaaaaaaaaaaaagtatcatcgtatgataatgaattaatgatggtgatacttgtggtttaaatttgctctcccatcaaaccgttcagtcgcagtacaaacttggacatggattgatatgactcgaactgaa

SEQ ID NO: 24748 - DNA, 2342 bp, Zea mays
  misc_feature (2014)..(2014): n is a, c, g, or t
gtggtaaaacagaggatgcgaaactatagatgacaatactgtttgacactgtttgcatagtggagtttgaaaagagaaatgtaatagggaggagataaaggagcctaagtcatccactgcaggtatgcccccgtcgcggccgaggtactcaattcatattgaaatccaccctcaccctgtggaattccatggatggtggcattgtgctttctatcaaccaaagcagatcactcgtggaacggtgtgagatcgatcttgaatggcttctttcccttggtaactcgagcaattgcaattaattcctccaacagctcttccagattgcgcagtggccattgagttgggccatcgcatggtgcattcaaggggtcatcatgtacctccatgaaaataccatcaacaccaacagcaacagaagtccttgcaatgcacggtattagttctcgtagcccaccgcttgcaacacctccaccatcaagctttcttccagctggttgctgtagagcatgtgttacatcagctacaactgggcagttgctttccctcagccactcaaggttccttgggtcaacaaatagatcattgtagccaaacatggtaccacgctcacagaccatcacatttggattcccagcaagccttactttctctgtagagttcaccataacagaaggcgcacagaattgtcctttcttgatattgataatttttccagtcttagcagcagccactagaagatcagtctggcgacagaggaaggctggaatctgtatgatgtcagcaactcttccaacagcttcacactggtggctttcgtgcacatcagtgactatcggaaggtcatatgttgctttcaccttttgaaggatctttagaccttcttcaagaccaggaccacggaacgattttgatgatgtacggtttgctttatcaaagctggacttgaacacgagtggaattccaagcttggtcgtaattgctttgatgtgtttggccatcttcaggacgtgctcctccgattcaatcacgttgggaccagccaacaagaagaacggtttggctgccttgagggtgtcgaacagcgccacgggtggagcctccattgtcacgcttcttccacctgcggcggcacaacaaaaacatcaaggcccgtccggccgtccctgtcctagaaccccccaagatcacgagaaagaaatgcagcggaagcacgggagggtgggtgaagcgcacgaacctgggcctcgacggatcgagggatggagatgcagatgcagatgccaccggagcggagcggagcggcacagcaatctgcccgtgaaggagacaggtcaagggagagtggaagagactgagctgaggctgaggatgacagcgaccggaggaccggttggctaatttaagccgagctctaacgagttgaatggacacaggccgaaaatgctgtgggccggacggtcgcaggctcagcccaatcacatccacccagacacagttcgaaaccgaaagtttttgccctcaaaactggtaccgaaaccgaaacaactaaggactagtttggaaacttaaatcccggaattgattgggattaaaaaaaatagtttatttccattttaatcccctccaattcgaaggaggtttgaggttcccaaagtaatcctaatggtctgtttggggtgaaatatttttacagtttttatgtaataccatggttttagataatacagtagtattttattattttatgctatgaggtgtttgtttgctgccaactgctaagcttatacaacaagctgccaagcgcacaggcacgatggatcaagttgttgcatcgtcatacaagctgctaaccatacttgccaacacgcaccacacataaacgatgcagtagtatactacacaccgaccgtggacaaaaacgaggttggccagtggcaatgggcgtggttggccggtgtcggtctgccgatgaacgaggatgactggatctagacgagggcgtggtgcgtcgcanggggatcgaggataaggacgaggcccacgggtggacgaggtaggctggcgactggtggacgaactaggtgtaccacagtggcctggcgcttaggcagtgaccgtccagaatttagaaggtgtgtattcgaaaattttataggataatgatttttaaagactaaagtttttctattggcatagataggagtaattatttgtatatataacatagaattaagcataaacaatataggcataactgatttaataactagtcatcataatttaaaattctaggctaactaaacacaaactacatatttgcatacaactatttcaaaactgaa

SEQ ID NO: 24749 - DNA, 3064 bp, Zea mays
  misc_feature (1007)..(1007): n is a, c, g, or t
  misc_feature (1391)..(1391): n is a, c, g, or t
tagggctgacaaactagaattatcaattatagtctatctgaataaatgtcaatgccatgtcaatcttctcccttcaagagggaaattagagccatttaatggctcaagtctagaaactacacttagggcatatgagatctaagatggtgatgtcgaataaataaacaaacttaaatcgatatacatggatagtttagagttggcttaaattaagcatgcataatactgaaaattattctaaatctaaatcacctttgggaagaattagaacataataaaactttttattttactatacatcaacatctcataatattattgagttaaatatatagattaatatcaatttaactaagaataaaataattatttgcaaaaaaaaagttaactaaagttgtaaacttaaacttaaatgtcagataacactaacataatcttccaacaaacatggacttaaaacaatgttcaagtttaatatataaatatttgtatgtttcactcttcttttgccagaaatgacctagtcggcccacatgccccaacccaacaacctcctccctcatgttgtcctgctccctaggccacaacctaggcctacgccacaaaagtctacacatgtttggctgaaagtatcccaatagatctaagtcatcctatctcatgcaacgcttagctgcaaaaatactaagtacaaaagctagatttttttatcgataggagaaaaccttaattcattcttctctctccatgcacaactctctccctcttcattcactctattctctgtctccaatgtgcgcattcgcctgaggggccccttgccgttgcgcacattcacttaagggtgagcgcaccaccgttgaatggcctcttaaaagtgctctaaggcctacgcatcatcgggcacaagaccgacgattgcgccatcttctaccttggtctactagcatcaccgatggccaggtaatatctaagaacccgttgaccaagcaatatctaagaacatnttttcttttctctccatgcttagggttaggattttcggatttagggaatgttagggttaggattaaggattttggggaaaccatattaggatgtgactttctctattcttctatttaatgtgctagtgggtagaaacacgaatctaaggcttgtgagaccatctatagcagtttatgtatacccatacccatattcaaactacactctataaacagtgcaatctacaatataaaacgatacaaaacggtatttttagtgaccatataggtgcaatatacagtagtttatccatatagtcataaaaacaccttttgcactgctttgtattgtagattgtattgttttatagaatgtagtttgaatatgggtatgtaatgggtaanctgctggtgatggcctgagggcttttgctcacattcatcctaaaatcgattgttgactagtatctaggattagggtgcaggctcaaaaccatggtctcaataccactgttagattctaatgaacttagctcgtaacagtggcaaagctaggtttattctagagatgcaaatgcaccccctaaaaaatacagaattagttataatgtacaaattttcactatatatatacctacattacttgatgtctatgcatacataaaacaattgcactccgtcaaatttgctctaccttcgccactagctctaaacctagccactagacatggtagtgttggcaacctttctttcactaatcatgtaaagataaatcgagtcccgtgtttggtaaataaaaaagttacaacgaacattgattcatgtaccgaccttttttcctgtttttatatgtggtgtaaaagaaacagcaactaataggttatcgtgccttcaattaggatgcggtggtggcatctgactcgatgccatgaccgagtccgatgagaacataaccaacaattgcatttgtttagcgatattgttagtccaacatggcacaactggtgaaataacacaaaccaatccggcaggtttcaacacaatagtttgttcggtgataagactgtctcgagtagatagggtaaaacagggaatgcgaaactgtagatgacaacactgtttgacactgtttgcagagtggagtttgaaaaaggaaataaaatacggaatgagataaagaatctgctagagatagcctaagtcatccactgcaggtatactcccaacaatagcaagtactcaattcatattgaaatccaccctgtggaattccatggatggtggcattgtgctttctatcaaccaaagcagatcactcctggaacggagtgaggtcgatcttgaatggcttctttcccttggtaactcgcttcacatgatggagaaaaggggggataaacaaagggtaaatttactgatatttggcttgaatatattgaaggatatcaaacttacagcaattgcaattaattcctccaacagctcttccagattgcgcaacggctaagaatgaaaagggtgcaaagaaatagtatgtgggttatatgataaacatgatcaatgctaagtaacgtggaaaaggctgcacgaatggactggattatacccattgagttgggccatcgcatggtgcattcaaggggtcatcatgtacctgtgggattatgcaataagatccgtttaatgttgagcataacagcagattatgttaatataccatcgagttgttcatgtccgcatctctttacctccatgaaaataccatcaacaccaacagcaacagaagtccttgcaatgcacggtattagttctcgtagcccaccgcttgcaacacctccaccatcaagcttacaaaataaaacacggcaaagcccgatttaactaaaacaaacaccggcaaaagcaacaataaattcatcataagctagttctgaaattgtgacgaaacaactaatgttttggtggttgagtttttactagtaggtaaaagttcaacataatattgaaactgttaaacttaaaaatagatctgaaggccccaattttggacattacaggttcttctgattgtggttatg

SEQ ID NO: 24750 - DNA, 1378 bp, Zea mays
tttttgtcccgttttttttttttttttttttaacacaaaccaatccggcaggtttcaacacaatagtttgttcggtgataagactgtctcgagtagatagggtaaaacagggaatgcgaaactgtagatgacaacactgtttgacactgtttgcagagtggagtttgaaaaaggaaataaaatacggaatgagataaaaaaatctgctagagatagcctaagtcatccactgcaggtatgctcccaacaatagcaagtactcaattcatattgaaatccaccctgtggaattccatggatggtggcattgtgctttctatcaaccaaagcagatcactcctggaacggagtgaggtcgatcttgaatggcttctttcccttggtaactcgagcaattgcaattaattcctccaacagctcttccagattgcgcaatggccattgagttgggccatcgcatggtgcattcaaggggtcatcatgtacctccatgaaaataccatcaacaccaacagcaaccgaagtccttgcaatgcacggtattagttctcgtagcccaccgcttgcaacacctccaccatcaagctttcttccagctggttgctgtagagcatgtgttacatcagctacaactgggcagttgctttccctcagccactcaaggttccttgggtcaacaaatagatcattgtagccaaacatggtaccacgctcacagaccatcacatttggattcccagcaagccttactttctctgtagagttcaccataacagaaggcgcacagaattgtcctttcttgatattgataatttttccagtcttagcagcagccactagaagatcagtctggcgacagaggaaggctggaatctgtatgatgtcagcaactcttccaacagcttcacactggtggctttcgtgcacatcagtgactatcggaaggtcatatgttgctttcaccttttgaaggatctttagaccttcttcaagaccaggaccacggaacgattttgatgatgtacggtttgctttatcaaagctggacttgaacacgagtggaattccaagcttggtcgtaattgctttgatgtgtttggccatcttcaggacgtgctcctccgattcaatcacgttgggaccagccaacaagaagaacggtttggctgccttgagggtgtcgaacagcgccacgggtggagcctccattgtcacgcttcttccaccctgagagaagacagatcgagggatggagatgcagatgcagatgccaccggagcggagcggcacagcagtcagcaggtgagaggagacaggtcaagggagagtggaagagactgagctgaggatgcggatccggccggcctcgagggtccca

SEQ ID NO: 24751 - DNA, 1466 bp, Zea mays
tttcgttgtgcgtcatctccctccccacacgcgtagtgactagcgagcgttcctcacacgccaacgaaatatcaaaataagtgcagtgtcgtgattcaaactgttggtctatagaaagagaacacttggctctaaccactacaattcatattggtttgtattatgatattagtttgtgttatacagagaaccacaactaactagttgtccagcgagcctgagtcccaataaacagtccaaatctacaccaattaagactaaatatacattattataaaactaattgtataagccatgactaatgtgtgagataaatctattaagagtaattaatttatgattagcacacttgtactgtagcaacctcaattagtttataattagctcatgtttacttgtttagtctcttaattgacatccaaaatccggactaaacttttctcatcaatccaaaacaatccctttgtattgagaacaaaacaattactagagcaccagagggcgctgttttgtttgcgtaagaccagcacacttgatgcctgaaatgctaaccgaaattgcaacttcgcaatcacagacagcaatgctgtatcacagtgtatatcacaatgtggcggattcgtggtactacaataacaaggattagcatacaaggaaggtgctttgagcgcacatgaatcccaagagcaagatgctgacccaggcctcgaacacgccgaggcaagccccagcgacgacgtcgaggacgtagtgccgcccaaggagcaccctggacgccgacgttgcggcggcccagaggaagagcgcctcacggggacggaagccgccggcggcgaggaaggaggccacgaggaaggcgcgggaagagtggccgctggggaaagaccagtggtcagcgctgacggccacgtacatgtccttggcgttgtaggccgggcgcgggcggcggacgaagaccttgacgaggccaacgaggatgaggtccagcacgaggccggcaacaaggcctgccagcagcggggaggccgccccggacgcgttggcgggggacgcggagaggaggagcagggagatggggacggggagccagatgcggccgtcgccggcgacctcgagcgccttgaggaggaggcgcggcaccgggaggaaaagggcgtggaggcggagggacacagccgcgtcgaagccccggacgccgcctaggagggtgggccttgacggcgccggcgccggcggcgaggtggctgcgtttgccatgcgcgccggcagcggcgattgggaaagcttgtggaattggtttggaattccatccagatcaggaattcatgattatactacagcttgtacgaggcaacaaaaaaaaatcagtcaagcaggatcttgcttgggtgcgttcggcccactgggccttcttgatacctagatattggactcaagtgaagagttctcatctcccttctctctac

SEQ ID NO: 24752 - DNA, 2589 bp, Zea mays
agatcaaatttcctggtgagtgcaaaaaaaatatgaaaagctggcttttcacaggatatacatacgtgcaatcagtcagggctctgaaaacacaatacagcagatgcagagatcaacatttaccagattgatgatttctgtagctgtaaactgaactccagcaatacaacttgcaatcatctgattgcacatttacaagtttagtgtacattccgtacccccaaattaattttaaaaagggaaactggatgccaaaacaggatccttagagttagccttcacaggatccgtgtcaactctagaaacctacaaatttgcacagtttatcgagaaacctaacattacttgtgctaactgcagtaggctccaccacaggatccttaaagttagccttctcactcaactcttcaaatgcgttaacaacattctgtagtctggcaacaaactcaatcaggagtgatgcaaatgtagccaaggacaaggcactcgcgctttcatatgtttgggaatcctcatcttcaagtggtatgtttggatggaatgatttacgagcaggccaagaaagtgctggcttaaaaccgtcaattgttgacgctgaatcatatctgctcagaaatgaatttgcaagaaagctctttgactgatgcactaaagtttgatcaactatggtaggttccagccctccattgttgttttctttggatttgttttctttttcgacagcactggtgccatcatccttgttttctttgttcttgttttccgtttccacagcacgggtaccatttacaacttctttgattccttgagcttgcttgctagcatcccatcgttcagtgttcaccagaagatatgacttctcatcaatctttttttgcagctcttcagctgccatgtgcacttcgaacagaatacctgaagaactcagcttggtcattgtcttaactctgcttccgagctcgcgcaatactttagctccttcctgtcccactctttgaatctctgcagaaaatactcttctgctttctggtggtgcctaatgtctgttcataatatatttgtttagaaaaaaaaagtaagaatctcaacagttcgttgttgacattaaatggacgaacctgaatttctgaaagaatgcaaccatgtaatgccattactgcaaaggaacagtgcctcaatgctccactaactttggtgaagctcctccaaggatagttcattgttttgtaaggcccatggggtggctcccatatagcaaagccaagctgaaaacatactagaaattagctaatcaaattcatcaaaatacacatggcagactgttgattgttgaatatggaacaagcacaaaccagggtttcttcctgtgctgatgcctcaacagctgccctgtacccactatatacaggatcatcagatgcttgatacacaagtatttttgaaggaatcctttcatattccatgcatctcagatatccatcaacacaacctagagcaaatgttcaacgaaccgtatcgagcatataagaccttgatgtcattagtttggtagatttggcaagaaataaacaaatcagatgcacgtataatcgatagccagttgaccaagcacacgaaaaaaataacttttccaacattggaaatactctgaattttgagcaggatgcaaggtcatacctttccaaggattttgcaacaccagtgaaattctttgctatcaagttatgcaaatcctctcccgcccagatggggtagatgcctacattgattccaagactgacagcagcaccaatagcaatcaatataaatctgcttgtagctgtatcagtgaatttcccagtgttgtacccagagaccataacataacagaatgtcaacaagaacacacggaatccatactcatacggcttcatcttcggatgtagctttgtcaacgttgtgaaaaaggctaccaatataaacaaggaaaattgcactttagatatattcataggccgctttgagagaaaaaaattgattgctctcagaatgtaagtgcttaccaacaataaggatgcttgttataagaataacttcctccagttttcccaggtgtttggacaattctgcaactactagagcaaaggctcctgcggttagtgtccccaatccccgattaaaccctttgcttaaggttgcaccgatgctgaactcgaagacgacgacgacggtgaggattgcccagacggagtggctgacgatgtcgcgcggctcccggaggaagacgagcagcgagatgagggcgagcgcgagcgcaaccttccccgcgaacacgggcttccgcggatcggcccgcgcgaaggcccacagctccgccaccgcgccgcacgccgccccccaccagcgggcaacaacgccgccagcccgccggagcaggccctccttgggcagctgctccccgtccccggcgatgccgccctgggaggtcgtcggcagggtccaggccgaggagagcagcggcaccgccgccccgcgctggtcctccagcgtcgaccacagcgaccccagtcgcgccggcgacgccggtgttgccgtccgcgcggccgaggc

SEQ ID NO: 24753 - DNA, 4796 bp, Zea mays
ggtgagatcgtattgcaaccgtcagccaagaccactgcgtctaaaagttctaccgtggagaagtcacaaacattttcagtgacagttactatccctccacagagatcgatatccacttcgcatcactcactaaaagctaaattgtgactggcctaccatgtaggaaaaaaacaacacatgtagttgtacttgcaggggaaacaaatgaccggtaagttcttcaaaggatgtactaactcctagacaagacgtcacatcgacacccgcacaacgcactcggagaatttcagaaatgcgatcagatggcggtgccaaacaatcaaagtccaaacggaaactgtccaaccgaggacctcgcgcatgtagtttacgtaccatcgcgcggcccggcctgttcaaagccgccacgatcgtcgttgccggagagagtggtaggatccgcgccggagaattgggcacccctcctcgcggcggagacgcccgcgagcaacaacagcgtgaccccgcaggcgactgacaggggaagcaccgcgacccgggccttcctcccgcgcgggtgtccgggcgcggacgccgccgcctcccccacagcctgcggcgacgacggcggcgagcggcggatccgctccttgatgtccatgtggcgtgacggcggagccgagccgcagggttcttcagttctccctgcccttccgcaggtgcccgcggtcgcgttcgcgacgtgagcgtcgtgccacgccacgatagattagttcggttcggatacggccgacgggcccgcgcgactgaaatagaggacgtttacgaggccgagcacgtgatgggggacgagtggcacaggggttttcgatgcgtttcaggtgaaaaaacggtggggctccctataactatagtggcgacgtgacggcacggtggcgagtgggggcgtcctcggcacgacgttgtcggtggtactggagcacctcggcgtgaggacatcggacgtgggggtttcgcctgttgcgcagtcttgtcgtcggtgccgtgaggacattggtgtcgtttggttcacatattggtaacgcaatgggtaaccgataacgttaaatcatctttgtttaagtccaaccgtaatggaacaacactataaatacataacaccttattcaaatttgttaccgccggtattcgagtgtaaatcattatcattaccatttacgttacatttcgtgaaccaaacggcaccttggatccgacgcggggttcctggcttcgctgggcgcgatcgtgctagttagagccgtagagcacttttgagctgtctgctggccaaccggatgtttggattctctagatgagtaaaagctttacactattttagtttactttgtcgtgacctaaagttttgcgaagtagtttagacttgagataatactttagaccttttaaataaagctaaagtgatctaaataggattaaatagagctttactcttccgctttagggcgtatttgactgcgaatcgcgtgcttcatggcagctttggggcgcattgtctatttggatccgctttttagagatagacttttttatcactttcctatattttttgtgcctaaattttaaaatggctctaggcaatgttattgtaccatcgactattgtaagtatattattgtttttacaaatcattaatttctattgtagtatatcatttttgtgtaataagcacatctctacggccctacgcaactatgcaatggcggacatctctcacaacacaagcactggcattgtgatctgccgaagcttttgtgtagcccccaaatccttatgcagctgtattgcctactgccacgagaaataaagcacagcagcatggaactcacctcggcagccatgcagcaatgcatgtcaacgaatcggccaaatgagcgatgatcatatagtaaacatgtttctcttccttttgacatcagaggatgaacagattaatggatctgtctatcaactatctacacttggatcaaatacaggagggaaagaatacattttgtatggttcctttgtgtttcgcagattaagaataagaataacaatagttctgccctagttagcaagcaagtctgccgtgagtcctgaccagattacagctacactacaaatgagtttgatctacaatcttgagcccccagctcacgtcctcgcagtgcctcacgtaaggcactaccttgcccaaatcggtgtccttcctcgccttgcagtcgtagaagggagcttgatggaagcacggctcgatggacatggcgcggacgcacggtgggtctggcgtcacgtggttctccgacttaagcatgatccacggcttcaggccggcgagcccctgagcagcgtacccgaacgtggaaaagccactggtgatcagcacgtcggtcatgctcaataggtagatctcagcaagcgccttcatgttgtgccccttgttcctcgacctctggtactcctcgtggctcggctggaacactctgacagtcacgccatcaacagccgactgctcgtcgtacttctcctggatctgctcgctgtaccaagcgctcagagaagtcgttagaacagcgatcgtccggttgttccgagtcccactcccggctgctgttcggttattccgagtcccatcggctgctccctctgccatactgatttctggaagcagcttctcgttttgagcacacgagaggatctggttcagaatgtgtgggaacgggccatttctctgcaatatacctttggtttcatatatcctgatctgaattcccacccttttttccgctttggccaggtaggacctgaagcatcttgtaaccgaataccagacgccatttgtcggatggaaaagatagcgcgccaagtgatggaacacggtgtctttctcaggaaacagcctgccgagctcgtcctggaaagctggaacgaggaacagggacggcacgaagtacatgtccgtcctcatgaccagccacggaacacctcgcaggaactgctggtcgtcctcgcagaagaagagtttgtcgtggaaaccatagttgccgtccaggtggaggtacacatagggagggagtctgttgccaaccaaagatcggtccgtaccaccaccgaaagccttgttctgcagcatgttgccgtagctctcagcgctgctctggccgaactcgtcgtcgttcagagggaagtccgaaggaaccagccacgacgttccaggaaagggctcgcagaaaagatccgcgatctccttgtaacggtccaggagcaagatccggttcgtgagcagcgcgtagaggaacgccgaagtgatctcgagcatccggttccctaagccggcgtggatgataaggaacaggtagttgcagtcgtctgtggcattgatcctcatgctctgaccggatttcagctgctttgaagcttccctgtatgctctggtgcctgggccgcacttcttctgcagagcttcttgtttccttagcctctctatgaggtacggagaaggtatgctcggtgaattgtggtagcgtgcgaaacggtacctgcttctgcatgatttgtcatcgaaaccctcgacgagaaggccgcccagaagccgatcgtactctatttgtggcgacggagacagatcgtcggacatgtcgtcttgtatatctgaaagaatatgaagagttttgggtcagtcaactgcaccttgtagttcaccatcatggaagaactcaaagaacacgataaaaaaaactaacatggaagaacatagtgttggcacatgggtgctgccaatgccagaggcgaagtggagcactactgctacaagcctacaagtagtcaacacgatctagaaaaacacgctgtgtttgttcaatatcctgatgaataaattcccttcctatcccgctcaaaacaggaaaaatcgtttaaacatgctgggtaatttatacagaataacacgacagcagcattcctcgtgagaaaggactagattagatcctccaaaatctgcagatcctcctgcttcttgtagacagcaccaagggagcaaggcagagtaatcaaatgaaacgtcgagtcgtgccatcgccatccttcctctcaatcagggtttacagtttcgaaaaagaaaaaaattcggcacccagcaaaaacaggaaatttcgggtttacagtttcgaaaaagaaaaaaattcggcacccagcaaaaacaggaaatttcgaaaattctaggtcaaaatcaaatagatttagatttttaaaaaacaaaaatgatataatttatattaaaaatgctaatttaagaaacatatatttttcataccccaccaaaatcaaagaaatttcggaaatttcaatccaaaattgtaaaccctgctatcaatccatgagagtgtgggaagtgggaacaagttggcaagcgagacaaaaaaaaacagctgtgtctaccctaccggctagtgggctgagcactgcggcgtagcaccggtatgcgggggccaattgccctgccggatttttctattactactactcaacgctggctagccgccctcagttgcagaaccatccggctgggcaatttggctagccgccccaaattgtcctgcacgcaaaacacgggaggccttagctcacttttgaaaccaaaaccctttggatgggtggaccttcataacgaaggagacttgacgggtggcctcagccaataagttgctgccaaaccagaccagctagactaacgatctaaaggaaatttactactcttctgttttcgaaaaaaaaac

SEQ ID NO: 24754 - DNA, 2582 bp, Zea mays
  misc_feature (4)..(4): n is a, c, g, or t
  misc_feature (943)..(943): n is a, c, g, or t
aggncccacatggcagcctctgcactgcaggatctcatcccctccggctgcccgtgcccagccgtcgtggcgcgacggcggcggtcggtctggtagggctcccctcctttccaccagatcagaacagatagtcatagatcactagatcagtgtcacaccacgacccgccagccggaccgccacttgccaaccaacgcctttccctcctcctccgcctccgggcgctagcgggaatggacgccgccgagctgcccctcgtctaccacatcggtctggtgctggccgcgctctgggccgccgccgccgtcggcttccgcggctccctcctctacctcctcgccttcctctacctctacatggtaaatgctcgctgtgcagtgagactgcggaagaggatacaacatgaagagatgaaatctgcctaccaacgaaggctcctctctgatgcagaatcagcacgctggttaaaccatgcaatcgacaagatgtggcctgtctgtatggagaagatcgtttcaaaacttctacggcccatcataccatggttcttggataagttcaaaccttggacagtcagcaaagcaagtattcaggaactttacatgggcaggaatccaccaatctttacctccatgagagttctaccagagacatcagatgatgaccatttggttcttgagctgggattgaattttctttctgctgaagatatgagtgctgtacttgctatgcagctgcacaagagtgtgggacttggaatgactgcaaagatgcatttaacaagcatgcatgtcgagggaaagatattagttggtgtgaattttgttcggagttggccatttcttggccgtgtaagactatgttttgtggagccaccttattttcagatggctgtgaaacactcattatcacgggctcgatgtcactgagtttccaggaattntcaggatggctggattagttgatggatactgcatttgggcagacattagttgagcccaatgtgatagtaataaatgtggaaaaatttgcatctactccttcagaaaataactggttcagcattgaggagagacctcctattgcatatgtgaagcttgagattctagaaggaactgacatgaagccatctgatataaatggactagcggacccatatgtgaaaggtcaccttggtcctttcaaattccaaacacagatacagaggaaaacattgtcccctaagtggtttgaagaatttaaaataccaatcacatcatgggaggcaacgaatgaacttatcatggaagttcgtgataaggaccccatgtttgatgactcacttgggcaatgtaccattagtttacatgatctgagaggtggacaaagacatgacaaatggatatcactgaataatgtgaagaaaggaaggattcacttggcagtaacaattgatgatatatccgaggaccaaaatacatcaagtttggaccaatcattgaagcaagcggatactgaactaccagtatcaacatctgtttgtagcgaagtggatgctagtgaacctcctgaagaaaagaaagtcttaatggatgaagtggagcacataaacattgatggacaagaacagcctggaggtttatatgtacatcgccctggcactggggttccaaggacatgggaatcccggaaaggacgagcacgaaacccagacacacagattcaccaagaggttgacaagcaaaaggaagtcccaacaccaaaagggagtgggcaagggggtctatttaacgtaggctcctttttccggtggaactcgaggaaggggagctccagaaatctcgatgccagccctcctgcaactccgggttctcagagcgtgacagagcttgatccaaagctccctcaaactccacgtcccaacctgaaggagctaggcgagaagcggacgtcgataaagatcgtagtggacgaagaagcaagcccggcagacaaggtgggaggtgcggagaactcaggagaagatgtggcgaaggtgatagagaaaaatgcaggtgaaccgggcaggtcactgacaagcacattgagcaggaagatttgcagaaggagagcagatgataggctatcagatatccccgagaagattgaagctcgtggatctaagccggtgagtgaagggcctattcttgttagaggtgagccaatgataacagtggaccatccgacgacggaacatagcgatggaggtggcactgagcaagatgcggtgggagcaaaggttgctactcagacctcataaggattgctacttaaggtcagcagttcttgttcttgtaatctttgctggtcgatttggttcgggcatgggaccttgctttctgtttatagatcagtgtccatagttgcgaagggtatccatttagaaatggctgaaaaatatagtaacaaagagcagcgtgttgtgcagtgatatacgctcatgttgataagatggctctgttagatcttgtttacttatgtaaagaaacatgaattgcatatatttcttgacataaataatgtaaaacgtatttttttggttgcaaaaaaagtcgacgcggccg

SEQ ID NO: 24755 - DNA, 3660 bp, Zea mays
ggagtggaggcaataaagggaaagctgggcggagtgctcgggtcccgtagccggattagttattaatgcccgcgagcagctagtcgtaggcgtaactattttaaggcagctgtcgccgctggggacttgcgaaagcttcgcctcttttgagaagctctgcaccacgcctcgctccgccccgctccccctccaccacctccaggcttccttcacagtctcgctgttgctagtgctgccttgctgctagtgataggggtcccggggccctcaagttctgggtgggcggcgagcatatggtgggcactgggcgggggaataaggaggaagagaaagaggaggaggagcggcagtagatttgggccgcacaggcagggatggggggcaagtaccgcgcggcgaggacgaagaggtggtggagggggctggcagcggccgggtgggtgctaaccgcggtggtctgctccgcggtgatgcactggaccctgcgccgggacagcatggaccgcgccgaggagcgcctcgtcagcatgtgcgaggagagggccaggatgctgcaggagcagttcggggtcaccgtcaaccacgtccacgccatcgccattctcatctccaccttcaacttcgagaagtcccctccagccatcgaccaggacacctttgcaaaatacacggcaaggacatcatttgagcgaccgctgctcaatggggtggcattcgcacagcgtgtattccatcatgagagggaaatgtttgaaagccagcagggatgggttatgaatacgatgcagcgggagcctgcacctccgcaggttgaatacgccccagtgattttctctcaggatacggtttcctaccttgcacgcattgacatgatgtctggggaggaggaccgagaaaacattttccgggccaggactactggcaaagctgtgttaacaaacccatttcggttgcttggatcaaaccacttgggagtagttctcacgtttgctgtgtaccgccctgatctccctgctgatgcatcagttgagcaacgtgtggaagcaactatcggatatctcggtggagcctttgatgtggagtcacttgtggagaatttgttgagcaaacttgctggcaatcaggatattgtggtaaatgtctatgatgtcacaaatgcttcagatgctatggttttgtatggaccttcaagtttggacgagcaagtgcctttcttgcatgttagcatgttggattttggagatccatttaggaagcatgaaatgagatgcaggtatagacaaaagcttcctatgccgtggtctgccataaccaatcctttgggcacatttgtcatatggatgcttcttgggtatagcattgctgctgcatattctcgatatgacaaagttactgaagattgcagaaagatggaagagctaaaaacgcaggcagaagctgctgatgttgcaaaatctcagttcctggcaactgtgtcacatgagatcagaacacctatgaatggcgtccttggaatgctggatatgcttttaggaacagatctaactatgacacagaaggattatgctcaaactgctcaaatgtgtggcagagcattgattacactgataaatgatgtccttgatcgagcaaagattgaggctggaaagttagagcttgaagcggtgccttttgacctgcgttctctcatggatgatgttgtttccttgttttcttcaaagtcacgggagaagtgcattgagcttgccgtatttgtatgtgacaatgttccgaaggttgttattggagatccttggaggtttcgacagatactgacaaatttggtcgggaatgcagtcaaattcacagaacgaggtcatgtatttgtgcgggtgtgtttggctgaaaactcaaatatggaagccaatcaggtcctacatggagccatgaatggcaaaggtggtagagttgagtcaacagctaatggtgccttcaatactttgagtgggtttgaagcagcagacagacgaaatagttggcaatattttaaactgctcctctctgataaggagtcgcttttggatgatcttgagggcgaaaactctaatcaaagtgattcagatcgtgtcacactagcaataagtattgaggacacaggtgtcgggataccactgcaagcacaagatcgtgtttttacaccgtttatgcaggctgacagttcaacttcaaggaattatggcggtactggcatcggtttaagcatcagcaagtgtctagctgaacttatgggtgggcagataagtttcaccagccatccttctgttggaagcacgttcactttctcagccacactgaagcactcatacaaagatatttcgggtgattcaagtaggagcttgacagaggcactaccaactgcttttaagggaatgaaggccatcttggtagatgggagacctgtacgtagtgctgttacaagatatcacctcaagaggttgggaatacttcttcaagttgtgaacaatatgaacgcagtagtaaaagctttcccaggacaaaatggagcagccggttctagggaaaaagcatcaattctttttattgagagtgacttctggaggcctgagacagatgttcagttattgaaccatctacgcgagcagaagaacggtcagttgtcggatgggcacaaggtagttcttttggtcacctctgaagccgacaaggacaaatatggatccatatttgatattgtgatgtgtaagcctataagggcaagcacaattgcttcatctattcaacaactgctcaaagtagagatagccgaaagaaaagataatcaaaaccggccgtcgtttcttcgaagcttgctggttgggaagaatatattggtcgtagacgataataaagtcaacctcagagttgctgcggctgcactcaagaaatatggtgctaatgttagctgtgttgaaagcggcaaggatgctatcagtctacttcaacccccgcatcgcttcgatgcatgttttatggatgttcagatgccagagatggacgggtttgaggcaaccggacaaataaggcaaatggagttgaaagcgaacgaggaaaggaagaacaagttggctccgatcgaaggcgcgacaactgccgagtaccatctgcctgttctggcaatgacagccgatgttatccaggcaacttacgaagagtgcataaaatcgggaatggatggatacgtatctaaacccttcgacgaggagcagctataccaagcagtctccagattggtagtgggaacgacagattcggctgtttgatgttcaaaatacgatggaccggacttctcattcatcgatcgaagtgaagcatcaccatcttgcctctgtccagctgactctatcccttgacaatgggcctgacatggcctctcacaagactagatgaaaaaaaaagaagatgaaagtgccgtgagttagctacgtgtcacacatgacatgaagttgctgcggcagcccagaggagtgtaggtagatcaccctgtaactctcttgttctttgatgtttataggctgttgtgtcttctgacaattcattggaaataccacatctcgttgcaatccccactgtcagaactgccctgcctcgtctcagccacattatccaggaaactgtttcctt

SEQ ID NO: 24756 - DNA, 860 bp, Zea mays
gtgcactgcagcaggaccctttaatttgtattgtattttttgtgtagtgcaacagatccctttaaatttacatgcccttttttctgtaataattagtcacatagatgtacagcaagagaaacatacctgtgatcattcaatggtccaatgtgtgcagggaatggctacttttcaaggctgatggatgacaacataatgggggaccttcagtcacaagcatgggaaagatggtagagttgaatcaacaactaatggtgtcttcaatactctgagtgggtttgaagcggcagacagacaaaatagttggcaatattttaagatgctcctctctgataaggagtcgcttttggatgatcttgagggaacaaattctgatcaaagtgattcagaccatgtcacactagcgataagtattgaggacacaggtgttgggataccattgcaagcacaagatcgtgtttttacaccgtttatgcaggctgatagttcaacttcaaggaattatggtggtactggcatcggtttaagcattagcaagtgcctagctgaacttatgggtgggcagataagttttgtcagccgtccttttgttggaagcacattcactttctccaccacactgaagcgctcatacaaagatatttcagttgattcaagtaggagcttgttagaggcactaccaactgcttttaagggaatgaaggccatcttgatagatgggagacctgtacgtagtgctgttacaagatatcacctcaagaggttgggaataattgttcaagttgtgaacaatctgagtgcagtagcaaaagctttccctggacaaaatggagcaactgtttctaggtgagtgtcttaag

SEQ ID NO: 24757 - DNA, 851 bp, Zea mays
  misc_feature (2)..(12): n is a, c, g, or t
  misc_feature (14)..(16): n is a, c, g, or t
annnnnnnnnnngnnnaaaaaaaaaaaaaaagggcggcccccgtcaaggtcggcacttttttttttttttttttagacatggtaccacatcacaattcaagctcacttatgaaaatccacataacatttataaaatggaactactatcctctcaacgaacaatccaaatacagtcccaggtggacgtactactagtgataattgacctgtgatacatgcaagcatccaaagcagtaaaagatggagctgtttggcagaaaaaaatacactcgagtggtagcagtcactagaagtaagccccaacatcacatgagggtgcccaggaactagtggccatatttctggaactcccactcactgttatctaatgggcacacttgacgagtcttaagccacctgctgatgcagtggaagtgaaaagcatgattacagactccccaagcaacagtgcactcctcgctggtcgcgctggcttggttcgcctggcactcgatgcatagatccatgatgtggttgcggcagatagcgcagttgtcgacgacgatatcccatgcccagagcgcgacggcgttccacttcttgatctcgaagcgcttgttgggcttgcgggaggaggacggaccggccgcagaggatccctcgccagctggggcgggcggcggcggcgcgttgatgtcggtctccatggcggacatcccggtggtcacgagagccttccgtttgcggagggaaggcgctagcgagaggcagggaatatgtgtacaatttctctagaaggccatggggggagaaatcccaaatagcaaggggagttggatcctctggctggatgccggcctcgaggtacccaa

SEQ ID NO: 24758 - DNA, 877 bp, Zea mays
ggaacataatgaggcccgcttcacttgcaagacaggatatagtgcccaacataatttcagggcattgtccgcaacattcagtaacctatatacatgcggccgaaaggcaaacccacttccataacatcaagacaggcacgtataaaaaaacatgacttcagaaaatggtaccacagcacaatacaagctcacttatgaagatccacataccattgataaaatgggcctactatcctctcaatggatcgtccaaatacagtcccaggtgtacgtactgctagctagttataattgacgggtgatagatgcaagcatcgaaagcagtaagagatggagctgtttggcagacaaaaacacttgagtggcagcaaagccccaacatcacatgacggtgcccaggaactagtggccatatttctggaactcccactcactgttatctaatgggcacacttggcgagtcttaagccacctgctgatgcagtggaagtgaaaagcatgattacagacaccccaagcgacagtgcactcctcgctggtcgcgctagcttggttcgcctggcactcgatgcatagatccatgatgtggttgcggcagatggcgcagttgtcgacgacgatatcccatgcccagagcgcgacggcgttccacttcttgatctcgaagcgcttgttgggcttgcgggaggatgaggaggacggaccgaccacggaggatccctcgccggctggggcgggcggcggcgcgttgatgtcggtctccatggcggacatcggggtggtctcggcctctcgggagtcctcagttcgcggaaggcgctagcgaggcgtagggaatatgtgtcccggcccggcctcgagggacccaatccggacc

SEQ ID NO: 24759 - DNA, 777 bp, Zea mays
ttgctggctaatccacatggattgagattaaaacgaacaggctctccttaagtcaagatcaagacaagatcacaccagcctttagacatggtaccacatcacaattcaagctcacttatgaaaatccacataacatttataaaatggaactactatcctctcaacgaacaatccaaatacagtcccaggtggacgtactactagtgataattgacctgtgatacatgcaagcatccaaagcagtaaaagatggagctgtttggcagaaaaaaatacactcgagtggtagcagtcactagaagtaagccccaacatcacatgagggtgcccaggaactagtggccatatttctggaactcccactcactgttatctaatgggcacacttgacgagtcttaagccacctgctgatgcagtggaagtgaaaagcatgattacagactccccaagcaacagtgcactcctcgctggtcgcgctggcttggttcgcctggcactcgatgcatagatccatgatgtggttgcggcagatagcgcagttgtcgacgacgatatcccatgcccagagcgcgacggcgttccacttcttgatctcgaagcgcttgttgggcttgcgggaggaggacggaccggccgcagaggatccctcgccagctggggcgggcggcggcggcgcgttgatgtcggtctccatggcggacatcccggtggtcacgagagccttccgtttgcggagcggaggcgcgagcgccggccgggggaatatgttttttttt

SEQ ID NO: 24760 - DNA, 713 bp, Zea mays
ccggccgggagcgagggctgcacatgtcccgtgggctcattgcgtgcctcctgccgtgttcgatcgatcggatccccatacgatctactagctagctaagctacacgactcgaccgaggaggaggagcgcgctcaggccgtatagaaacttggagcatgtcgttaaccacccaagtgtttgggcctcccggctacaggcggtggtggatctattacatcgtcaacgatactgatcaattgagtaaagctctgaaccgacatgatcacctggtggtgttcatgttctcggcggagtggaacgaaccctgcaaggcgatgaagaaaccgttcagggacatggccagggctagaaagatgcaggccgtattctgcttggtggacatcgacaagcttaaagatgctgtggcgcagcagttccaagtggaggcgctgccgacgttcgtgctgtacaagaacggcatacagaaggagagggtcgttggcgccaaggtggacgacctcagagccgccatcgacaggaacatatgattccatctccgatcgatcgatccattcatgctgcatgcatatacggtcgactaataacaacatgaggctagcaaaagacgacggacgatcggatcgtccaacaataaacaaataacattattattaatcttcatttctcatccgtttgctggaaaaaaaaaaaaaaaacccgcggccctcgagct

SEQ ID NO: 24761 - DNA, 797 bp, Zea mays
  misc_feature (50)..(50): n is a, c, g, or t
tagccaagttcgaattggcactcgtagcatctattctttccggtcccccngatggtcgatggtgatatttgcgggcgtcgggataatatataatactcgacccgccagccctcccgggagtagggctgcataagtcccgtgggctcattgcgtgttcgatcgatcggatccccatacgatctactagctagctaagctacacgactcgaccgaggaggaggagcgctcaggccgtatagaaacttggagcatgtcgttaaccacccaagtgtttgggcctcccggctacaggcggtggtggatctattacatcgtcaacgatactgatcaattgagtaaagctctgaaccgacctgatcacctggtggtgttcatgttctcggcggagtggaacgaaccctgcaaggcgatgaagaaaccgttcagggacatggccagggctagaaagatgcaggccgtattctgcttggtggacatcgacaagcttaaagatgctgtggcgcagcagttccaagtggaggcgctgccgacgttcgtgctgtacaagaacggcatacagaaagggagggtcgttggcgccaaggtggacgacctcagagccgccatcgacagcaacatatgattccatctccgatcgatcgatccattcgtgctgcatgcatacgatcgactaataagaacatgaggctagcaaaagacgacggatcggatcgatcgtccataaataaacaaataacattattattaatcctcatttctcatcgtttgctctaaaaaaaaaaaaaaaaaggccccca

SEQ ID NO: 24762 - DNA, 828 bp, Zea mays
ggccgcttttttttttttttttttccaagacaggatatcgtgcccaacgtaatttcaggccattgtccgcaacattcagtaacctatatacatgcggccgaaaggcaaacccacttcataacatcaagacaggcacgtataaaaaaacatgacttcagaaaatggtaccacagcacaatacaagctcacttatgaagatccacataccattgataaaatgggcctactatcctctcaatggatcatccaaatacagtcccaggtggatagatgcaagcatcgaaagcagtaagagatggagctgtttggcagacaaaaacacttgagtggcagcaaagccccaacatcacatgacggtgcccaggaactagtggccatatttctggaactcccactcactgttatctaatgggcacacttggcgagtcttaagccacctgctgatgcagtggaagtgaaaagcatgattacagacaccccaagcgacagtgcactcctcgctggtcgcgctagcttggttcgcctggcactcgatgcatagatccatgatgtggttgcggcagatggcgcagttgtcgacgacgatatcccatgcccagagcgcgacggcgttccacttcttgatctcgaagcgcttgttgggcttgcgggaggatgaggaggacggaccgaccacggaggatccctcgccggctggggcgggcggcggcgcgttgatgtcggtctccatggcggacatcggggtggtctcggcctctcgggagtcctcagttcgcggaaggcgctagcgaggcgtagggaatatggtcccggccggcccggcggtcc

SEQ ID NO: 24763 - DNA, 3727 bp, Zea mays
cctttttttttttcaataattcaaatttgaagtgcaagtcatcattcgaatagtggaaaagctgaatggaaaattaatagttatgttattaagtatacattgaggagtatctagaaacaaaccaaaaaattcgaacatcctattcacgaaacatgaccacaaatttgtgatccaatcgttttaaaattgtataaaaaccaaacaacgttagaaaaccataaaacttatcgagatgtcatgacatcttatgtggaggctatgataaaaatgacaaggtttcataaaatttgtcacgtatgacccatacaaaaccgaagaatctctaaataagtttcatgatttcatgtgaaggttgtacacgacaaatttgatcgaaaacttgtcaaaattttataacatccaccaaatatgatatcataatatctaaataagtttcattattttctgacttcactgactttttatacaattttaaaacaactggttttcaagttcatggtcatgttttgtgaacatgatgttcgaaatttctggtctgttctggatatgttctcaatatatactcaataacatgaatatcaattttccattattcgaatagcttgcaattcaaatttgaatttttcgaagaaacttaattaaatgaaaaatactaaatatacaaaacatttcgagaaacgtgccaaaattgaacatgttgttccagatattataggaacacggtagaaaaaatttagggacaaaaaaatacactttgttgagtgtctagaaaaaatattcggtaaacgtccccttgctgagagtgtcagcctaggacacttgataaagttgaagctcgtgagctaccgtcgacttctaacggcgctttaccaagcgtcttgctttatcgagtgtccaacaatagataaaagtagtgtcttcgtatgcgggagtgtcacacactcaataaaccacctctttgccaagtgttgtattttgcgactgcgacactcatcaatgtcgagtgtccgacattttactctcgccaaatgttttagcacttgacaagaatacgtctccggtagtgtgatataccttcctgtggtatttgaccaaaatttatgaaaatatacaactattctgtttattatacaataaaactccttcatgaaaacaccgctatattttccattggccaatacaatacgtacagtggtacggttggatccagggtcttctaatttgaaatttgtttcttaaatatatatatatattaaaaaaaatagaggctgacgggcaagccataaacagtgcattgcacggcaaggagtctcaacgaactcattagttgcaaaagcacacatttagcgctacaaacgctgccgccagagaaaatacagctcgtcgccattcccatactccgtgcaaggataattaggggagggcgcgttgtgcgcgcacggcgcacgcatagcccgatggccgacaccacgagaggtgtccacttgagccgacaggagctaaagaccagccgtttcgctccatgaataatcgtcgctcagatgatagatcacacaactcgcaagcaatacggcagcagcgctattatatatatgggtatgtacaagccggccgggaatccatgcttaaggtgaagcaagcagcacacgagacgatatagagggagggatcatggctctcttccgtgccgccgcgtcaggagggttcgcgctgatccttctcgcgtgctgcagcctcataatgctggcggcggcgtctggcggcggcggcgtggacgacgacggcgtcggtggtgacaggctgatgatggaccggttcctcagctggcaggcgacgtacaaccggtcgtacccgacggcggaggagaggcagcgccggttccaggtgtaccgccgcaacattgagcacatcgaggccaccaaccgggcgggcaacctgacgtacacgctcggcgagaaccagttcgccgacctcacggaggaggagttcctggacctgtacaccatgaaggggatgcccgtccgccgtgacgccggcaagaagcgggccaacgtatcctcctccgccgctgccgtggacgctccgaccagcgtcgactggaggtccaagggcgccgtcacgccgatcaagaaccagggcccgtcgtgctgtccgtatatctatatatgttctcctttgattttgcacctatgcacctctgcgcgcaatccgttaattgatttctgcatgcagctagctgctgggcattcgtgacggcggcgacgatcgagagcatcaccaagatcacgacagggaagctggtgtcgctgtcggagcaggagctgatcgactgcgacccctacgacggcggctgcaacctgggctacttcgtgaacggctacaggtgggtgatccagaacggcgggctcaccaccgaggccaactacccgtaccaggcgcggcggtacgcgtgcagccgctccagggccgcccagcacgccgccaccatctccgactacgtgcagctgccggcgggcgagggccagctgcagcaggcggtggcgcagcagcccgtggccgcggccatcgagatgggcggcagcctgcagttctacagcggcggcgtcttctcggggcagtgcgggaccaggatgaaccacgccatcaccgtcgtcggctacggcgccgactcctcctcgggcctcaagtactggctcgtcaagaactcgtgggggcagagctggggcgagcgcggatacctgcggatgcgccgcgacgtcgggcgcgggggactgtgcggcatcgcgctcgacctcgcgtacccggtcgtgtgattcatatactatcatcgtatgcatgcatgatgcgtacgtgcgtgcgcgcctgcttgttgcatatcggcggcacgtacgtacgtgtatacatatatacgtactactactacactacggattgatctgcatgctgcgacgtataccacgcatatatatatacacacatgaaaactacgtgtaatcaatcgatactagtagacatataccaacggtaacgtgttgcatcccattgtaaaagccggctatcactttcagggacaaaatgcccacattaattattataaaaggctttgttattattaaaaaagtggtccagttcgcactgcttgctccccgcagggccaaataatgccaaattaccaccattaatgaaatattacgggccttaattaatgctatgaatatgagtatgtgtgtatcagaattcatcagacccttgctgtataccatcactactagacgcacaaacacatgtggttccaactcgtattatattgatgttaaatcgtagaaagcaaatccatatatattgatattaaaattagtacgaacgttggatctttcatatctttaagcatcgagatgaggaccctattgcataagtttggttcacacattacacatggcgtgctagagaaactagtagggtgtcatcaccatctgcatgatgaggcataaggtcgattgttgagcaagccaacaacataatcttgtatccaatagttctcatcgaaccttggagtttggattgctggtgggtgtagaatatagctattaatcatgttttgatggtacaaattacatttattgaaaaaagagaaagtgtttatatttaaaagctatgagttgaaagatttcgacatgcatgaaagatctaacatctagtgagtgtttggtttatagggactaaacat

SEQ ID NO: 24764 - DNA, 1473 bp, Zea mays
gactcctatgggcgattgggtccctcgaggccggccgggatccatgcttaaggtgaagcaagcagcacacgagatatagagggagggatcatggctctctcccgtgccgccgcgtcaggagggttcgcgctgatccttctcgcgtgctgcagcctcatcatgctggcggcggcgtctggcggcggcggcggcggcgtggacgacgacggcgtcggtggtgacaggctgatgatggaccggttcctcagctggcaggcgacgtacaaccggtcgtacccgacggcggaggagaggcagcgtcggttccaggtgtaccgccgcaacattgagcacatcgaggccaccaaccgggcgggcaacctgacgtacacgctcggcgagaaccagttcgccgacctcacggaggaggagttcctggacctgtacaccatgaaggggatgcccgtccgccgtgacgccggcaagaagcgggccaacgtctcctcctccgccgccgtggacgctccgaccagcgtcgactggaggtccaagggcgccgtcacgccgatcaagaaccagggcccgtcgtgctctagctgctgggcattcgtgacggcggcgacgatcgagagcatcaccaagatcacgacagggaggctgggtgtcgctgtcggagcaggagctgatcgactgcgacccctacgacggcggctgcaacctgggctacttcgtgaacggctacaggtgggtgatccagaacggcgggctcaccaccgaggccaactacccgtaccaggcgcggcggtacgcgtgcagccgctccagggccgcccagcacgccgccaccatctccgactacgtgcagctgccggcgggcgagggccagctgcagcaggcggtggcgcagcagcccgtggccgcggccatcgagatgggcggcagcctgcagttctacagcggcggcgtcttctcggggcagtgcgggaccaggatgaaccacgccatcaccgtcgtcggctacggcgccgactcctcctcgggcctcaagtactggctcgtcaagaactcgtgggggcagagctggggcgagcgcggatacctgcggatgcgccgcgacgtcgggcgcgggggactgtgcggcatcgcgctcgacctcgcgtacccggtcgtgtgattcatatactatcaatcgtatgcatgcatgatgcgtacgtgcgtgcgcgcctgcttgttggttgttgcatatcggcggcacgtacgtgtatacatatatatacgtactactactacggattgatctgcatgcggcgacgtataccacgcatatatacacacgaaaactactacgtgtaatcaatcgatactagtagacatataccaacggtaacgtgttgcatcattgtaaaagctggctatcagggacaaaatgcccacattaattattataaaaggctttgttattacaaaaaaaaaaaaaaaaagcgaggggcggcc

SEQ ID NO: 24765 - DNA, 2283 bp, Zea mays
cccgtgtgagcctgcaaggaaagagcgcacacaacgtcgtgtctcggcggggtgcccgatggacggccgggcagggcggagtcccgtgtgagccgggagagtggtccgggtcggcggggtccttccggccgccgaaaggctcgccatcgcggagacggcgcgctgcattcttcaggcggccaaaaggctcgccctcgtcgagcacacgcgctgccgcggcgtacgccagcaagaggcagcagcaaacgaacacgagagccggcctagtagccatctccacactccttgcaaggaggcaatgagctagctgaagcttgctggaggtttacagggtagtgagctttcccgccgcccccatcgagctgctggtctactatataacacagctcgcgccttctcgttcgcatataaaaatctgctgcatcgtgcacagggcaaaggatagcgcaccgaataaatgcactgaatcaaaagactgacactcctagagggaagagagtccggccgaggtagctggggtgaacaccgcgcagttcaccgaaatggaaatgggccgtaacgccacgtcttgatgggccggcaccatcgtaccatcctttcactatcgcgtgacccagttccgacttgcacgcaccgacgcgccacgaacgaacgccatgcatgcactgctgcggaactctgccgcccgctgcgccagcgccagtatgcaccgtggtcgacggccatgtgcaggcggtgccgtcgtgtcgtcgtcgccgcgccgagcgcgtgcacgcggcgcgacgagggttagttctcgaacagcacttcagcaagctaagggggcacggtgatggggcgtacgtcgtccgcgcatcacgtacatgcatggctgcatgcatgcgtgccttgcaggtgtggcgttaatggccggtgtccggtccattttcatcagtctcctccctccaatagttcaagaatttactctcagctagctaccatcgctgtggctccataagttccatgcgtggggcaggcagtgcgcgtcggcgtggcagagcgacacggatgtggcacctgtacgagctggactgtggcttcagagggagaaatcaatggcgcgggcagaggttgtttctcgaactgtttgtgtttggacttcaagttttcaaccatccacctagcaccgagacaccgagtacagaggcacagtacgtatttggagccagctttgtgaccatgtggtggcagcagtgccaatgtatgtgtatcagttatcaaaatgccttcgggtgatcgtctgccttggattggattggattggatgcaagatatgaatatgatgcatgtgaggatgaaaacaaacgagtaacaaaccgagtataaaaataaagtagcatgtttaggagttaggggtgcgtttggttacaatgacagaacgggtcgacatgagacgatcccttaaataaaattgtttggttaaggtttaaggtttagaacaggactatctcactgttgtctccagttgtccctcaaaattggagcgacgagagagaacaccaggggacgtccttgtccacgctgtcctgcaaccaaatgcaccatatgacgtcgtcaaaggccatcaaaagatataaaaaaataaatttcaaaatttaacaattttaaatgtatatttgagactctaaataactttaaatctaaaaaattataggtcgcattatgaaatacaaattccgtgtacgtgtaggccatgttaacatcgaagatgagtcaaaagttcctaaattaattttctatttttgagaaactaaaactaaatttgaactctaataaatagtttcaaataaaaacgcatcaactataaacttgtggatcacatcgacctctgtaactttagtatgaatttggtcttcatccgactttatacgaaaaatatgaattatttttacataattggttttaaaaatagtccctaagtcttaagcgaatcagttaatcaatttgtacgggcggcatctaatgcctttgtaaggagttgtttaataaagatggtctctttaaaatatacacatttgtaaataattaacatagctatcgattgttccgacctgtcctaccgtttacataggtggctcctataaaaacatgtctaccatatttatcaggacgtctgtctttaataaattctttttagtagtggggggagtgggactacgaagcaataccaacgaaaacattgatctacgtaactaacatatgaaattagatacgttaagagcaaaaaagtatttttcaaactat

SEQ ID NO: 24766 - DNA, 2238 bp, Zea mays
actggcttttttttttttttttttttttttttttttttacactaacaaatttttgctagctaattatttgctgactaattattaaccattcataaacaataagccagaagtatcgaaacagggctttaggagttaagaccacatgcgcaactgatacaagatagatccaaagaggtatcgagataagtgatgataacttcaccccatcatcaaacacatacgtgcagatcctaagcaagccctgcatgctcgccgcgcacatagttgcattgcggacatacacacggcgactgccgcctagctagttctgcctgatgacgtgcccctcatttgctttcttgaacagacgcgcctgtgccgcggcggcgccgtcgtcaccagagttgagcgcagcaccgaatgcgtccttcacctcctgcgtcgtgaaggggaacctgttgttcaccatggagttgagcaacgacgccgtgccctcgcggtagagcgcgcccatgccgtcctcgcgcgtgttcgccagcgcctccggtacggtgaggtcgtgcccgaacggcaccgccgcgctcgggccgaacagccgcaccagcgggcaccagaaaccgaataggccccagatcacgcccgggtgcatcatccagtaggtgcatgggcccgtgaagggcggcgtgttggggtcgtacggcgttggggtagtcggtgttggcgtcagtggagagaacggtggtgatgtgctgataggcggtaacggcacttgtggagtcggcgtgtacccaccaccgccgccaggcgtggtcggggaggtttcagaggacggtgaaggggggccatagtagccgccgccgccactgccgccaggggttgtgggggaagtatcactggacggcgatggagggccgtagtagccgccgccaggagtggtcggcgaagtgtcactggacggcgacggaggtccgtagtagccaccactaggcgcagacggtgtggtcggagaggtgtcagaagacggcgaaggagggccatagtacccaccaccaccaccaggcgtcgatggagaggtgtcactggatggcgaagggggagcactacaccctccaccaccacctccaggcgtcgacggagaggtgccactggacggcggaggggttgcgctacaccctccatcactacctccaggtgtcgatggagaggtgtcactggacggcgaagggggagcactataccctccaccatcaccgccaggcggcgacgtcggggaggtgtcagaggacggcgagggaggtccgtagtacccaccaccacctccggggcgttgatggagagctgccactagacggcgaagggggagcactacaccctccagtaccaccaccgccgggcgtggtcggggaggtgtcagaggacggcgagggaggcccatagtacccaccaccacctccaggtgtcggtggagaagtatcactggacggcgaaggggggacactacagccaccaccacctccgggcgtcgatggggaggtatcactggacggcgaaggaggagcactgtatccgccgccgccaccgccaggaggcgtcaccggggaggtgtcagatgatggcgaggggggaccgtagtagccaccaccgggcgtcgtcggggaggtgtcgctggacggtgacgggggagcatcgtacccgccgctaccgcctggagctgtcggtgtggtcggggaagtgccgatgtctggcgaaggcgggtagtagctgccgccgccgggtgtggttggcgtggtcggcgaggtgccgatggacggcgggcagggcggagtcccgtgtgagccgggagagtggtccgggtcggcggggtccttccggccgccgaaaggctcgccgtcgcggagacggcgcgctgcattcttcaggcggccaaaaggctcggcctcgtcgagcacacgcgctgccgcggcgtacgccagcaagaggcagcagcaaacgaacacgagagccggcctagtagccatctccacactccttgcaaggaggcaatgagctagctgaagcttgctggaggtttacagggcagtgagctttccagctagccttactagcaactggtctgctatatcccggccggcctcggggtacacaacgatgctagcgcccgctactttttgcatgtgtagatgcagctgcaccaccggagaaggcaaccaaacgcccccgaaatgctcatacgaccgtgttcttcttcttaatcttttg

SEQ ID NO: 24767 - DNA, 1561 bp, Zea mays
aaacatgcatcgacgttgtatacgttagtgtgtgctaggggttttgtgtacaagggcttaaggggttatgtttacgtacgttcatggccccgtgaagggcggcgtgttggggtcgtacggtgttggggtagtcggtgttggcgtcagtggagagaacggcggtgatgtgctgataggcggtaacggcacttgtggagtcggcgtgtaccccccgtcgccgccaggcgtggtcggggaggtttcagaggacggtgaaggggggccatagtagccgccgccgctgccgccaggggttgtgggggaagtgtcactagacggcgatggagggccgtagtagccgccaccgccaggagtggtcggcgaagtgtcactggacggcgacggaggtccgtagtagccaccactaggcgcagacggtgtggtcggagaggtgtcagaagacggcgaaggagggccgtagtacccaccaccgcctccaggcgtcgatggagaggtgtcactggatggcgaagggggagcactacaccctccagtaccaccacctccaggcgtcgaaggagaggtgccactagacggtggagggggagtgctacaccctccatcactacctccaggtgtcgatggagaggtgtcactggatggagaaggaggagcactataccctccaccaccaccgccaggtggtggcgtcggggaggtgtcagaggacggcgagggaggtccgtagtacccaccaccacctccaggcgttgatggagagctgtcactggacggtgaagggggagcaccacaccctccagtaccaccaccgccgggcgtggtcggggaggtgtcagaggacggcgagggaggcccatagtacccaccaccacctccaggtgtcggtggagaagtatcactggacggcgaaggggggacactacagccaccaccacctccgggcgtcgatggggaggtatcactggacggcgaaggaggagcactgtatccgccgccgccaccgccaggaggcgtcgccggggaggtgtcagatgatggcgaagggggaccgtagtagccaccaccaggcgtcgtcggggaggtgtcgctggacggtgacgggggagcatcgtacccgccgctaccgcctggagctgtcggtgtggtcggggaagtgccgatgtctggcgaaggcgggtagtagctgccgccgccgccgggtgtggttggcgtggtcggcgaggtgccgatggacggcgggcagggcggagtcctgtgtgagccgggagagtggtccgggtcggcggggtccttccggccgccgaaaggctcgccatcgcggagacggcgcgctgcattcttcaggcggccaaaaggctcgccctcgtcgagcacacgcgctgccgcggcgtacgccagcaagaggcagcagcaaacgaacacgagagccggcctagtagccatctccacactccttgcaaggaggcaatgagagctagctgaagcttgctggaggtttacagggtagtgagctttcccccgggccaggcccgtgccccggccggcctcgaggtacccaatg

SEQ ID NO: 24768 - DNA, 1393 bp, Zea mays
agtgagttttttttttttttttttaaatagactgtgcatgtgcaccatggttgccccgaccctcaacaaaatgtggttacaataaacagacatgctgccactcagaagtcagaaggccgctgaggttgttctctgaaacatcagactaccgagagttcctagcttcacattcttcttgggccaaaaagtctaactcatttcaacagaaacattttctcctagaggctaagatgcctactatcggaactgccagacaaacggactctcgctataacctctaccaatctaccatcatcactaagccactgcagaagtgaaacatgcaaaaccatacgtcgtcagacaacagactgccactacaatctctatgtcatcatcgtcgctgtagaagtgaacgtgccaacaccattacaccagtcgtcatcagaaagcttgtcgcttcagcctgtccatcagaaggtgcgcaactgactcgtatccttgctcccttgcattatatatggcaatcccagtcggtggtatcttccgcttcttcaagcagaaggagctgttgcatatccagaatttcttgatacccttctcctcaacgcagtgagggcacagccagttcttgttcttccgcacctcttccatctcttcgccgtacctaactttcaggcaaccacggcagagtatcccattagaagaatggcaagatgagcactccgtctttcctaagcatggctgcttcaggtctccttccccgcagcgcttgcagtcctcctcgccgcacaatttcttctgcctgcagaaatggcagcagatcccaagaacagagtcgtacacgccgcccctccccctgctgtcgcaccgcctctcctgcagcgcctgtaccctctccttggccaccgccaccgcccacttcccctccttatcatcttcccatgtatcatcctcatcctccgatcccgccgccgtcaacttactcagaacccctgtgccctgtccattcagccgagtggaacagcggtgcgtcgacgcggatccggtcgggcgggtcggcgtcgcggcgaggaggcggccggagcggcggagcggggtcatgctcgtcacccgtggcctgggggtcttccgaggcgtcgcgctccctgccgcgcggtggctggaggcggaggcgatgtcgctgagctcccccgcgcagcggagaaggccgagcatctccatccgggccatgttctcggagatgcgggcgtcgcggagactctcgtagtcggacttggctccgagtttccccatggcgtcggcggcggcggctgcggcgtctttggacggcttgcaaagattggttgttgtgcttggaggattggtagtgggtcgcgagtgctgagcaacggctctatgtgaagtttgaatt

SEQ ID NO: 24769 - DNA, 932 bp, Zea mays
  misc_feature (1)..(1): n is a, c, g, or t
  misc_feature (908)..(908): n is a, c, g, or t
naaccttttttttttttttttttgcgaagatataaaatttatttgacataattaaataaaatatagaccatgtctagattaaacataacacaccttctcgatctgaccacatacatcccataatattatatggatcatgtatgacacggatcggagaaactgaattgaaggagttgaggcagcgcgagctaggagggattattaagcggattgggaggagacgaattgaagatccggatctgctccaggaacgtctgcccctgcggccggtccttgcgccggacatacccggctgccacgccgtgggtgtactcggggacgcccttctccccgctgcgccgccacatgtcgttggcgtagctccggtgcgcgaagtaggcgatcgcatccaccgcgccgccgccgccgccgccgccgccctcgaggtccacggccacggccagccgctcgtagtgccccgtctccacgccctccagctcgtccagccgcgcaagcccgcgggccgtcaccgcgtacgcctccccgcgcacgcggtgcgccccggcgccggcgccggggaggttcagcaggaacggcacccggtacggcccgcacaccagcggcagccgcgccgacgtcaccgcggggcccaccagcgacgcgtccccgctcgcgaagagctcctccaggaggcggtggttggagaagccgcgcttcagcgtcccgtacgtgaacaccagcgtcgtccgctgcttcgccgccggggggtgggtacggtggcggtcctgcggatcccccgccggagccggagcgtcgccggtcgtgcccataggaggtgcgggcgttgattaatctgtctgtatctcagatgagagattcttaggaggaggaggaggttgttgttggtgctgcgtctgcctgccgcgggnggggggcctacgtagctgactcga

SEQ ID NO: 24770 - DNA, 1299 bp, Zea mays
ttttttttttttttttttgttttttttttttggagaataatttcttactcagaaaatctaaaatttgactcaataagaaaaacaactctttgagttggtcttaaacttagcccgtataaatgcgttgtgtgggataaggactactatatgagagcacctgtataatctaatctcaatacattctcggctcaacaatagcgttacccaatcctgtgccttccagaagtacaaaaatgtaatgaacaccattgtggtgaacattttaaaagagttaagggtaaaaggcatgtttctcattctgaactccgcgaccttttctttcgtggtctcaactttggtttcttctcaccaccagctctccctgttgccatgtgcttccgctttgctgttgttgcatcagcatccccaaccattaggtgctcataatcatccaggcttgcaaatggagacaacccactcttcttccctgccctccttttctttgtgtaagagacaccgcccttaccagcatcaaccatctcgtcatcacttaagttgccatctgaatcgcccgcgagaataggaatgtcatcgtcattttctgacccttcatccccagatgcagtatcatctgaaacgtcatcaaattccacatcactgtcatctctaagtaaatctttttcctcttcaaatgcatttgagtcaaggtcgtcatagtcatattctccatcatctgccaacccatctcccagatccagtatctcatctccactctcgtcactagcctcatcagcgtcattatcagctaagagttcccccgcatcttcatcaagaactgagtccttctgctttgtcttacgcttaacagtgccggtcttgttcaaatagaaacggtggaaaacaatatcttcaggaggcacttcattttctgccaattctagaagctcctctccgatgagatgatgattcagattaagctttttagccggagcaatttgtgatccaccatgccatcttccttcagctatgcggttcccttttggtttcttttccatgaatttgtcaaggaaagcaggaagtgataggtctgtcagcggatcaccactgtacacaatattgttgccagatagcaatgttctagccatagtagaaactgaagggtgcacatgtgaagccaatactgttaactcccaccaactgacacgatctgcattgcagtaagaaggctctctgtgtcgtcgatcgcggggggcgtcccgtctggacgagtcagttgatgcatgttctcatataccaacccggccggcctcgagggtccca

SEQ ID NO: 24771 - DNA, 892 bp, Zea mays
  misc_feature (16)..(16): n is a, c, g, or t
ctaagggaaacacagnctggtagctcgagggccgcttttttttttttttttttgaagataaaacgcttttattccaccataacaattcacaagttcgtccgcgttttgtctggctctggctggcgtggcgtgtaaccaacggatcacaagacaacacgcccgcgggatcacgacgacgcagccagcgcatcagctggccctgaccggtagtacccatcgctcagccgatgaggtcggtgatggccgtgcagacgaccgcaatcttcgaggactcctcgccccaccgcgcgacctgcggcggcgggcgcacggcggcccgcgcgaaggcgtcgtcgcagcggcgggccagggccgccgcctccgtggccttgcccttgcccgccgcgtagtcgcggcggttgatcccgtcgtacgcctccgcgaacgccatctccgccgcgtcgtacagcctctggcactgctccagcgccgcccgcgcctgggcgtcggccggcggcttggccagcagggccttgatgtcgtagacggcgtccccggcggtggcgacgcccacgtcggcggccaccttggccaggccccaggtgtccgcgtcggggctgtcgtggtggtggctcagcctcgacacgcagaagccgtagtccacgcgccggtcgtgggccgccgccgccgcgcacgtcgtctccggggtggcgccgacgctcagcgcgagcgtcgcgacgagggccgcggcggccagagcgccagccgtggaaggtctcattggtctcgtacctctgctggataaccggcgctgttccggcgatagagctcggtgggtggtggctttgctgtcttgagagttgagccgagtgcctggtggtgtggactgtggagtgagtgaccgagtgaggac

SEQ ID NO: 24772 - DNA, 6492 bp, Zea mays
agaaaacccgactaatccggtttgaaatttgactaagccgggtttcacgagctcgagtgatcgggaccaaacaaacgagccaacttagcaggttccgagtgatggaacgggcttagtgggtttgcatgccagcctagcgtttttctccattctttgattgtctatgttgttgcgccaaatgttctccaacaattctttgatactaggaatttgttggtgttgtttaattcctacattggaaaatttttttatgtggcaacaactatcttcttatatttgtataaaacctatgtaatcagactctttgtttgagggagagttggaaaaaaataaaaagaaaaatctaaggaaaaataattctgctgaagtttttttttgcgccagtactgcagccaaaatgattggggagagcggagctaactttactcgacacatcagaataacataactcctttattattatttgtatacaaagttctctaaaggtacaaactttgaagtcgtgtcgtgtcacacctgtcaactcgatcgaccacgtactggacgcacaccatggtattggtactcatgtgtttccgtaaatgtacagtaccatatatagtattcacttgatgaggttagtgatggcgatgcagatatcagcgatccgcacgttgtaggagctgtgctgcgccagcggcgacgggacggcggcggccacggcgagggcgtcgtcgcactggcgcgcgagggacaccgcctccgcgaccttggccttcccggcggcgtagcggcggttgttgatctcgtcgtccgcctcggcgaacgcgaacccgacggagccgtacagcctcccgcacttctccagcgccgcgcgcgtcgggccgtcgggcctcttgttggcgagcagggccttgatgtcgtacacggcgttgtcggcgttgttgacgcccgtcagcgcggccaccttggcgaggccccaggtgtcggcgtcggggctctcgcggtgcatgcccagctcggcgacgcagaacgcgtagtccacgcgcgcgtcgctgtccgccgccgccctgcacgtcgtcaccaccgtcgcggtggcgccgcccgccaggcagccaagcgcgagggcgaaggcgaggaggaggtggacggcctgcggcagcggcgccatcgccttcgtcgtcgatggaggggattcttggtgccctctttgtgtcgggaaaagagtgatgatcaggatcagctcgatgggtggtggttttgctttagctgtgatgggacaaccggacaagactgaagtgtgggcagtcacgtttcccggccggccggccccttatatagccgtggatcccaactcgtgggccctatcgtaccgttttagcctgtcgatagaatgggctgtttggatcttttctttccatacatacagcccataaatccatcaatgactcgctttatagcaaaccaagtagccgaaggcttccaaatccaattgagcatgcccacacttctctgccagtttggattttctttctgttttttcggggccgcagatgtgaacatgtgttcgagaagtcaaataaatcttaaatttaacttcatagaaaatagtataaatattcgtagtacttttcatagagggacacttatctctgtagcaaataagatcgtaatgcataatgaccattggctcctcacagagaacaaagaaagaaggaaaattaccattgttctgtttttttgaaaaaacgtggaacatcaatatataactaatgtttattgacatataattagtgtttattaatatttatttagtgtctattaaatgttttaacatataattagtatccattaattgatttaacatataattagtgtctctcaacatgtaacacgtatgttgcttgtgtattgccacgggttacttgtgtattgcaatgggttctatatatcgtatgagtagtcgtttgaataagacacaatatatatatatatatattctattgattaggtgagtgtgaatgtggagctaacaaccaagattcaaatactcgttttacataattttaatttatgtagctggtgatttatatagtagatattagtgtctattagtttagtttaacatgtatttagtttctattaatgtattaattagttccaattaacatataaatataattaatgtctcttaatatgtaattagtgtcttttaacatatatttagtatatactaacatgtaattattgtctattaattgattttaaaatgtaactaatgtctaccaattgattttaacatataactagtgtctattaacagataatgtgtgttaaataatttttacatgtaattaatgtgtgttaaataatttttacatgtaattgatgtctattaaataattttattacataattagtgtttattaaatattttacttaatagattttaatcattgagtattcatgcaagcaaagagagacaccaatcaggccctagtgtgcgcaggcgcgcccgcagcggcatcccctccaattctggtggcctgacgcgtgagtaactgctggcagtagcggcctttacacagggctgtcaacaaaaacagtctccacattgtttgtttatggaactttgcggaaaaataagcagggcttgatgaataatacaggtcgcacttggcagtagtaatagcagaacgacgaggctttcctttgtgttgttctgttgcagcgcgcagaaataaaacgcttttattccagcataacaattcacaagttcgtccgcgttttgtctggctctggctggcgtggcgtgtaaccaacggatgacaagacaacacgcccgcggatcacgacgacgcagccagcgcatcacctggccctgaccggtacccatcgctcagccgatgaggtcggtgatggccgtgcagacgacggcaatcttcgaggactcctcgccccaccgcgcgacctgcggcggcgggcgcacggcggcccgcgcgaaggcgtcgtcgcaccggcgggccagcgcagccgcctccgtggccttgcccttgcccgccgcgtagtcgcgccggttgatcccgtcgtacgcctccgcgaacgccatctccgccgcgtcgtacagcctctggcactgctccagcgccgcccgcgcctgggcgtcggccggcggcttggccagcagggccttgatgtcgtagacggcgtccccggcggtggcgacgcccacgtcggcggccaccttggccaggccccaggtgtccgcgtcggggctgtcgtggtggtggctcagcctcgacacgcagaagccgtagtccacgcgccggtcgtgggccgccgccgccgcgcacgtcgtctccggggtggcgccgacgctcagcgcgagcgtcgcgacgagggccgcggcggccagagcgccagccgtggaaggtctcattggtctcgtacctctgctagtgctagataatcggcgctgttccggcgatacagctcggtggctggtggctggtggctggcggtgctgtcttgagccgagtgcctggtggtgtggactgtggagtgaccgagtgaggatgaatccctacgatgccagcagagttatctagatctcccgtggggccgtcctgttcgtttgggcctactaaaaaaaagcgcggccgatgcttatccgtgcctctggcccattaaggttcggttgggccataattttctttaagctgaaggacgatccagcccaggtgcaggggcgaacccctcttctttccggttgccttgcccgacgcttggatgaggagaccaagcaactgcgggtctgcaatcgaagcgaaagcaccgaaacaatcgaccaatcctgctctcgcatctgaatccaacgcaggcgaagcgtcgcgagtccaggtaagtagccgcaactaggatcaacgcatctgcattctcgtccgaataccgcagtagattcatgcacgcacaccgtcttgatccgagaaccatgggattgaggcgcaagaggggggagattcatcagatcaatctgtggagaagtacttcagtgctgctcgcccgtggccctgggaaaccatttacctatcgcgggcgtaaggaaggtccaatatctagtgagaattatgctaagccacttgagcagaacagagaatttggtatcgtggatcagtgtgtcagaagcagcagtgtggctggtacggtgggaacgaacttgatatcgtgcatttggatggaagtgaacttgatatcgtgcatcctttttcaaagctcaatgaaacaaccggttacaaggtacgcaaagaagtttgcatcttcttcttcttcttcttcttcttcttttttggtttggtttgaaagaaaaagttgtcgtttttgtttactccatcacttcaacctctgacccttgacggtttctgttttcagccacataatccttctgggctatcttctgctgccgcgcgcagcaaaagtcgcctgacgctggcacaccctgcattagtttgcattggtgaattctggtcgattgtgactactggtgactggtgacgggcaacagctcgttctgactctctgccctgccatatgctcatcagctcatggcgcagcaaagcacgtgttttagtttaattttgtcatacattacatacattcgactgggatcatctcatacggacgcatcatcatcaatggccggtgacatcagaggtttggtagacgttgcatccatttcttcctgccccggccggccgtcgagggttttggtttctcgtgccggcttccgcttcagcccattagtacgtcccattattcatgccgacgctgaagggcgtgccatcccgttggccctccttccgtacgtgggcttcgctatttttacaaccagaagcaagcaccggagcgttgtctggcactggagagaaagtgaagctgcctgctagctagatgtgggaacgttcggttctgaaaggtcactcttcaagcgcagttagggcgtgtttgcgaccctgtatctatctggtcggctcggctcgttcaactggtctagctactgtaacttaatttgtttgcaccactgataccgtatgagactactctgattcagatgaaccgaatgacaccattgagccagggttttctttagttattagaatatcaaggctcgtaatatacaatctatatctatatacatatatgaattggccatgatttaatgtatcgtccggcggtggtggtggcaaagttgaccaaggggccggggggtgcagcggcaattaaggtgggcgatgctcgcaatattcagatggaagcgtgctggttcatggagggtggcgtcccggaatttaattcgcctcttcattgcgtcgcgtcatacaatgcgtaccagttccttcctgcgtttgctactctcctctcacgttgagagtagagacagagtcacggtctcacctgctccgctatcgatcgttcgttgcaattgcagccaggctctgagaaaaaaatgctatgctcgtctcttttctacttctcctagcttgacaaggatacgccaccatctccaacaaagaaagaaaaaaatgtcgcggttcccctgcaggctgcagctcaaatatatgattgtcgttcgacgtatcgatcacgacgacttccccatccaacgtgaacatcggaaaaccggcgaacgcttccagtttttatgtagagctccggccgggaagaagaagcagggagggatctagagctcatgtttcattcctgttgggaaacggacggactgctgagcgaaaccgaagctactgctggtactgattgatagaactagtggtaatgataatggggaaaaaaagggggaaacttgtggattttcgatagtgccgtgcggtgtggaactgcggatggtcacgccctcctgttcctccggccaccggcgccgctggtgctactgcggctgtgatcgccgtcctcccgccggctgacgttgatgctgctgctgctgcgggtggcggctgcggcggcgtggtgcaggaagtcgaggaggacggggctgcggcagcgggggcagcgcgggtcggcctcggagagcatcacgtacatgaggcagcgcgggcaggccgccagcaccatgggcgtcgcctccgggctgtcggaccactgcagcccgtgcccgtggatctgcggccgcggctcccgctcgccctccgacgacgacaggcacgagctcggcggcggcgacggcgacgacgacgaagacgaccactcctcgtcggaggacgacgccgccgacgccgggggagacaggtgcagcttcaggtccagccccccgcccttcccacccttgctgctgcctcggctcatcacgcccgtgaagcttcagcaaggctaatcactattaatacatacaccgccatagattttgattgattgatgctatgctaccgcctagtaatggaagtgttgtactaggagcgagagcgcttactgtctcgtctcggtgacgacggtcggtctgca

SEQ ID NO: 24773 - DNA, 5729 bp, Zea mays
  misc_feature (235)..(235): n is a, c, g, or t
  misc_feature (421)..(421): n is a, c, g, or t
  misc_feature (509)..(509): n is a, c, g, or t
  misc_feature (672)..(672): n is a, c, g, or t
  misc_feature (5620)..(5620): n is a, c, g, or t
ctgatggttgcaatggagtagtgaaacagctaaattaaaataacaaaatttatgtatggctaagattacaaatggattatgaaatattttttataacaaaataagacacattttgtatataagttattatgttattatatgttctcgttgcaatgcacgggtactcacctagtataagtatgagtatggataagccgctgtagatgttctgatatacagacagagcatgtatcancggtttctaccttttctgtattattttatctctgtatattacatattttaatccaacagcgaacggtacgatacagcaagccccggacactattggtgtcttcttctccgccctgccgttccgcgcggaacatttccaccgctttccacttgcctggcggcctggtccctgtgatttgtggaattntcgcgcgcatgtgttagcatgcagccagcaacggacacggaggtggtagggggagctgtgaagaaagagccagaagagatcgtggtcnaagtagacggcgacggggacgaggaagccgagaaggtggtcaagaggaggcggaggaggaggaagaagacgacggcctgggatccgcacaagaagcgcgcatgcgtggattgcacgaagaggtgcgcccggatccatggccagcctgcttcgccgtccgcatnggcgtcgtcttccagcaacgcgcggccggtcccggcagtgccgtccttcttcaaggtcatgttgggctacttctccgaggacatggtatgttttcttttcctttattttcttttctccggattacttgcttcgatctcgctgcatgtctgcattgttttgtaaaggcatagtttctgtgcatgtttgcatagattagtaggcaggaggtcgcccaaggatttcagtgataccagaacgagctcatgagtcatgaaccacgtactgttgcacaaacgcaggatataccacccccttttgccaagacaatctgggacctggcaggctccaacgtctttctcgaagacgcgttcgggctccgctggcgcgtgcggctctgcctgcgcgacggcgtgctgtcattcgggcacggatggaagaacttcgtgctggaccatgccgtcagctgcggcgagttcctggtgttcaggcagatcgccaggtcggtcttcaccgtgcagatgttcgccccatcagccgtcgagaggctgcacctctgtgagaggaacaagaggcagagccggaagaggaagcccaggccgcagagacagagaacaagctctcccagtatccagactgtcaaggcgaccaagaacagagtgaagaacagtaataagaagagacagcgtactgatgatcaccaaaacggtgtacgcccgagaggccataagagcaagacggcagctcaggtctgcgtcgacgactctgacgtccccgatcctgcgtctgaaccgaagtgtccagacacgtcggaaagattgccggaggctgaagtcacagaaccgcaagaaatttctgagccccctgcgggacgacatgagcgtgaagctcagaaggtgttagacggagaggcagaggtagcagacgacagcgcaatgcttgaagagactgaaaccatctacaacgctagacttacggagcaccaggttcctgctgccaatgaaacagagcatggcgagtgcttggcaaatttcgatgctagcatacctcttgctatgatggatctgaatgaagtgagcatagacgatatatttctgtcggctgatacgtacgaatttggaagtgacatgtgtaacccagaaccgttttctgttggtctgaacatggaaggcaccactactggccaaaactcgggattcagttgccttgaggagctggataccccacagaaccacctttcttccatgggagatggccattgttctctggttccagaagcaggaccatgtaccgaaaacaacaaagagaaggctgatgcactagaaacgggagcatcgtatttctgtgactcctcgtttcatgatatagacatcaacgcgttgcccgctaaggagccgccgtcgtttggagaggatagcccttctcctcgagctggcgctgaaatgcatcctaatgaatgtggattaagcagctgtagtcaggatagaggcaatagttccctccttatcatcaacaagcaagctgcacataaagaatgtcagtactattttccaaacctttgtttctgaatttacacgtacactttttttttggttcccctctgtgtttgcatgggtttttagagtcaccacaaagattcagcgtttgttgcagcagattctttcatgacgacgaagcaggataaaccacaaggtggacaatgtagcatgcaggatggggtaggacgacagcatcctactgaaatcacgtcgagaaatgcaaagcctcgtgaatctcctgaactcacgcggaatcctctgggaactggtattgcagtgttcatcatgatttatgactctccgagaatttagagccttgaatgaactggatggatgttagtttcgcacctgtacctgccgcacagcactcagttcacgcgtttcagcacaacttgcaggaactggctctgaatccacccacagcggaacctctgaatctggtggtcttctcgcgctcacagaaaacatcaccaaattctgcatcgctgtgcctgcaccagggcaaacatggcttgtgagtaaccctgactgatctgagctcaccgttatggaccatagttctgaaagatttttctttgtacaggagattcccggccgactgccggtcattccaagaacgaagaaacatgggaggaaggttgtgatgctcaaggacccacgcatgagactctggcctgtgctctaccaatgcaccccgaggttcaacggcatcatcactggctgggttgacgtctgcagggagaacagaatcaaggaaggtgacacctgcgagttcgaactcagcggtaactctgaactctcattccaactccaagtgcgcgtgcccaatacgcacccagaatgttgaccttatctatcgtatcttaggcttctgtgtcccatctttttccttcaatcccgaaataagaatgtatgtagacttctgttaacaaggaaatgtcgatgctttctggcacattttcatgtccagattgtccccttttcttttttttattacaatggaatattcagattatccgtgcatgctaaaaaaagaagtctgactgctaccactgctgctatcaatgaagaaatggaacttttttttgtagtgttacagaagtcaagcgttctcagtttggcaaagttgaaagctagattttgatgccatccgtggattccccttcgaacaactccgatagcaactcgaccagatcatctgccgtgtacctggcagatttcccaagcttgggttgcttctgcaggaacgcgcagtaagcagggaccaccatctccgacacggcgttccgcagcaccgctcggagcacggggtccgggacctcgcggcacatctcgctgtcgcgcgatctgttaaacgccgcgttgaactccgccagaactttcgccgacttgcctctgccacacgcggtcgtgtccaggagagcgacgacggggccccacgacgacgcggcgtagctcgctacgtgctgctcgacccggctccggcgccgcgccgcccacgcgtccccgagcagggaagccacgccgtcgttgtccgcgacgcggctcagcacgaagctgatgttgttcgccaggaagaggtgccgcgagccccctgcgtccgcgcaggcgacagcgaatctcctctggaggttgcgttccaggcccgcgatcaggtccgagacgacgccggcgagggagccgcgctcgtcggcgcccgcgaggatcagatcgagcgtggtgcggtgcctcgccagcagctcgacgcaggtcatggcgtcgcgtgtcagcgggtggacgccacctgcggcgctcggcgtgtgcgggaacagtgagtcgccttggatcttggctatggcgccgctgaccatgatcctcaccgcgccggccagtttcgtgaggataccttgtgtccgctcccgcccgccctcccgcccccccccccggaggaggagcaggaggctgggagcggcgtcggtgagagcctcgtacatgccgagcatgtacacgagcttctcgtgcgacgtgatgctggtgaatccgttggcgaagtcgagcaggatcaggatgcggttctccgcgatggccagcaagtattcgtccctgaaaccgtcgaaggcgcctgggttctgcgcgtacagctgcctccgcatggcgaccatggccttccctatgatctccgtcaccgtcgtccaccgcttgatcacggcctcagtcgtctgctgcgagcattcgacccgaagaattgacaagaaactgcaccgtgatcgtcgtcactcagtcacatccgagcatggaaatccattcaccagcaggaagccagagaaaccagaagcgtcgaagttacctgtctagcacatcgcagggagcgttggcgaacgcccggaagagtacctcggtgcatccggcacgaacgacccgaagcgcgatctcgtgaaggacggacacgcctgcggggcagatgagatcgaggtcgtcccagacctcggcgtccaagagggccgcgacctcgtgaggcacgctcgagctcgccctcgaccggctcccgtcggacgcgtcgaccaccccgccggtgcccgccgagctgttcctttcgccggcgctggggaagatcagccgtgattggttagtggaggcgagcgagagcctgtggacggcgccgcgcagcagggaggcgttccagaccctgacgcgcaggaactcctccaccatgcgcgacgcggcggcgccgacggcgctgtccaggcggcggcgcgcggaggcggcctccgggagcgggaaagggttctccgccgccaggaggagcacctcgtcgaccgccgccaggaggcctctgttggtgtagctcgccccggcgtcccagatgcccgagtcggcgccgggtgagcgagtccactggagcagggcgtgctccgcgagggcgagccgctcctccgcctgcgtcttcggcgcgacggcgacaccgaacgctggcttcccaacggcggcccccatgcttgattgcgagtgcgaggacccgagtccgctgcgcgttgcggcgttgccgtgtgtgattcaatatccgagaaggagatactggagaggttaactagcattactgagttttcaggtcgcctagtgcagacggacggaggtagacaccaaaaagtaggtaacaacaccgaacttgactctccctgcccccggtgtcaactccgcatgtgctgtttagttcggatgagatctcttggcgcggataatggttacaagttataattatattgaatagtagtatctagtatatttgaatgaatttaaccaaataaaagtattattatctgttaccctatataatctatttacgttatgttttgggtgagccaaacaccaccttatttttttttaaagatcgcctcgcgtcccggctcatccccgccgtgttcaggctgattggatttgaagatccccgccgtgntcaggctgattggatttgaagtcgaggttgtcggctttgccctaattaaccagacgcatgacaaacgcagacaatctgctccaatccacctcaatacatacagatttag

SEQ ID NO: 24774 - DNA, 2769 bp, Zea mays
tctctcttcaagatttgttggagccagtcttgacattatttttattttttttcaggaagaacaggcttctgtgagggagataaagtgggacgcttttaggaagtactcggaggatcgtctggaagctgagcagcagcgtgctgaggagctggaactacaagtagcagctcttaaacaacagctccaagaagctgagatccattataagcaaaaggtgtttttctctctgaggtttctcatttttgggctctgtgctaattcacctgtttcctgttggacctaatagagattgtggttgtgtacccaagatcatttagatatgcctataggttctgaggaaaacggacattttcttgcggcaactagatggcatactaaactctattacacatgatgttttacttggacactttagtatttcttgtatcactggaatttttaaagtggatgtttcttcttttgacaggaagaacaagtttctctaagggaggttcaatgggaagcggatcaaaaccattccctggatgagcttaacgctcagcgtcagtatgccacggacttggagaaacaaatcgaagatctgacacagaagttaacatcagctgatgcacactacaagcagaaggtaaacattacccttgcagcaatatttttagaagtgaaaaacacacacaccatcatatagatgatcagcaaatattaaaaataacatggtggagttttgcaagcctgcaggtcgccttgtgtggtcctgctaatacaggccgtccttgtgttattggaatttccaacttgattaaaaccgcatgatgcatttgctagttttcccagctgttttttctcgtgttgaatttctccgagttctccaggtgacagaagagagggacaaacttgccgaggtcaccaaagagttgagcgagtcgaagatctgacacagaagttaacatcagctgatgcacactacaagcagaaggtgacagaagagagggacaaacttgttgaggtcaccaaagagttgagcgagttgacacaaaaagtaagcgagagtgttgaattggagaggaaggtgcaggaccttgagcagaagctgcagctagcttattccaagtctgacgaacaggcagtggatactgtggagtcgagatcccgtgaattcagcctggattcatcaacgagttcaggcaagcagcaagacaaaactcaggctgtctcaccaaacccaaccctgcaaggagtgcaagaaccttccggcatcatggccttcaagttcatcctgggagttgccctgctgtctgtcctaatcggcgtgtttcttgggaagcggtactagcgctcaggtcgtgctgaaagggctcagccagcggcaagtttgaaaggattggtggccttgatggtaatggttcgacgactttctgggagaagggctcatcggcgtgtttctttttgccgtaattttcacttttcgggtaagggggggccaaggaatttgatttttgatcattcctaccctttcatgcaaatggccaactgcatgcgactggttttgcctacagcaagtttccgtatacatttcttgtccgtaaagatcacaagtccagcgacgaaacatgaagcatttgctactatatgtctgtctatatgctcgtatggagagagtgcaagttttgctaccttgtacagattccaccaatccagtgcttttgattattcagattatttactttttcagcaggcatttgttgtttgcaaactgcaacgcctacccagactcccagaggtcggtgctgcactgtatgcataggcagttgaccccatcatcaacctacaaagacgagctagtttcagaagtaacctaaacatcaatctaaccatagcaacatatttagtgtaaaaataattaggacgctaacatgctaataggacgccgtccttagataagatctgatggagatgttagcatgatagaggacaattaatctacaggcaggcctgaaattaaacgagattcttggtggattcgctacagcgtccatctaaagaagtggtagtacttgcaatttccataatggcattcgaatgaaatctactatgcgcataaaaaaaacagggtctaattgatttctcccagattggtgctgcatcccctgccctgcttctgtgcgcgatgcgctcgccgtgtcgcgacactgcagtgccgatggaacgcctcgatcgggctggccgccggtcaggtcaagtccgtgaaccagcagcagaacgccacagagcctgctgcaaccgcgtggaagaaggccagccgctagcgcctctacctcacacgccgccgtggcccagccggaagccttcggcgagcgcggtatcgcccgccgccgccgggctgctgacggcggcgccgacaatgacagacccgcttgccgcgctccaacttgcgccgacaatgcgagaagcctgggcctacttcttcgtaattttatgttgcccctctggcccgtctgggccgtaagcgacagggcctgctcaagcatccacgcccggttcgcggagcccacccgtgaaggtagggatgaaaacggtacggaaaaatctcgtaccgtcccgttccgattaccggtttttcggatcgttttcgtatacttcggttacttttcggtttcgggacgaaaatggatagattgtcttcggtaacggtatcaaaaacgggtagaccgttcgtttttgcggttaccgttttggttccgaaaaatcccgtttttcatacccgttaggcta

SEQ ID NO: 24775 - DNA, 2410 bp, Zea mays
  misc_feature (12)..(12): n is a, c, g, or t
  misc_feature (27)..(27): n is a, c, g, or t
cccacgcgtccngagccttgaacaggnaaatcgatgctaagttggtcctcggtgtcgacctgcaggagaagtgcagttctataaattctgagaaagaagaagttgctgagaagctgtctattcatgagagaaagttagagcatttgacagaagaacactcaagaggtttggaactccgatctgtagttgaatctaggaatgaagaaattgagagtcaactgcgtgaagttcttgaaaaggtagcccaaaaagaagctgaagctacaggtttgacagagaagctggctttgctcgaagctgagaatgaaaagttgactggtgtgaacgagacattaaaagacgaagtggatgctaagctggccatgtttgatgagcttcaggaacggtttagctctactcatgctgagaaggaagaagttgcagagaagctagctgttcatgagaggacaatctcacacctgacagaggaacacacaagaaccttggagctccattctgtagctgaatcaaagaacggagaaattgaagctcagctccgtgaggctcttgagacaatagcacagaaagaaggtgaagctaaagaattgtgtaagaagctggatgcccttgaaattgagttgggatattatgaggagcaggcaactgaagctgctgctgctgaagagaatcataaggttaaatttgatgaagcttcacagaagataaaaatcttggaggaacaacttgcagagacacagagcaagttggagcatttccttatagagaaggaaagcttgactcaaacaaatagtactttgaatgaggagttggaagtacatcagaacaagttgaacgatttacaacttgcacttgctgctgcagtagcagaaaaggaggaggcatctgaagagattcattcgctgcataaaacgctcgatggaatgatcgagcacaaagcagaattagaaatacaggtatcttctactatacaagagcatgaagaactgaagagcaagtaccaaaatacaatggaagagaaacatgcgttgagtgataaatatgaaaccgcaaagaaagagctcgaggatgcaatagccaagttggaggaggaaatgaatgtagacaagtcagaaaaagagtctcacatctcaaaactggagcgacagattacattatctgagataaagtacatggaggagataaagaccatgcaagtggagacaactgaaaagaatgaagcactaacagccaagatgcaggaacacacagacctacagcatgagaaagatgagttggaacaacagttgctggaagtgaggaaggaactggatggtgcctaccacaccatagcaaatcaggaagaacaggcttctgtgagggagataaagtgggacgcttttaggaagtacacggaggatcgtctggaagctgagcagcagcgtgctgaggagctggaactacaagtagcagctcttaaacaacagctccaagaagctgagatccattataagcaaaaggaagaacaagtttctctaagggaggttcaatgggaagcggatcaaaaccattcgctggatgagcttaacgctcagcgtcagtatgccacagacttggagaaacaaatcgaagatctgacacagaagttaacatcagctgatgcacactacaagcagaaggtgacagaagagagggacaaacttgttgaggtcaccaaagagttgagcgagttgacacaaaaagtaagcgagagtgttgaattggagaggaaggtgcaggaccttgagcagaagctgcagctagcttattccaagtctgacgaacaggcagtggatactgtggagtcgagatcccgtgaattcagcctggattcatcaacgagttcaggcaagcagcaagacaaaactcaggctgtctcaccaaacccaaccctgcaaggagtgcaagaaccttccggcatcatggccttcaagttcatcctgggagttgccctgctgtctgtcctaatcggcgtgtttcttgggaagcggtactagcgctcaggtcgtgctgaaagggctcagccagcggcaagtttgaaaggattggtggccttgatggtaatggttcgacgacttcctgggagaagggctcatcggcgtgtttctttttgccgtaattttcacttttcgggtaagggtagggggccaaggaatttgatttttgatcattcctaccctttcatgcaaatggccaactgcatgcgactggttttgcctacagcaagtttccgtatacatttcttgtccgtaaagatcacaagtccagcgacgaaacatgaagcatttgctactatatgtctgtctatatgctcgtatggagagagtgcaagttttgctaccttgtacagattccaccaatccagtgcttttgatgattcagattctttactttt

SEQ ID NO: 24776 - DNA, 1786 bp, Zea mays
tgcagatattctaacagcgaggaagaagacctaaaaaactggctgccctgattaacagcctctgaaccagtggttgacagccttccaactagaggacctgccgcacgctcaacagataatggcgccagaacaaaagacacgttggaaagttatgcgtgaccactaagaattgacaaggactatcctatccaggcattcagcagcagtcacaacgggagtgctcctaatcagccaaacataaaaaagctttgatggcatggttcatcacgtggcaacaaaacgtggaacaaagtcatagaggatctcttcccctgaacaaaacaggtacataagtttgtaaaagctttctacagtagaatatatgagaatatgattggcaatgcagtatctgttcttattcagggtaggaaaaatgtaatattaagcagtggtctctcttttttacaacatccaataatctgcagaaagagaacatgggattatgtatacttttctctcgattattaacagaagggtgcactatttcctcagaaaagaagcaaagaattcttgttgggcaacaatatgagagaggaaacgttatcccatgggttgtcaaactcaatatgtcacaataaatgaaggttctgattgaaggtaccactcaattttgaactgctgatagaaagttaggtaccatgatctcgagtagccctttcggattgtccacatgaacccagtggccagagttagggagaacgtgaagtgacacttttcctacatcaggcttggactctctcccggctaatgcttttagcctttgaacgtcatcagggacccatcgatcactgtgctctgcttgcactattgcaatctccaaatccttaggtgggtgttccagcaccgaccaatagtccctttccctataagaactaaacatgtctatggcagcctgaagattgaaagcccaggtcacatgatcgttgtccttcttcaagttactgccgatccattctgaaagagacttcgaaaatccaaggctgagcatgtggtcgacaacccacttgcgtgatggaagtgaagaaggaagactcgctagcgtttgcaaaacctgttcaacttcaccatcactgttctctgtttctacttgtccagggacagaatcaaggacccagagctgtttgggaagattagcagaatctccatacacaccgcgagagcagctctccgcgaaatctagagcgacttttccacccatggagtgacccacaacaacatccggccatggccaaccacgggccttcactaaatcagcgaggtccttggcggcagtagatatgttgtggggtgggccgagccccttgatcccagccgatctgccatggttcctcaagtccacgagaaccatcctccactcgtctgaaggggagcggttacggagttcggagacgagggcgcgagagaaggagcgccagttgcggccggaaccgaggaggccgtgcaggacgaaggcagtggcggtagccggcttctccggcgacagctggatctcgtcgaaagcgagggtttcggtctggtggggggcgtccgagtggacaggtgaggagaggaggagacgccacggacacagagaacaccccgaggagaacgagaggaggcgcgagcggagggaggacgaggcccgcagagacgccgccatggccgatcgcgtcgcgagagccctgtccgaagccgcggcaccgttgcgaagcagcagcgaaggtttagacaaggccgtcttgtttccccggcccggccggcctcgagg

SEQ ID NO: 24777 - DNA, 789 bp, Zea mays
ggaactacaagtagcagctcttaaacaacagctccaagaagctgagatccattataagcaaaaggaagaacaagtttctctaagggaggttcaatgggaagcggatcaaaaccattcgctggatgagcttaacgctcagcgtcagtatgccacagacttggagaaacaaatcgaagatctgacacagaagttaacatcagctgatgcacactacaagcagaaggtgacagaagagagggacaaacttgttgaggtcaccaaagagttgagcgagttgacacaaaaagtaagcgagagtgttgaattggagaggaaggtgcaggaccttgagcagaagctgcagctagcttattccaagtctgacgaacaggcagtggatactgtggagtcgagatcccgtgaattcagcctggattcatcaacgagttcaggcaagcagcaagacaaaactcaggctgtctcaccaaacccaaccctgcaaggagtgcaagaaccttccggcatcatggccttcaagttcatcctgggagttgccctgctgtctgtcctaatcggcgtgtttcttgggaagcggtactagcgctcaggtcgtgctgacagggctcagccagcggcaagtttgaaaggattggtggccttgatggtaatggttcgacgactttctgggagaagggctcatcggcgtgtttctttttgccgtaattttcacttttcgggtaagggtaggggggccaaggaattggatttttgatcattcctaccctttcatgcaaatggccacctgcatgc

SEQ ID NO: 24778 - DNA, 1305 bp, Zea mays
tctagatcttctcatcataccgataccggcctcaacgccctctctttcccagcctcacaaccagttcctgtttcagtcgatcgcagttagcatggccgcgacacagagctgtcaggctgctgcttgcttcccggccgccgtggcggtcgacgaggagcacggccaccacagccaccagctgaagggaggagcgcatgaggaggctgagaacgacaataagccggagctccggcgtggcccctggaccgtagacgaggacctcaccctcgtcaactacatcgccgacaacggcgagggtcgctggaacaaccccccccgcgccgccgggctgaagcggacgggcaagagctgccggctgcggtggctcaactacctccggcccgacgtgaagcgtggcaacttcagcgccgacgagcagctgctcctccgcgtcctcctcccccccccggccatccggtggtcgaagatagcgcagcacctgccggggaggacggacaacgaggatcaagaactactggaggacccgggtgcagaagcacgccaagcagctcaactgcgacgccaacagcaagcgcttcaaggacgccatgcgctacctctggatgccgcacctcgccgacgacgtcgataccatcgctgcggccaacgacgacgacgaagaccaccaccaccacctacgcctcctcgtcctgcaccaccaccaggcccagcacctgcagcaagctgctgccgcggccggcggcgctgccaacgaccttgctgcgggcgcctacgacgtccgccagctgcacgcgctgccgtcgtcgggcatggcggcgacgtcgtcgtccgactcgctcgcgtcggagtcgtacgatgacgggggcctgcttttcgcgaacttgcgcgccggcgagatgctgatggacggcggagattgggcggcgcagcaggaggccgaccaagggctgtggccgccgccgccgccgacgcgtctgatcttgatcagtcggtggtgcaggctgctggtgccggcgctggccagtttcaggacatggagctcagtggttgggtgcaaggcttctccgagagcattacagataacttttgggccttggaggaaatttggaagatgcaatgagcgagcaattttacatcttacacatccatccaaattaaagacaacatagatacacatatacataccatatattctaacaacaggtgccatatacgatatacatacacaagttgttgtatagttgtattccgcttatatatatattttttttgcctctcaatgaagttcattcttatagaggttgg

SEQ ID NO: 24779 - DNA, 1445 bp, Zea mays
agactaataaattccctcacatgctttactctctcctcgcatcttagcctataaaaggactggggaattccaggccggctcgtgataactgatcatcttctctagatcttctcatcataccgataccggcctcaacgccctctttttcccagcctcacaaccaattcctgtttcagtcgatcgcagttagcatggccacgacacagagctgtcagagcaggagcagcgcctgcagcaaggctgctgcttgcttcccggccgccgtagcggtcgacgaggagcacggccaccacagccaccagctgaagggaggagcgcaggaggaggctgagaacgacaataataagccggagctccggcgtggcccctggacggtagacgaggacctcaccctcgtcaactacatcgccgacaacggcgagggtcgctggaacaacctcgcccgcgccgccgggctgaagcggacgggcaagagctgccggctgcggtggctcaactacctccggcccgacgtgaagcgtggcaacttcagcgccgacgagcagctgctcatcctcgacctccacacccgctggggcaaccgatggtcgaagatagcgcagcacctgcctggaaggacggacaacgagatcaagaactactggaggacccgggtgcagaagcacgccaagcagatcaactgcgacgccaacagcaagcgcttcaaggacgccatgcgctacctctggatgccgcacctcgccgacgacgtcgataccatcgctgcggccaacgacgacgacgaagaccaccaccaccacctacgcctcctcgtcctgcaccaccaccaggcccagcacctgcagcaagctgctgccgcggccggcggcgctgccaacgaccttgctgcgggcgcctacgacgtccgccagctgcacgcgctgccctcgtcaggcatggcggcggtgccgacgacggcgacgacgtcgtcgtccgactcgctcgcgtcggagtcgtacgatgacgggggcctgcttttcgcgaacttgcgcgccggcgagatgctgatggacggcggagattgggcggcgcagcaggaggccgaccaagggctgtggccgccgccgccgccgacgtctgatcttgatcagtcggtggtgcaggctgctggtgccggcgctggccagtttcaggacatggagctcagtggttgggtgcaaggcttctccgagagcattacagataacttttgggccttggaggaaatttggaagatgcaatgagcgagcaattttacatcttacacatccatccaaattaaagacaacatagatacacatatacataccatatattctaacaacaggtgccatatacgatatacatacacaagttgttgtatagttgtattccgcttatatatatataatttttgcctctcgaaaaaaaaaaaaaaaaaagcggcc

SEQ ID NO: 24780 - DNA, 2241 bp, Zea mays
gcgcaaacagaaaatcagtcttttttttttttttttggccacagaatccagggggtccccctacaaacctggcacacctgttacagtacagcagcagaacacggaaactcttcagcaggtaaaattcaagatcagcccgaaaatttctacaagaaactggagcgcagcatttgtgcacttatagcgtaaataaaataagacaccctggctcagattaagttgtgatacaagtccacccactggttgctagttgctaccagtctctggagagttacagaagcaaaaggtcaagcctaagtcggatcagtttctccgctccatcttgaagtgtacaccagaggagaaatcggatccggaacagtggcttgcaggacctgttgttttgactcgaagcaagaccaccagaagaaggtagctgatccacggaaaaaagaatcagcagattcggcttcagatagcttccaactaatgaagcaaattccgcagcatcccatctctgatgtcttgctactacgtactaaggatctgaacagcagaagccaagacagactagcctgtcactcgtcgcatctttataagggacctgaaactagctgcgcaggttcacggattagcttggttgtcgagaagcaaaagctgcttagcttcatcgacatgaatctggacggcctcaaggtctgctgccaccttttcaccaacgggcagcgtgggttcatccagactgcaagcggttaggcttcttctatcttgcagaagctcacccagctcccggatcgcttggttcagcttcgactgaagttcatccatgtccctggcttgatactgcaaggactcactgcacaccttgatctcttcctccttcaagttgacttggaaaacacagtcttggtaatcgaccagcaatgcctccatatcctttgcgctaccctcccaaatctctgctaaagtgttgtcacggacaaacttctcaatgtcagtttccagtatggagatgcaggaatcctctatttctgcttcaaggactgcaatctcacgatcaatataatcacactcattcatgcttcttatttccttatgtaccatggagccccacgcgcccgccttctgtagttcacacagaagcttcatccgatcctcctcagatttcagcaggtcggttgccttgccatagttcttgggtttatgcattagtgtagtggaagtatccaggttatcaatagcaaacaggaccttttcttcctcctttctttgagcttcatgagcgcgaagtttcgctttaaggccatcaattttgcttttcaactcagtttcagattcacgtgctctcgttcttgcagcagatagttcgattttgcgagtttggagatgattcaactgttctttcttctgattcattgatccaaagctggcatcgaacttggactccgcaagacttttggtcttcaaaaccaagttccaacatgatgctgcaggcaagaaatacttgccttcaaaagcatttttcttcttctgtgattctgatagcacagacttcaggaaagtgatttcttcctgaccacgctgcgcacctagacgctgaagctcaattcttgcagaaagttcttcggccttaccactagctatttcgagtgccttaaaatattttactgcatcctgagcagacacaaccttatcttggacaagctccaacttactccgaacaatctgcagcacttctttcaaagctgcaattgtggagtcatgaatatgtttcacttcaggattctcagctgcttcactcatttcgacatctttctcgtccaactgaatatgttttacagcttcagagtcgctttgctctaaaattttccgtttgaattcatctctttcctgcatagctttctcatacaaccccataagtctatcattttcctcatgcatctcctccagctgaagacgcaattcaacagatgtaactcttgagaaattgtcctcattggtgcatttttcgtctactatcttagactcctgtgccacactggatgagttatgtgcatggaaatctgatgtggctgctggttgggcattcaacagatcatctacagggtttccatcttgatttgcctcaacattgacaacagtgtgttcatagagctcaaccaatctcttgttatcctcaatcaaaaccttaagctgcagcctcaattcttcattctctttggccaaaccgatagcagtttcatgagcttctgcctcccgttg

SEQ ID NO: 24781 - DNA, 3762 bp, Zea mays
tctggttccgcatgcctggtcctggtgtcgtacgctcgtcgggccctgcgttctctaccgaaagaaaccttttcaccggggcgcttggttggtcactccgctgccttttccggttgatgatcccggcggagactccaggctccagtagcaggccaacgttgagcaggccagcaggggctcgacgttgccgacttgccggagaatctcgttaagctgccgccattcagtttggtcacaatcaagctgtatgtatgcatgtacgtaaactttgaaacttgccgggcacgaccacgagtatataaagcggtaagccggagccagagattccaaatcacagacagtacggattttttttttttttttcccaaacaaaaagctttatttgacatgacagcaaagcagagttacagcgaaggggtcggtgacacagagaggaagggaccagaccataatacttgctgatcccctcctccagtcctcctgaaccttacacaaccaagcgctcgacaaaacggcacaagcttacacaacacactgatcaaacaacagaaacttaagactaaccagcatcaccaaccgcagtcccggaggctcttccttaaaaaacagcagtaacctcctgacagcagccactgaaacccaaacaaaacgagaccagaaagcagcaagactgaccgtggacggatggatggaccagcgcgtgctctaatatggcaaccgatccatctgaccaacagacaccccacaaatacttcaaacacggaggagagattcacgagagcttctttgtaaatatttggccctctgccagccctctaccgcgtgcactaaaatgagcacatgatagcagcagaggagcgagggcatcgggcaggccgcgggcggaagtgagaacgcgcggcgcggctcttcttatacttctggggaccggccgtttcacttgttgtcgtcggcgtcgacggaggccgggagaccctcctcgccgtcgccgcggctattcttgacgaggcccgcggccatggcggagacagcagcgacgacgtccttgaggatcttctccttgatctggcccctccgcggcggcggcggcaggcccgccctgctgccgcctctggtggcggcgcgcccagctactgccggcatggccggcgccggaacctggatggtctcggtggccatcagcgaggcagctggggactgggtggtggacgacaagaggaggagaggggacactgttggatttgattgcacaggacaggatcacaggagccggcactccagctgcctaaaataggcggcccggcggccgagctggcaccctcgcgttcgccgggcagaacggagcaaggagaaaagcgctagggcgggcgacttgtggggcccaaagtgcgcgtgagaggggcccgccaccagggaatcggacgaaccacgagtagtttcggttttagttttgggggaagcccgtgtgaatgacaagtagggacagccacttctagtggcccagcacagaacgccgatattcaacatggtcggtccgtgggcccgtgcggccgtgccttttgacgtcgctagtagttcagcagtggatagctatcctatcctcccccagcacagcacttgtgctggtgccactgatgctgctaaatgttgcattatttagtagagcttcatcgactacaagggtctggctccagtaaaactttaaggagaagttggccacagcatgacaaacactttaactctagagttataaattatataaagtttttggagttgtagtataatttttttgagtgtctcttttactgctctgaaactccaaaaaaaaaacaacctgtcatggagttttaagttatttcccgccactgctaccggttacgagaaacaatctaactttggaacagatctactctacgcagagttttggagtaaagctgctctaggtgaaggagagccatattaaatacgtcctaaatttataaaaggagacgaggataaaattttatagcgaaaactaccggatctaacgtgtattcaatccacaaaaaacggtatatgcactctcaattttttttttttttttttttgttgaacttgaagaggtctttcaccagatcctccaaatctgatggagttgaaaacaaaattacacaccgtatcaccgattatataaaaaacgattcacagtactagctgtatggctggcatacaccatctgtggcatgtcttccttccttcttggttaaggatatacatcatacattactaatgcgtttacgtagcctctagatgagtcgcgaatcatccatctctgggtcccattgcctcaagcaccaggtacagcgttgcatgcgtgacgtcactaggaggacgtcgtccactcatcacgcattcacgctatagccacgagcccacgagccaatcgcgcaagccgtttgtttggctttgacccggttcgctgactcgttccaatttctctccagtctgatccggcgtgcgcctacaatcccatcccgacgagcgactacccagggcggccccgtctccgcttgcctccctcgcagtcgcagcttgctgtcaggcaaggcaaagggtcacgaaaccgaacggcttatccattccagcttatcgaccggatacataataatcgctaatcagcgtcggccgataacgctggtacacctgttttcgatttttaattttaagaaagtttgtagatttttaaaacttttgttgccaattcttgtataaaaaaactgtgtattatttgaagactcactgttgtaaccaaaatttaaaatgggcaacggatggaagtttaagaaaaaaatatataaacaaataaaaattgatgtatcagctagggttgctgattagccgctcctcgaagccgataaaccgttgtgtgggactgattaaccggtggtcgagtaggagctagagtttcttttgactagaaagcttttcaaaataccactgttacttacttacttgcaatataggctaacaatacttgtaataatagatcatgttattgctattttcaggaatgttggatcaaatcgatttttttcgattaggatgttctaggtaatggtctcgtgctttaagtgcaagtattgcaagaaacagtggatagtaaatataggaaaccatggacgtgatgatagaaattggttcagagtatgtggtccagattatcattgacaatggagcgaactacaaaaggacatgtcatatggtagtcgtgaagcatccttctattgtgcgacagtcgtgtgtggcttataccataaatttgatgttcaaggagaatgatttattttagcataatattgtggttcaaagtgctaggcggatatcacgatttctttacaatcataacaagttacattccatgatgaaggaggtaatcgatgaggagttggttctgtggaatgtcaccagatttgaaatgacttatgtggagcagggtattagttgctcacatcgaaagattataatatggcacaagatcagtggaacacgcacccgcgggaatgatctttaccagagggtgcattgtatcttcgatattatttgtgaactatgaaagcgtgatatgtaatattttaactgctaaatgtattggacttgtggtaacattcaagccattttttattcaattcaattgttgtgatctaaacgcgcttttacttgcaaaaacaagaggtttagtttcacctgatctgctgttggtttatcagttctggaccgattaac

SEQ ID NO: 24782 - DNA, 7398 bp, Zea mays
ctaaaagaaactaaaacatattggattcccaccggttatactaaattatttataaaaaaaagttatggcataccttataaaaaatcctagctacgccactgttttgcgagatgggaaaggtatgtttttttatattattggtgaaactattttctgaattgtgctatccccggtctacaaaattgctggcccaagcacgagtagggccgagctcctaagtacacgttagtaaccgaaccgaacctgggccttcaaactcaaaaggatccggccaaaaacaggccgggccaaattttcacaggatgtaaaaggagcctagacggaaaaaagggccgggctcagtttatatggggcgtaaaagggcctaaacgttcggcctacagactgaaaggaactgttacgcgacagccgtccaggtacaaaccatcaccaaacatatcgccagctaacctgggattcttctggattgaccgcccccttgaaacgacgccagcagagcaccgacacgacacccgagggcgctcgtgcacacacaacttacaagaacaagaatagacttgtccattccacacatttctcccaaccaacaagcccgtgtcgccatcgccatcgccatccaaccgaaccccgaggcgagctttgaccgggggaaggggaaccccgcaaaaacaaagcgagataaaaacgccgtcccgggaacacaaacgccacgaaagccggcacgggagaaagtgccggcgggtttcgctggccgtggccggccaacgggtcaaactaaacagacgtgacaagactagacgaggccaaacggacccgagtttggcctaaaatactactactagtactactcccggagggcagagccgcagaggcagagacaggccagctttgggatcacaccggcgctcgcttttcgtagcggttgattgtccttgtgtgtgcgcttggttggcacgggcgggcactgaaagcaaggggggtttcgcatcgtttgctgcgtagcggaaaatctggatgggctcgggctggcctcgttcggggttcttggttcggacgcgtagtcgcgtacacacgtgaggctggcggttcagatttcagaatactgtacgtacgtatgagctgagcaatcaggcggcgtcgccagctcttcctccatcgtctcgttttccttgcgctcctgcccgggagaagctgacatttcaatcaaaaaggcgaaaggagagcacactctgtcagcgggggggccccggtggttcccgcgcaggcgcagcgctgacgtgctgtcgtcgccgcgggatcgccacgcacggacgggaaccatttcctccgttctcaccgttccgttgatctcctccgcagcgcgcataaacaaatggcacctgcaataatggaacgcgtggtagggccgtgggcccgtggctctaacacaacaagataggccggcaggcgaccgaggcctggcgggaccgcatgcagcagggcggcatggtgcagtgtgccacgccgtgcccaccgcgacgggggcgcgggagggagacgccgagacgctctgacttccattaaccgcgctgacttatgagggtgccgcgccgcgcgctgtcgtcgctgcgtctccgcgccagcgccagcgccatcactcacgggtcacggccgcggcgaggacacagcggcacgacagcggctgcctctgacaccgcagtggcagccgggttttgcgtatgcatgcgtggtcacgtcgcagagcccgaggtgtggatgccgtcgacacgtcgagcgaatacgtacgcaaacgtcgtttgagcacataaacgaggtgcatgcgtggccacataaacgcccgtcgtttgagcactggactgccggacgagtagtgggctgcctctgcctgcctgcctgcctgcctcgcactcgcattgccatgccagcatgacacagcagcatgcacggctcatgaaatcgtgcgccaggccccagctacctgctactctcaatcgcagcactgtgcgatggcgcagcagcagctaggcagacagacacagctacagctcagacgctgcgcccctcgctctgctagctctggcgctctgcccgtctgccgcgtcgcgcgtcgccatgccgcgctgccgtccatacaacacaattttactggatcgttacgtcacacatgcatgcgtttgcttgcttgccgccatgtttaaagcgtgctatagcacttgtcgacttctaccggcagcagcggttggtgcagggtggtacgagtagcagactgtgttctcggttgcagctttagttgcgattcttacacggaacgagcctggagagtgtcatcggttgcattgcattgcattgtcggtatggtctttctgctttcgaaacgggccaggatgaacatgcgacgttgagtcaccagatgctcacgcctccattcccattttttcttttccgacaagcaaccgtaatcataggcacatctgaaattagtaggcgaaaagggatggccagaaaggtggcacggtgggggaggggtcagtgcgttgtccatgctccgaattccgattgccacacgctctgcaaatccagcaaaaaaaaaaaggcattcccgccaccgatggagaaatgctccgctgtgtggctggctgtgcacttgtacatcgccccggctggcaaatttccgggtgttaatgattttccagacgaccagtctagtggacacgatggttcgttagcaagagttggcccaataatttaatgggattagactgtgtcggccacgcaccggatcggatgcacttactactagtatgtatagcagtatgactgccagccaaatttaaaaaccctgtttttttttcttaagctaatcctacccgtacgcttcgacaggcagtccgagacgactccggcatgcgaaactcgcaagctcccgcggcaccgagagcacggcaacttgcaagcggcggcatcttctaaggtaaaacacacgtgacgttacgtccaccggttgagaggtcgtgcgctggcggagcgaaacgcagggagccagccagctaaggacagcgacgcccaccccggcgagcgagacacggtgcggtgacacacccggacccggcccgggacggtgcggcgagaaggtgcaatgcgaatgcgcgcgcgggagcaacattctttcagtgcaacagcgcagcggcgcacgggacaaacgccccgtgagcgcgaccccggcccgtggccaccggaaataataataataaataataaattctgccgtgcacctggctgcacccgcagcctccctccaacgacaagagctgccagtgtcatccgtacaagctgaaaccatgactggcgacaagagacaagagagcggccggccccccttctgtagcatcagcctgcattgacgacattctagcaagcagttttcatctttcgaccgcgaggcaatcaactgaaagtaacagccgcgcgagcgagtggccaatgcaaggccccacccatggcagtaggatacagacgacggagctcggcgtcagggggggtgcggagtgtggaccaacggcgatatggccagaggagtcgctactctagctaatccaggcactgttgtccggtcggtcttgctagtactagtactagtagtagagccatagaggggatgactggacgagcggcctcggcttgcagggcaggccaaatccgttttcagctaggcaaaccagacatgtcagctatttctccggttgggatagagggcaagcaccctgacacgatgcttttgagtgacctcactcaccatcatcagcacgcacgcagagggatgagggaggcagaggcagaggcagagacaggctaggcaacagccaagtcgcctggagccgtgaggccacggagacggagcgtgtagcgtgggcagcgatctgccgtgatggttttcaaaggccattcatcaagcaccgatgatgagtggtctgtcacagcacaggggtccgccgcaagcgtacgaaaacgccaaacgacgaagtgcatcggaacgaacgaggatacagagaaggaataagttgaacaatagggttaccaccgtacccccacgttgtacagtgattttggatggacacaaaatcgaacagcgaactgcctaatcattttggcatggcattgcctacgacctgccacggcgacatctcccttcggagtacagagctgtaacggaacgataatttctctttgtttggttcaaaagagacggaatgactacttttttatttggttttaagacaaaaaaaaaacaatgagatcaaccatatgacatacggggccccacctctctaagcgacgaggagggccgctgggggcttgactgccggagttcccccgcgctcgccttgcgcgatggtgggcgtgggccagaccgccagaggttgcccgcgcggcagcagggcccaagctccccccacgctcgcccgcgtggcggccagccggagatcacccgcacggcggggggctgaagctcccccgtgcggccactcaacctcgccgacggccaccttttctcctccctcactgcggttgctgtctcctcttcacgcgaagaagctcgtggcccaggtctcaagcgaatatttattctacttgggacgttcgtgaccgtgactcttggtgtctcttgtccaaatccaaacatcaacaacaacaaaaaattcatcctatgctgttcctgtaaccaaacactagctacttggctagtcagtactcgcggctggaattggttcactgctcctcacttagcttcctaggttgtcgctcccagcatcggttaatatcgtgatcctccgtgccgacttgacgaaatcgctgaaacggcagagcaattgttcataataagctcgtacggtcattcacgctgcgtcagcggcaggcatccggttcctccgggccgccttggcgagttccctgaagggctcgtcgccggcgtgcctcacttcaccggtggcgccgcggtacagcacgcggctccgcatctccgcgccctcgacgccgaacatctcggacaggcggccgtacagctcgtcgaacgagcccagcgccgacaggtcgaggttgcggccgaccgtgtcggactcgacgaacaccttgcattgtccgggctcaagaccgggctcggaggcctgctggctgctgccgtccccgaaccacggcagcctctccgacgacgtgttcttgccggtcgggctgttctggatgacgccggagcccgagcccgagcccgagccctccgagacattggggcccttctcggcggtccagcacagagagctgttaccagtcgccgctggggaggtggcgccgccggagctgctgaggctcatctgatgctcggttagtatggtccgtccgaagagcaccagccccgccggcttgacggcgacggggttctgcttgctggcaccgacggagagggtacacggtacgccgtcgcgcgccggtgcgcctccgatggtcaggtcggtgctgattcctgacgggatagggatcgtcggaccgacatggtcgggacggcggagcccagggtacagcaggctcgactgcaggtggataaggtggagatctgataaagatggaacaaattgcgcatgcctggctccctgtatggctgcaggagcactgccgtccgggaacgggaagaacgacggtgggtgggcgtgaaggaaattgtggtggtgttgctggccgtgtggcagtgggctgggcgggaacgccgggttaaggagctgcccttcgaaggggaactcggggtacgctgggatgcggggcttcttccgcggcggcgagaaggaggcgaggtggatggccggcatgcttgacaccagctcgaccagccatgggctcacccgcttcacgttctgcagaaggtccggctcgtcccaggtcacctgcagcgcaatcgccaattcaacaagtgagcaccaagcgcaaagcttttgttggtatggtagctgttaagtagcacctctgctgcatacctgaagaaggcgccacggcgactgcggccagcggatggggtcggtgacctggacgccggcgacggtgccctcggtccccctgatcctggaggagtcctcggtctcgaacgccatcttgaaccgcatccctggggaccactgcaccctcatcgccgcgcggaccgcggcggcgcgaacgcagaactcgggcgtgctcgcgcgagggtagtacaccacctcaaacgactgcccggcagccgccagcctcgccgcctcggccacgtcctctggtcgcaccttgccccgtgccttggcagccgcgcaagggctcacattacctcggataaggccggcgtaatgatgccacccgggcgtaggggcctcgtcgcctccgcccccaccagcgccgcagaacccacgctttgcgcgccggatgccgacgtgcaggtccccgctgtcaccgcggaggaacacgatggagtccccggcgatgagcttcttctggttgacaaacgtgctccacccagtggtgagcaggtgccggcgcggcgtgccccggtagatgtggcggaacttccaggcgggcccgtgcacatccttggcgacgacgttctgcacgggcgggtcggcggcgtagtcaagccgcgggaagatggtctccgcgcagtacctcggcacggagaacccgccgccgttgttggcgtcggactgtgtcagcgtcttggcgaacgacgccggcttctcctgctcgtccgccgcggccacatcgtcatcgaggccacccgcgtgcgcctccccgccgcgtagcgggacgaggcggatcctggcgaagacctcgtcggtgtctggatcagccatgtagcgcactgccgtgacgcggcaggggaccagcgccggtacgcgcgccgcggagaggtcggccgcaccgtcgagaccgagcgcgtgctccgcgtgcccctgcgggaagtagcagacgctggcgccaacaagcggcacggtgcacatgctgcccgcgcacgccagccacagttgccggtccacgcaccgctcggcgccggcggcggccggctccgtcaggtccgcaaatgtgatcattgggaacgcgccgatgcgagggccggcggccggtggagtgagagggatacagaggtggaggagacgaactgacgaagacgagcgggtgtcgtgtgtaactgagctacggagctgcgtgttcctcacggtaacgagccggcgccggcccagcccgttgtgactttttataacccgttcggcgactggaagtgggtgggagacaggccgtcaggatgatgtgcggacggtcgtgtaggaaacagcgatgagtaccagtggatcgacgtatgcgtggagctgtgtggaagtttgaggcccgtgaatt

SEQ ID NO: 24783 - DNA, 2342 bp, Zea mays
ccctttggagactccatagctttttgctgtctattcccacgtgctgaacttggtgtctcatatgatgcgatgtttgagaatgaggagtcctatgtgccaagaaaccaaaacagaaaattagtcccgattcaaattaccacatgagaggatatgatacagaacatgctttctcaaaaggaggcctaagtatcaagggatacaaatataatatgactcagttgctcaccatagcttcttgacattcagctccaagatagccactggttgtacggagcctattgtccaagagtaagtaatatgcaacagttgcctgtacataaaagtccagtgatccagtcacaaccattacagtacaaaaagatggatgaagacaacaaaatgcagaagaaataatacctcattttgcagccttttttggattgattccaccaacaggttcttgtcatatcccatacctaaaacctcacggagagtttcctcatcaacctacaaaatgggagcaaattgaaccatatttcttaattaaaccacatgaccagaagaaaaggccccacactcccaaactgtagatccatgactgcaaaactgatcgtattctcaaactatcaacagacacaatacaaaaattattctaaaaaggagttcaaaaatattgtgaatactgcagtgaagttaatgtctagaaaaggattatagaaaacatagtgaggaagatgagatttctttgatgcaatagaagttactaacaatgcaggagcaaaataatggtataaggggcaaggtgtagttatgtttttttaccataatgaggtaaggtaagcatcacacaggggagccctagatgttatcaggtgagggggtcttttttagacaaacatgtagagtgtaaacataggggtgtatttctagttcaacattcttgctagctaaaatgtcgatcatattcatggcgtcaaatggaaaggtgctagaactaaaagatagatactatttagtgatcccaaatcaacaatgttgtcatatttgtccattgagggttaggttcagaattcagatatcacgaggagaaatgtttagtataggcacaatccagagaaatgcagttagtagattatattagctttgtccatatagtacgtcgaatgcagaacatgttatacctttttgacttgttgcgcactatctggaggaggcacagtcaaatagcgcgggagaagaattttgaaccaatcatgttcgcgaatttcacgaatggtgatccgcttcataggatcgacaactagcattcttggaatcaaatcccttgctgcaccagacaaatggctgggaagggtatatattccaccctaaagtgcaagagaaaaggagggagatacagataggctctaaatcagcaggaacatgtaacaatgaacatttctaatgttaaaccgtagatacttgctgacctttattttcttaaaaaggtttggtatgttctcgtcatcaaatggcagagtaccacataaaagagcataaagaataaccccacagctccacacatcaacttcaggtccagcatatagtttaccagatatcacctcaggagcagcataatttgggctaccacaacttgtcttcagaaaatgaccatcccgcataacattacttaagccaaaatctgcaatcttaacattgcattttgaatccaataggaggttttctggctttagatcacgatgcaccaccatgtttctatggcaatattcaacaccggatataatctgttggaagaaacggcgagcctcttcctcctgcagcctacctttctcaacaatgtaatcaaataattccccacacttaacatactccataacaacataaatatcagccggtgtgtctataacctcatagaggcggataatatgtggatgcataaataacctcaatatcttaatctctcttttaactttctcttccatctccatgcctctgattttacggcggttgagaatcttgattgccaccttgtgtccagtgctgatatgctccgcaattttcaccttcccgaatgagccaattccgagagtcttgccaatccgataattcctcaacgggttgccatccttgcctgccccctccatcctctgcctggccgctggaggggaggcagccgcggctagtcgggaggatcgcggcggagatgcggcggagatgcgagaggggtgcgaagcgaggcgtcacgggtcggggcggagccgcggagggggggaagggggaggtcggaggagaaaggaggggaggagattcgattccggcagcggggtccagggccgaaagcgaccaccgcgacgggaggcctc

SEQ ID NO: 24784 - DNA, 2073 bp, Zea mays
ggtaccgggcccccccgccttcttttcttttttttttttggcctgtaagcagcacagcatttaattaaccgttgtaatagctgaaattattaatgtagatagacattatgccagcaaaagcactgatctaattcaccggcagctggccagccgtaaagaattaggagataagttactccacacagtctggttcagaagatcgccgccaggcataacatcttctcatgcctaccatctacatactccagaaaatccaatctactggagattactatttacagctttgtgagcgatttagacattcctctagtgaaacgcaaggaatgcaactgatggaaagctgacaccagaaatcaaagaactctcagttgagttagaaaggccgcgcacaagtccagaaagaggagctgtggcccactgactctttgcaaatcgaggaggtatttctcgtctcttgttttgtacagctgaatttcaaacttaattaaacttaacctctcactcaggctatcagtttcaatggaccctgcactgaagttatgattgttatgaatttgagcaggaaagccaggactccatctgcacttcatgttatagtgacctatctttttccagtaaacatttaattcttgcagagctttcagcacttcagacattatttcttttggatgtgctcgagactgaagaccaagagcccatttcctctcagctggaagatgtggtctcaagccaactggagactccataaatatttgctgtctattcccacgtgctgaacttggtgtttcatatgatgcgatgtttgagaatgaggagtccatagcttcttgacattcagctccaagatagccactggttgtacggagcctattgtccaagagtaagtaatatgcaacagttgcctcattttgcagccttttttggattgattccaccaacaggttcttgtcatatcccatacctaaaacctcacggagagtttcctcatcaacctttttgacttgttgcgcactatctggaggaggcacagtcaaatagcgcgggagaagaattttgaaccaatcatgttcgcgaatttcacgaatggtgatccgcttcataggatcgacaactagcattcttggaatcaaatcccttgctgcaccagacaaatggctgggaagggtatatattccaccctttattttcttaaaaaggtttggtatgttctcgtcatcaaatggcagagtaccacataaaagagcataaagaataaccccacagctccacacatcaacttcaggtccagcatatagtttaccagatatcacctcaggagcagcataatttgggctaccacaacttgtcttcagaaaatgaccatcccgcataacattacttaagccaaaatctgcaatcttaacattgcattttgaatccaataggaggttttctggctttagatcacgatgcaccaccatgtttctatggcaatattcaacaccggatataatctgttggaagaaacggcgagcctcttcctcctgcagcctacctttctcaacaatgtaatcaaataattccccacacttaacatactccataacaacataaatatcagccggtgtgtctataacctcatagaggcggataatatgtggatgcataaataacctcaatatcttaatctctcttttaactttctcttccatctccatgcctctgattttacggcggttgagaatcttgattgccaccttgtgtccagtgctgatatgctccgcaattttcaccttcccgaatgagccaattccgagagtcttgccaatccgataattcctcaacgggttgccatccttgcctgccccctccatcctctgcctggccgctggaggggaggcagccgcggctagtcgggaggatcgcggcggagatgcggcggagatgcgagaggggtgcgaagcgaggcgtcacgggtcggggcggagccgcggagggggggaagggggaggtcggaggagaaaggaggggaggagattcgattccggcagcggggtccagggccgaaagcgaccaccgcgacgggaggcctct

SEQ ID NO: 24785 - DNA, 3603 bp, Zea mays
tgcgctatacattgtctgctgagtcgtgatcgtgtgggcacagtctcactcgctattttctcgatcgagctctcctttcgtcctctctcgccatcgaacctcacaaggaaccaaaccgaagctcgccgtctccacaacaccgccgcattgccggtcaccgtttctccggcagtgcgcgcggcgcggcgcgtacgacgacgacaaccggtggacggacggacggtcgcgctgcgatgcgcggggacgggagggggagccggccggcctggcctggccacgcccacggctgcccagcttgccccccggaaccagccaagccaggggaggggccgcgcgtcgcgcttgcccacgcacccatgcccgcggcccgccatgtcgctggcgcaggcaggctccggcgctgctggagtgctggctgctggacgtagctgcgctagccgatcgatcagatccgacccccaacaccgcacacagctggtgtgttagattctaccatgcaagtggagggtcggatccgttacccgtttttaggggaaacaacgagggtctcccttgctgagatatagggtttaggatgttgttaagggtctgttcagttgcaagcattgcacggagatcttgaaattactgatatgcttgtgaagacaggggtaaatagaagtgctcctcctaagactgtgtgatgagatggacttggagacatatgtttttgttcttggcggcataagagaagagtataagataggtttcctgtagcaacttatcattccagatgtcgaaccagaatgatcccattcctgttgaagtaatcacgggagtcgacgacatcaatcacagcgattccggacactctagcacctaggtagttcggggccctctaggaacgcgggtttagggttttcgacgcgaggattagcgttggcttgagtcctgctagctcctaatgtgcatgatgaattggaggctgtaacgataaggttaggtgccctcggataaagaaacagttaaggcaatgttcagttactagtggtttgagggggattgaagggattaaatcctctcctatttaaaattgaatatgaggggatttaatacttttcaatcccctctaatactctagcaaccgaataagccctaaatggttagaattaactatactccgattcctgttaaccggctcagaagacacacctaataacagtgtctactggctactgtgcctgcctctgctgcgctgcgccgatgcgctcaccgttccgtggggcttgctcagttggtcggccagctgccccgcccgtgctccggccgcctccaaaacttcgcctcgttcgccgcgttgtcctgctccgctgctccctggctgcactgtgcactgtaccacgcatggcgattagttggcaacactacgaatgcaaaaatgtacgtgcgtatgtaccgtacggcatcctacacccacatgtcgcggcgcacgtacaaactcgaggatcggccgggcccatgcatcgtacgtagtagtatgctacgtatcgaatgaggcagcgtaaaacagctgcagcagacctacggtgtactaagatagaacgagctaaactaacccgctaacgaatccaaccacggcccgcccgtccgtccgtggtctatatattgcgtacccccaacacaccccttcgttccagcacgtactcaccgcacccccagacggcccgacacgtccgtccgtgctggcttgtacttgcacaccacaccacaccagcacccagcctccccaacgatgacggcggcggcggcaccggcggtcgctagcagggtgtgggagtgggaagggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggcgagccggcgcccgactgggcgcacgagacgctgctggagcacgacgccgagcgccgcttcttccgctacgagatgaacgacaacaacatgggcttcggcctcttcttcgccacgttccgcgtcgtcccggccgccgccggcgggtgcgagctgcgctgggagttcgagtgcgagcccgtgcgcggcacgcccagggacgcgctcgtggcgcgcctgcaggccgggctcgacggcatggcggcgcgcgtgcgtgaccacgtcctcgccgctcgcgccgccgcccctgccgtggtgcccgccggtgcagctggtgagctcgtcgtcgtcaagctcgacagctccatcgccgccgtctgatcaccggccggcgcggcgtcgacggcgatccaacacgtaccaacgaagagaccgccgttcgctggtgctctctcctctgtctgctcacgcgcgccacgctgtcgctgcccatcgtgtttccgtttcctatctcctcgtcgtcgtggtttttagccctttgtctgtgggctgtggctgtgtgctgctgtctcgtctccataatttatccgtccctgcatagattattgtatgcatgtagtataaccgtgtactccactgcttttatcctctcaccctcttgtgcattttattaattaccctgggtacgtgtcctgtactagtattgctgtaccttgcccggaataaaccagcttgatcggctgacttttttcttttcaaaaaaaaaaaaaaaagctgttgctgcaggatgcagcctagcggttgctgggtcttggtccactgttaggtggtgtttaatttttaaagactaatttgcattgtcttattttattttattttactctcctaaattactaaatacagaaactaaaatagagtttttcgtagtattcaataatttagaactaaaaaatagatagctgctgctggcaccacttgagaaaaaagggcggcttacctgtgtagcctaatagactaatgatgtttttttatctaatgactgcgggtgcttttacctgaccgagtgactgtgaatgtcagatccatccgcaggctgtcgattcattcttcagaatcaatcatgcatgcatcctggtactctgctactctaggtagctagcatgtgctcgatcatgtgatgatgacgacgaagaagatctcagatgatcagatccagtcaactgcagacggccggatcgcctgtaataaccaacgaaccatagaaaaaacggcggtcaactagagagatggcgcttcgttatatatgaaacggcatatgcagttgacagttctagtgtctcctggtcctgggtcctgaccaccttgcgtgcatgcaaccggttcacttgtctagacagttttttttaatgtcgacgtaggtttcattgcttgtgcctttggatgcttttacttcagatcatcggcttttccaattacaagagatatttaagaaaactgcatgatatgaaatgtatttaaacccgttacatctcagatgtagttactagttaggctattcacattgcaaagtatcatacttcaatatccaataatgacacataggatacaaaagtatgatactctct

SEQ ID NO: 24786 - DNA, 415 bp, Zea mays
cgtcaagctcgacagctccatcgccgccgtttgatcaccggccggcgtcgacggcgatccaacacgtaccaacgaagagaccgccgtcgttcgctggtgctctctcctctgtctgctcacgcgcgccacgctgtcgctgcccatcgtgtttccgtttcctatctcctcgtcgtcgtggtttttagctctttgtctgtggctgtgtgctgctgtctcgtctccataatttatccgtccctgcatagattattgcatgcatgtagtataaccgtgtactgctttttatcctctcaccctcttgtgcgttttattaattaccctgggtacgtgtcctgtactagtattgctgtaccttgcccggccggaataaaggagcctgatcggcagacttttttctaaaaaaaaaaaagagaaa

SEQ ID NO: 24787 - DNA, 1163 bp, Zea mays
ggtcccgggtccccccctcgcgtcgccccagcgcccggaaaaaggtgaggcccaacacctctgcctcgcaccagtaccacaacgccacgacacgccggcgaggtggacgagcggcggcgatggcgggcggcgaccgggagcgagacgcggacgaggagacgaggaatcagatgatgcagaaccttttcggggaccagtcggaggacgaggacgatgcggacgacgacgacgtcgccgagatggtcgatgaggacgacggccaccagccgcagtcgcccccgcagtcgcccccgcagcgccaccaggagctggacgacgatgcctacgacgatgaggaggaggacgcccgcagccacgcgcccgcccgcgcaagcggataccactccgaggaagtggatggtgaggcagagaatggaggggaaggggaaggcgaaagtgaagggcaagttgtaatcgaagaggaaagtgaaggtgaagctcatggtgccgatcttgatcaaggagaaagtgatggggacaaagtccagagctccccagaaagagaactcgatgaccagaggatggaacctgatgtaagaggaatggacagtgaagatgaaggctaccagcagaggacagtatctggcagaagaaggggagttattgcctccgaatcggagggatctgaagatagttactatgctgctggagctcaagaagacgaggaacctcgccaaacaaggaaacaaagctctccgttggaggaagaaagagatcatgaagtagttcgtgatgtgtttggtgatagcgatgaagatgaaccagctccatatcgtgttcgccatgaaatcgatgaagattctcataggtctcacatggaggatgaaggccattatgagaaggacatgcaaccagatgacgttgtggctgacgaagatatgcgatatgaatctgatgataatcgtgaactgaaaccaaaagagaaaccagtcggtccaccactagacttggtggttccagttaagcaaccaccagctcgacctgacaaaatgaatgtgatcaaggtatcaaacattatggggattgaccctaaaccctttgatccaaaaacatatgtggaagaagatgtttttgctacagatgaatctgggactaagaaaaggatacggctagaggacaatatt

SEQ ID NO: 24788 - DNA, 623 bp, Zea mays
  misc_feature (3)..(3): n is a, c, g, or t
  misc_feature (15)..(15): n is a, c, g, or t
ggnaagagctctagnagaggatgatgagcctggctatgattctcggcgaatgccaggccgtaggcgttttgaggatgaattggaggctgaagcactagctgagaggcgtatctttaacgcgaagaagtcaaatatgagcagaaatgttccccacaaaccaccgtaccctcctgcccgtccaccgagacgtcaagcggatgaatactcggggagtgagagggaggagtcagagtacgaaacggatggtgaggatatcgaacattcaccgcctcgtggaagaagggaggacgagctggatgaggaggaagaatacgaggaagatgttgaagaagaagaagcgcctctgtcggatgaagaaatggaggcaccgaaacgtaagagagaatcagggggtggtgggcaaaggcgcgaggagctggtgtctgaggaggaggacgaggaccacgacgattctccgccaaggaagcagccggctgtttcgcatcgtagaaaggctgtcgtgtttgatgacagcgacgaggactaaaatttgtaaaacgttggtgtgtgtatgacgacctgacatgatacgcttgcttttttttccccatttgtttaagagaatgattagttattttccgctt

SEQ ID NO: 24789 - DNA, 1288 bp, Zea mays
cggtctagtaatccggcgggttgaccccgtccgctttgatccaaaaacgtatgtggaagaagatgtttttgttacagatgaatctgggactaagaaaaggatacggctagaggacaatattgtgcggtggagaaccattaggaatgcagatggcactacatcttgtgaaagcaatgcacgctttgtaaaatggaaggatgggactatgcagcttctgattggcaatgaggttcttgatatatctgtacatgaggcgcatcatgaccagtcccatctgtttttgaggcatgggaagggaattctacaatcacaaggaaggcttttgcacaaaatgcgatttatgccatcctccttgtcttcaaagtcgcatcgcttattaactgctctggttgattctcagaataagaaaactgttaagatgcaaaaatggtttgagactaaggatcctgagaaagcgaaaatggaaaaagaaagggttttgggccaaaatattcgagcccattcaatccttcaacgcaaaagagaaaaagtgaaccgcaagtacacacagcctgcccggccaaggcggcagctttctccagggttcttggaagacgctctagatgaggatgatgagcctggctatgattctcggcgaatgccaggccgtaggcgttttgaggatgaattggaggctgaagcactagctgagaggcgtatcattaacgcgaagaagtcaaatatgagcagaaatgttccccacaaaccaccgtaccctcctgcccgtccaccgagacgtcaagcggatgaatactcggggagtgagagggaggagtcagagtacgaaacggatggcgaggatattgaacattcaccgcctcgtggaagaagggaggacgagctggatgaggaggaagaatacgaggaagatgttgaagaagaagaagcgcctctgtcggatgaagaaatggaggcaccgaaacgtaagagagaatcagggggtggtgggcaaaggcgcgaggagctggtgtctgaggaggacgacgaggaccacgacgattctccgccaaggaagcagccggctgtttcgcatcgtagaaaggctgtcgtgtttgatgacagcgacgaggactaaaatttgtaaaaccgtatgacgacctgacatgatacgcttgctttttctccccatttgtttaagagaatgattagttatttttcgtcatgctggtgtaatatggttgcaattctacctacagaggtgagattgtacatgctttaaaaaaaaaaaaaaaaaaaaactcgagcccgg

SEQ ID NO: 24790 - DNA, 1468 bp, Zea mays
caatgatacatttttttgtaaacaatggctagttgcatttgtttgtaataagttcaattggtttacttatatggttggacttggttttgttttttaatgagatgtaagacattatctattcttgaacaggtacgtgcgttgttatgttgcggctggaataataaaattattcctaattataaaaaacatgctttgtctatgctttgtagttcaaatgattgaaatgataataatgaatgaaagctaatatgtttttcttggaaacaagacatcagagtttttggctatgtatttataggctatgtatctatatatatggatctgctatctttctcggatacgctaattcactatatgtaaagaatttgtatgtcgtcgcatcgtagtagaaataaaatgaggtagttgtgatacttaaaaggaaatgtatattttattaggattatagattttacgagtgatatagggggaactaatacgggaagtgttagtataggtggaaaaatcttggtgatgtgatgcaataagaatatagggaagaaatttagagaaaacaactcaagacagtctggggccgtttttttttttttttgcatcaaaaaaatgaaatactatttttcaccgctgcgaattacagtacgccaagatctgttctttgacgcggtacaattttcgaataacccaatcaaaataggagattacaacaaccggtttagcacaacacatactgattgatccgttgagttctaacttactgttttttctgtttgaattccccgtaaaaaataccaaaaaacgcaataagcagcgagcagagctctgcagctcagcgtcttccgcgctagggcccggcttcgcgctcagaaccatcatcagagtcgtcctcgaattcatcgagatcctcgtcgtcgaagtcgccgtcgaagtcgtcgtcgaagtcgccgtcgaactcgccgtcgctgcccatagcctcgagctcatcctcgtcatcatcctcgtcctcgatcaccgccttccggcccgcaccaccgcctgccgcgtaaccgcgccggaggcgcaaagcagcagcctcggtcgtaggctgcataacaaacctagcattggtagcggtcgccgccaccaccaccggccggagatgggcaagggagacggggcttggagccactgccgccgctgcggcggagaggcggcgcagtgcgagcgcggcggcgcggtgcatagccatcggctttatgaagtgtgaattgagggggcggcggcgcgggcgcgtaaagggaggcggcgtctagggttttggttttggcggaggatttaatggagcgggatgcgcctgctgcaagttgaaggaagtttccagagacacacacaaagagggttcgcactctcggttccccggcccccccccaggccgctcgcccgtcatcgcttttttgtcatctcgatctctacagtatgtccttttcgccgg

SEQ ID NO: 24791 - DNA, 1650 bp, Zea mays
ggaaggtgagatctcctgtctaacagaagtgttgaattttgagcgattctggtactgcagatgctggtacaaaatattccaaaaaggagaggagggtatataacacgcacaaatacaaattgatcatttttttttttttttaatatgaaatactgcatcatattgacaagtgccacaaaaaatatcatactagaatactgatctggtgaccatgtaatgttttacaacatatgaaagaaatgcaaactggttttcactcttgcattctaccctcctagcgggaggagaggtgtgtccactgttcagtagcaatccaccatttcatcctgcaaaaccctgcccaaatctggttctggtcctcataaaccctccccttgtcaccggatcggcctccttggcgctgcagttccagtaagcgcccaccgtccccaggatcggcatgtcatccgggctcgggctcggggacctcgacctcctcggcgttgagctggccgacgatatcttgatgtcctccacggtgaggtccccaaggatcgggcggtcctcccggctgatcggcgagtaggaccggacggagttgctctcgggcgtccccgaggaaccgagccacgtggagaggctggcgtccacggaggcctcctgcttgctcggcgtgctgggggtgtagcccgagaccgccggcctctcctccttcctcttggccgctggtggctcggcgaggaggtcgtccatccggttctcttgccccacagtgacgttctcccctcgtgccggcttgagcgcggcggcagcccggggcttgggttccttccaccgggcgaggttgaggttctctacggagccgagcaccgcgggggcctccgccgctgggggcacgacgggcgccactacctggccgaaggaatccttggatgtcttgccaaacggaagcaggaagagcgactcgcacgcatcctcctcgctgcgtccgatgccgaggaggccgtgctcgtcttcgtcctcgtcgccgtcgatcgcgcactcatcaatcccgtcttcgtcttcctcctcgtcgtcctcgtcgccttcgaactcgtcctcctcggcgtcctcgtagtcgctgtcggtgtcgctgccggcgcagttgctgtacctgtggttcaaggggaaggcctcggacttggcgcactccggcaccagcatccaccccttctccctgctagccccaccaccatcctccggatcggctccctcgccgtcgtcctccgggatcggggccgcctcgaaggtggtgacgttggggtcgaacgtcaccttcttcttcacgacggctaggcacatgccgtccgtggagtccctcaactcgaggagcgtcgctagaagcggcgcggcggcggaggccgcggcctccccatccacatcaaccttcttcggtgtaacccgcggcacagcccgggcgcggccgttgggggactgtgaaggcgaccgcttgcggcggcggcggcgctccttggcccccccgaagcagccaaggaagcagcccatcggggaccgcgagcgacggcgagaggcagcacaaagcgagtgggaggggagcgcggggcagtggtgattagtgattttcaggcggccgctcgggcgggggtccgcccggggggggaaaactggtgt

SEQ ID NO: 24792 - DNA, 752 bp, Zea mays
ctcgtgccggaaatgaaaagagaggaaaggaggaataggggaagactgggttgtcgaggaggccgtgctcgtcttcgtcgtcgtcgatccgacactcatcgagcccgtcttccccttcctcatcctcgtagtcgtcgtcctcctcctcctcctcgtcttcgaattcgtcctcctcggcgtcctcgtagtcgctgacgttgccgctgccggcgaacttgctgtacctgtggttcaaggggaaggcctcggacttggtgcactccgacgcctgcatccaccccttctcgctgctatccccaccatcctccggatcggcttcctcgccgtcgtcctccgggatcggggccgcctcgaatgtggtgacgttggggtcgaatgtcaccttcttcttcacgagggccaggcacatctcgtccgtggagtccctcaactcgaggagcgtcgctagtagcggcgcggcggcggagacggcctccccatccagatcaaccttgttcggcgtaacccgcggcaaggcccgggcacggccgttgggggactgtgagggcgaccgcttgcggcggcggcggcggcgctccttggcccccccgaagcagccaaggaagcagcccatcggccgcggcgagaggcagcagaaagtgtgtgggagtgggagggcagcgcggggaagtggtgactagtgatgaggaggcggcatttgggggagcgggaaggaaaggaaaacacaattggtgggggaacggcacccaatg

SEQ ID NO: 24793 - DNA, 2510 bp, Zea mays
gtggataggaacgattactaaccggattgcttctctaatttatataaactttgattagctggaacgattccgtttgcaatccgacataaacgaacaagtcctaagtctgatacatctttattcattaaccgtcggctgggtcagtgtatgttgcagacttcatatggtttgtatgtgcaagtgtctgaaaaacaaatacgctcgaatcatttgcagattgtagtttgaattgcaagaatgaaggtcggtcgaagtgttgaaattttgagcgattctggtactgcagatgctggtacaaaatattccaaaaaagagagggtatataacacgcacaaatacaaattgatcatattgacaaaagaataatatgaaatactgcatcatattgacaagtgccacaaaaaatatcatactagaatactgatctggtgaccatgtaatgttttacaacatatgaaagaaatgcaaactggttttcactcttgcattctaccctcctagcgggaggagaggtgtgtccactgttcagtagcaatccaccatttcatcctgcaaaaccctgcacatgatttaacatcagaactcagaagattatacctggaagagctggaattgcagtcagattgctgagacaaagttcacctgcccaaatctggttctggtcctcataaaccctccccttgtcaccggatcggcctccttggcgctgcagttccagtaagcgcccaccgtccccaggatcggcatgtcatccgggctcgggctcggggacctcgacctcctcggcgttgagctggccgacgatatcttgatgtcctccacggtgagggccccaaggatcgggcggtcctcccggctgatcggcgagtaggaccggacggagttgctctcgggcgtccccgaggaaccgagccacgtggagaggctggcgtccacggaggcctcctgcttgctcggcgtgctgggggtgtagcccgagaccgccggcctctcctccttcctcttggccgctggtggctcggcgaggaggtcgtccatccggttctcttgccccacagtgacgttctccttgtccgaggacttgagtgcagcggcagcccggggcttgggttccttccaccgggcgaggttgagattctctacggagccgagcaccgcgggggcctccgccgccgggggcacggcgggcgccactacctggccgaaggaatccttggatgtcttgccaaacggaagcaggaagagcgactcgcacgcatcctcctcgctgcgtccgatgccgaggaggccgtgctcgtcttcgtcctcgtcgccgtcgatcgcgcactcatcaatcccgtcttcgtcttcctcctcgtcgtcctcgtcgccttcgaactcgtcctcctcggcgtcctcgtagtcgctgtcggtgtcgctgccggcgcagttgctgtacctgtggttcaaggggaaggcctcggacttggcacactccggcaccagcatccaccccttctccctgctagccccaccatcctccggatcggttccctcgccgtcgtcctccgggatcggggccgcctcgaaggtggtgacgttggggtcgaacgtcaccttcttcttcacgacggctaggcacatgccgtccgtggagtccctgaacaagcacaacacagatacgccggatgaaacgacgagagcggcggctcatctcgccagactgaaactgcagccacccacccacgaacctcaactcgaggagcgtcgctaggagcggcgcggcggcggaggccgcggcctccccatccacatcaaccttcttcggcgtaacccgcggcacagcctgatccgacatcacacgcagattcgatcagatgatccgatccaccaacactagaactcgatcgagcaacgggagaaacaaaacaaatcacggagcgggtcgactcggttacccgggcgcggccgttgggggactgtgaaggcgaccgcttgcggcggcggcggcgctccttggcccccccgaagcagccaaggaagcagcccatcgggaaccgcgagcgacggcgagaggcagcacaaagcgagtgggaggggagcgcggggcagtggtgattagtgatgaggaggcggcatctgggtctgatgagcgggaaggggaggaaaactggtggtggtgggctggtgcctggtggcgatgaagccgttggggaaaaggagacgcgccgcgacccacgactggtaacggtcaagttgacccatctggcaagtgaccgttggacgaacggaaacccgtgtgaggggctcccgccagaaaggaatccgagggccaccatgaaaatgggctgggcctacccctatgtggcccatggttatgcgtgcaccaccaaacaacagcgcaaacgctgagcgtagacctgggcggggtcggtcatccgtctagcagtgttcactcgtccagtcgtgcaagtgcacagaacttctactctgtctttacagccccaagcccccaacaacatctcaaaacg

SEQ ID NO: 24794 - DNA, 1509 bp, Zea mays
tgcatgcctgcagggtgatcctcgaagagctggacatccattgaacttgtaacgttactgctggcctgcgtttcctggaggcgaggaatgtacgctgcacctttcatctccacgccgcacctaccattggcccctacaatccctcccgagcgggcgcaagccaaacgtactacgtcaaggcagaagatgcgtccaatgtgcatgcgctcttagctccgccgccgtccgcaggcgacgtgctgcactgcaccggtggctcagtgagtgagggaacagccactgacagggcccttcagctgggcgcggacggcggacgcaacggccacgcacgccacacgaaggctcacgctggcgacgctggtcgctggctgacgcacgccctcgcgtcgcatcgcgccccgcctaagggcgtccccgggccgcgcgcccggcccgcaagttgccccccttgctccaccccggattcctggtgcagatgcagcgcacggtcgggccgcgcgcccccttgctagcctgccacactcggcgccgcgcctataagtagcgcgcacgcgccggcgccgcgctgcacccccggctcgagctcgcagcgacaggcacaggcagcaaggctggtttccttcctcgtcgaacgtctgccgctgctcgcgatggccggacgcggaggaggtagcaagagtagcctgtacgcggcgctgggcgtggccagcgactgctccgacgccgagctgcgcagcgcctaccgcaagctcgccatgaaatggcacccggacaagtgcgccggcgcagggagctccggcggcggcgcggacgccgccaaggccaggttccagaagatccagggagcgtacgccgtcctgtcggaccccaacaagcggatcctgtatgacgtcggggcctacgacggcgaaggcgacgatgacggcgccggggagatcctcggagacattctcgaggccatgagccaggcaggccctgccgccgacaacggcaagggggagagcctggaggacctgcagcggcagttcgaggagctgttcctgaggccgtcgccgtcgtccttctcgccgaacgacgcagctgggaagtcggcttccaagagtaggcctgctgggaggaaatagacaggacactgcggcgaataggtcggtccagctactcctgttccagataagctacgacctacgaggtaccgatacctggccaggagcccaggacagcgacctgcgacggcgacgaggctgccagtgctgcacgctcaagtacatgctccgagttgtagctactactgtagatcggcacggcagtcgccagaatggtaccataaggcggccgtacgcacacacgcatgaacgctgtttttaccatctcaggttcgctgcaaaatttccagcgtgttctctgtaaaatccctgcatgattgctataaagaaattcttcgtgggtactaataaaaaaaaaaaaaaaaaaaaaaaaaaaaaaaaacccacgcgtccgcccacgcgtccg

SEQ ID NO: 24795 - DNA, 1544 bp, Zea mays
  misc_feature (3)..(3): n is a, c, g, or t
  misc_feature (5)..(6): n is a, c, g, or t
  misc_feature (10)..(13): n is a, c, g, or t
  misc_feature (19)..(30): n is a, c, g, or t
ttntnntttnnnngctccnnnnnnnnnnnngttgacaggatccaagctattgaatgcggtgtccgcaattaacataaaaccaacagtgtcaagatagcaagcacaactaattaattcgagagatacttatctctgcacaccatggcaaaatttaaagcactagagacccatggtactctaataaggaactataaatccaaaacaatggatgaggacatgagaggctatagacaaaggggtatttaacagtgtgaatctagccatgaaatgatgtcgttaatggcagttgaaatccggtcatctggttctccctctaagattgaatggtagctgccttcatagagcttgagggtcttgtccttcgtgctggctttctcataaaggaatttgctgacctgaggatcggttaccatgtctgcggctccgtgaagaatcagcaatggagaggagatcttttccaactgtgattcaatgtccttcgtggcttttaaaagttcaactgctgttcttaatctcatttggtcagaatatgagatggcattgtactcagctactttccttttccttggatctctaaatgccaaatctcctatatctttctgcggaaataacttcgcctcaggaagaagacatgacaatatgctcagtgccttcaatacaggtgcaggtggtgttacatcttctgaaatcttgcacataggtgcgacaagaagcacaccatcccattcttgttgttgcttcaagtgtactttcagggcaactgcacctcccattgactgccccaagagaaagtgtggcagctcacacacttctttcatgcctcttattcgtgcatactgttcaatgacatggtccaccattccatcaaagcttgcaatatagccatggagaccatatgacatgccaaaaccaggataatccatagcataaactgcataaccagcagctgctatcctcttagcaatcccttcaaaaaagaaagtgcaggtatccccatatccatggcagaagaaaagtgcagccttagttgcagtgccctctcttggcagccaactcttccagaatatttcaacgccctttgaattggtctcgtaattctcttccatctggatttcattgtgagccatcttgaaaaggcagtggtcgagggtggggagcacgggcgcgaaggcggcccgcacccgacgccgcgcgggagcccagtccagacactgagccgcggcggccctcaggtcgtcactcgcgccctccagcgtccgctcccgatgtgcgcccttcgccgcagcacccgcgaccacggcagcgcgcccccgcgggcgaggcggcgccacaacggcgacgcgcgggccggatcctgcgatccggtgcgagatcgccgccatgtgaggaggcatgtgtggctgcttggccggcttgtcgatcggagctgtgacctccgcgcacgtgttgctgcgctctgctcgagatggaatttctcgcgtggccttgccggcttgccgtgcgcgtgggcaagtgggtttatgtctcgtcaatgtctgggagct

SEQ ID NO: 24796 - DNA, 1951 bp, Zea mays
gatcggaatctggaccttttccacgtcattgccactacggcggtcgtcggcagcgctgcggccgccgccccctgccactaatccttcctacccttccgtgcttgatccttcttccattgccttatctctccttcctcagtttaatcaccagacggccagccctagcgagttcatattccgctcctggttgtccgtccatggccgcgtcgctgcttcgccgtggcgtcgtcaccagccgccggcgatgcccggtggagatgctgcggcggctggtctcgtccgaggcggcggctgaccgggcaccgtcgcggccgccgccggagatgccgccgttcgaccaccggccccgcccgtatgccgggctgggtggcgccgagatcttcgagaagaggaaggcggtgctcggcccgtctctcttccattactaccagaagccgctcaacattgtggaggggaagatgcagtacctgtatgacgagcatggaaagagatatctcgattgctttgggggcatcgtgacagtgtcgtgtggccactgccatccggatattgtgaatgctgtggtggagcagaccaagttgctccagcacacaaccaccatttacttgcaccacactattgtagagtttgcagaggcactcacctccaaaatgcctggcaatctcaaggttgcgtattttgtgaattctgggaccgaagcgaatgagttggcaatgttgatggcccggctgtatagtgggaatctcagtatggttgcgctcagaaatgcatatcatggcggaagtgccggtacgattggattgactggtttgcagacgtggaaatacccaattcctcagggtgaaatacatcatgtcatgaaccctgatccttatcgggggactttcgggtctgatgctgcagcttatgctaaggaagtcgaagaacacataacttatggaagttcaggaagggttgcaggcttcattgcagaaacattccaaggtgtgggaggtgctgttgaactagctcctggatacctaaagttagcttatgacattgtgcgcaaggctggtggcgtttgtattgctgatgaagtccagagtggttttggccgtactggcagtcattactggggattccagacacaaggtgtcattcctgacatagtcaccatggcaaagggaattggcaatggcctaccattgggggcagttgtgacaactcctgagattgcaagtgtgttagctcaaaaaatccaatttaacacatttggtggaaatccagtttgttctgctggtgggttagctgtgcttaaggttcttgacaaggagaaacgccaggcacattgtgctgatgttggatctcacttgttggagcgtctaaaatcgcttcaggagaagcacgaaatcataggtgatgttagaggaaggggactgatgcttggggtggaactcgttacggacagaaaggagaagacccctgccaagtcagaaaccattgaactgtttgagaagctcagagatctcggggtactagttggaaagggcggtctgcatggtaacgtcttcagaataaaaccaccgatgtgcttttcgaaggacgatgcagacttcttggtggactccatggactacgcaatgtcaaggctctgaaggaacatgctctgagttgacaatgtgtctgcgtggaaacaacacttcctgcaaccgcaagatgcatggcctgaaatgaaactgaaaggcagatgatttaatgggcatgctccccgggtggtatgttggtgttatggtgaagtttaatagtccccctcccccgaataaattgatgaaaggggacagaacgtcttgcccagcttgtgaactgtttgtagaagaactgcagttaataaatagaatagcgagcaagcaagcgtgatatcaatctgcataaaaaaaaaaaaaaaaaaacctgcccgggcggccgctcgacc

SEQ ID NO: 24797 - DNA, 2701 bp, Zea mays
tcagctgtacgttacgttgggctctaaagcagctccaccggcttcccactgatccttatcctcaaggagacagggatacatgcaagagctagcctctctctcgatctctccctctctatcagagagagagagagacagctgccatagccgcccccatccagatgtagcactacacactactacagtggttcttatgaatgattgatggatcgccggatcgagaagataacgaccgggattgtacatgcaaatcgtgtgatgccagcaggaaccaacacgtacgtgcacgacgacgcatgacctaagcatccatttgtggtgaaacgtatggcgacagtgaagggcgcgtgtggtggtacgtagctgggtcagcaaagcaaagcaacctttttatacttcaattatttgttatccccatatatgcagactaataacggttctttgtacacgatggcgtcgacttgcttccatgattacgtatgtgatgctttgaaagagacggcccgcaaatagtacgtctgtggcaaatatagcagttctgacgagctccagctaataaggccatgcatgcacgctacattatttttgcatcaggcatttacgcctctaataagtaaggataaagaactaactacgttcaaggcgtagtttcgtccacgcaaacgtgtactctttctaaaggtgaagtggataaacagtgcgcacacacgtcgcacaatttaaagacggcccttaattaaccttgtacaatttaaaggatcttgacaaaggtggccagcgttcaacgtggatcacgcagcttttagataactgggtcacaacacgtgatttattttgaatgtcacaggaggagataggatccccacctgaattgcattactctttgtggctaaaacgcctttttagtacagcagggagggggttaggttacatcgatgtgatttattaatagaaaaacttttatctcatctgccaacgaaaagcaggacctctttcaggatttccatgatgatttctccaagcatacgacgacgaatgggaagtagtagatagaagcgtacatcttcctcctgcgaagataattgagcatctcttcacccgcttcttcttcctcctccttttaccagcttaagaccacgcttctcgtccttacaaaccatcagaagctcagcgatgcgcttttggtttggtgccgatccaggcatccagcaaattccataatcaccttgtaaaaaaaaactgttgcaagttttggaaaggtggacgctggttatatagggaaaaaaaattatggcagtgcaggaccagggtagacaagttttgggcccatgggttggagagggcgcgtagtgattgggctgtatctgttgtccacgcggcccgtataattattttcgcccactgctcgcagcgtggtctgtgtctggaaacaaaattgtgacaagcccaattccccttctgtaaaagagaaggaatccaaacatggaactatatgctcacggtgaaagtcaatggatcaaatgcaaaaccttgtcataccataatttaatccctaaatacaccttttgttgtctgaactgaagaaagttcgaaaccccatgagggaatgcttagtaagtcctgctagggcatgctgcatcagaggccaacttaggttcattcattcattcatggccacaggataacccatatggtttctcacagcagataaggccggcaacctggcactggcctgaagcgtccaacgggctctggaaagccttacttaaacaggtcagtaccgcagatggtttctgaccaaataaccattattcgcgtatttgcataaagtttagtacggagtacttcagaaccatacaagtccgactttgaatcagtctgccgcgcactgcgcacatgtacagttttacctgtggtatgaacacagaggatgcccccaaaaaaaggtcaaaaaaaaacttgaccaattggtcgctattttagttatcagtagttgaacagatcttcttttacatgaacatcttatacggcactgcgctccaggggacgcatcttctcatcgtgattcaacttggatgcgccgagatcccaagcccacccagtggtgcttcgttgagattttgtacaggagcagctgggagtaatggaataggcctgcaagaacctctctctatctctacagatatatacgtttctttctctaatctagtatggccgacctatttacacgcaagacctccagatcctgccctccaaggatattacaatgacagatacgtcgtcgtggtaccgccgccggtcgccgtgtgggatctcgatcagttcgtggaagtccatccctgcaaccacaacaagtcatatgtgagaaaacaagatcaccgactgaacccccgagccaactcaccctgaccttccagaacctaaaaaacttcctactactgcacaacacacgaacggtatggcttcagtatgtgtgtatacctgctttgttcgcggctttgaaaagaacctcctccaccaggtgctgggcagggtcgccgtcgggggttgtcgcgatgaacatctcgacctgggcaaccgcctcctcgctggtgaagtactggtacagcccgtccgaggacagtatcaggaacctgtccctcgtgctgagcctgcggtgacagagcgaagggctgcacgtgacgtacggggagacccgacg

SEQ ID NO: 24798 - DNA, 1733 bp, Zea mays
ctcttccacgagacattgttttttctgttctgaacaaaactgtacacaaggtccttgctccagccgcacatcaagctttcgttaccaatattttaaagaaccacaaagaccgactctttcaaacacgcaagcattccagtgctttcaaacctcccaagccactaggataagtgactgttgagtcctctaattaaaagtcctacaaatgcttctagtatttcaatttccacatcacagggtaggcagatttagtacataggtgagcagtcaacctgagattgtgtcaatagaatatcgcatccatatatgatgtctgcccgtcgataattcgaacactggtgcctgggtccttggcgtcatgcagggttgttttttgagaccctggcaacaaagatgacccagttctttcttaacaagcactggacaacaacggcattctaaagcatgtgtacaactagctatcatgctgtaaattaatccagaattccagatcactaactggtatttgacatgttctgctagtttttccagcagcatgcccgtatgaaatggcatgctgccactaagccaccacagatgcagcgtgccacaccgtaacaaactaaagcacattctgccgtgcaaaggctgacaggaccaaaacttgtaaaccttcagaaggcagcttggccagacgtgcaccaaatgcagattttagatattcttgggctgctccaattcaagattctgcagtagcccaaagatcccagtcccaaccttcgggggcttcccaaggcagacactcgctgaggggcactccagaaaatctgcctccccatgtgtggctgcatccacaatgaactttgttgctgtctcgaacgtcatcttgccaaatggcgaggtgctgaactggccaatccccagcctgttcataggccggtatccgccatccaaggtcataaagtctgcgatcaggctcaggtgcctcatgtcaacattgatgccatagggttcaaacacgccgctcacttccttgatgatggtgccccgtgcggcctccaccccgtatgtcttcagcatggcatggatatcatttgatgtgatgtcattgacgctgatgtattcactgagattccataccacttcaaagttcactccggcggtctctagacgcgtatggttgtgcattggcttgacgatcttacaatgatcaatgttattgcaggccttcacaagaatagtcctagctatctttttggcaatctgagctagtaaaatatgaggttcatcatgaaaggcatagtgaatctcaaaatccaaatcactggattcaacatggatagtatgttttaactttttcctgcgcttctttatttgaccctgtttctggtcatctaatcttccctcattttgatttttctcttctagtttagctgttccacgatcatcttttgattttttccccttttttacagaatatggcaggtcatccactgaagtcgtctcagacttcgagatcgtgtgttctttgtcagcctcttgtgaatcatcacctgactcagctggatcctcatcgctctcctcagattcgctacccattccctcctcggtttcagtatcatcatcatactccatctcatctttctcttgccgtttcatcttttctgcatcagttcccaagtcaacatcattatcattttgatcgtcatcatcactagtaccagtgtctcctccatcggcatgtctactttgag

SEQ ID NO: 24799 - DNA, 4165 bp, Zea mays
  misc_feature (4101)..(4103): n is a, c, g, or t
  misc_feature (4126)..(4127): n is a, c, g, or t
aatgcaggtagttgctgctgtgctgttcccccccgtctgtccctgagaggcccgcggcgtctccgcttcgcctcaccacccaccacctcctcctcgccggtacccctcgccggagccagcgagcttccggcgaagaaatccggcgggcacaccacacgggggcggagcaggggggaaggggtccggcgccggaatgggggcaagcggccgggtgctcaacgccgtcgtcgctggtgtcgcgtcgctctagggttaggtaggtgtccgtagctttctccttcgctccccctccctcccctttgccgcccggcgtcgcattggggtcccgtgccgaccgccaggccgcgtgatccacccgtgctcgagctcggagaggctcccggttgcgtggcatggggccatctcttccgcctgctgccgctgactgggaattcggcaccatttcttcgctctgaggagtagtaggtggcagcagtcgccgatctggatgccatctcaagtcatggatccgaggcgccacctctcccagttcagcaatccaaccgtggctgcgtcctccttctctgaggagcagtttcgccttcccacagagaggcaggtcggattttggaagcaggagtcgctgcatcacattggaagcaagtcagttgcatcttctccaattgaaaagccccaacccattgggacaaaaactgtgggtcgggtagaaccacaaccatacaagctgagagaccagaagactgcatttagccttgagcacaagacttttggtcaagagagacatgttaacctaccaccatctctgtggagagctgatcaagaccctaacctccaatctgatccatctttatttcccgatggaaggaggactagtccaaatgaggcctacaacgagaatgggcttttctcaagctccctatcagaaatttttgacagaaaattgggactgagatccatggatgtgcgtctacgccagccagttcaaaaggttgatctaactcatgtagatgatgagccctttgagttaacagaggaaatcgaggcgcaaataataggaaacatacttcctgatgatgatgacctactatcagatgttcttgatgttgggtacacagccccatgctaacatgggtgatgatgtcgatgatgatatattctacactggaggcgggatggaactggaaaccgatgaaaataaaaaaaatacagaacttaatggagctaatgatggtcttgggttgctaaatggcacaatgaatggtgaacatccatatggggaacacccttcaagaactctttttgtccgaaacattaatagcagcgttgaggattctgaattaaaactcctatttgaaaattatggagaaatcagcaacctttacactgcctgcaaacatcgtggttttgtgatgatatcttactatgacataagatcagcatggaatgccatgagggcacttcaaaacaagccactcagacgtagaaaacttgacatacattactccattccgaaggacaatccttcggagaaggatattaaccaggggatgcttgttgtatttaatgttgacccctctataacaaacaatgatatccatcagatatttagcgaatatggtgacataaaagagattcgcgatgcaccgcaaaagggccatcacaaaattatagaattttatgatgtcagagcagccgaaggtgcagctcgtgctttaaacaggagtgatcttgctggcaagaaaataaaactggagactggccgtctgagtggtgctagacgttcaacacagcacatgtccaaggagttggggcaggaagaatttggtgtatgcaaactgggcagtccaagcacaaatagcccttcattgccttcattgggttcatctaatatagcagcaatgacatcttgtggacgtgaaaatgggagtatgcatggtttgcattctggacttctcacatcaatgagcccgttcagagaggcttcatttctgggtctatcatctaccctaccacagagcctgtcctctcccattggaattgcttctgctgcaactcatagtaaccaggctccccttggtgagctcagccactctcttagtcggatgaatgggcatgtgaattatggttttcaaggcttgggtgctattcatccccattctcttcctgatgttcacaatggagcaaataatggcaccccttacaatctgaacaccatcacacctgttggtgtcaataagaactcaagaacagctgaagcagttgacagcagacatcttcataaagtgggttctggcaatctcaatgggcactcatttgatcgtgccggtgaaggagccatgggattttcaagaagtggaagcggtcataactgtggtcaccagttaatgtggaataattcaaataacttccacggtcatcccaattctcctgtgctgtggcaaaatcccggatcatttgtaaataatgtaccgtctcgccccccagcacaaatgcatggagttccaagagcaccatcacacatgattgagaatgttcttccaatgcatcatcatcatgtggggctctgcgccagcaatcaatccgtcactttgggacaggcggcatggctatgcagggggacttgacagaagcatcaagttttcatcctggcagtgttgggagcatgggatttcctggtagccctcagcttcatggtctggagctaaatagcatattttctcacactggtgggagtcgcatggatccaactgtgtcttcagctcagatcagcgcaccatctcaacagagaggtcctatgttccatggaaggaatcctatggtcccccttccttcatttgattcacctggtgagcggatgagaagccggagaaatgattcaggtgttaaccagtctgataataagcggcagtatgagcttgatgttgaccgcataatgcggggggaagactcacgaactacactgatgataaagaatatcccaaataagtatacctccaagatgctcttggctgctattgatgaaagtcataagggcacttatgattttatttacttgccaattgattttaagaataaatgtaatgtcggctatgctttcatcaacatgaccaatcctcagcatatcattccgttttatcagagttttaatggtaaaaagtgggagaagtttaacagtgagaaggtggcatcacttgcttatgccagaatccaagggaaaacagccctgattgctcatttccagaactctagtttgatgaatgaggacaaacgctgccgccccatacttttccactcagatggtcctaatgcaggagatcaggaacctttccccatgggttcaaacatccgagccaggtctgggagatcccggacttcttcgggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttaggctgctgcagaagttttgtctctggcgggaagctatatgcaagagggtggtaccggttcgttccccagaatctatgtgcttgttaacctgaaggccgagaaaggcgaaaaggcgcagggagagcctccagattttggtcgctgtaagaattaaccccatgttgtacagctggtcccagtaatttgtgctgaggggagagtgaaggagtcatttgatcagtttttagtggtggtgtgtggagaggaagagtcttgcctgcttttcctttttgaactttcttttgtgccttcacctgtgttacattttgagtcgagggctcctcttaaattgtgtgcagaggggctcgattttgttaccccagaacaaggcgcatgtgcgtcggcgtcgtcttctgccaccgtatctatcgaccttatgttcatcttcatctatatataggatgagttttgatgtcatctcnnnaaaaaaaaaccttaaccattttnncctttttttggctttaggggaacaacaatatttttttt

SEQ ID NO: 24800 - DNA, 1002 bp, Zea mays
gtctctgaggatacttcatatcggcttcatgtttctcctgaccttttaacatttcagaagatgactgcgagggagtgggtggagggcaacttataggggaaaggcgatgtgatttcccggccaccagctgagcttcaaatggcaagtggggttttggaacgcttttaactttccatccattacgggaaagagcttgaatgcgctcccacagatcttccataaaatccttttggtaggagagtggccttcatctgtctcaaagacagagaaagcaatatcatcaaaatgcctcctgatacttatgtaagactgtataccaaataaaactctctcgaactcatctggaacttgctcaaacaattctggaccagcccatggaagtgaagccaaaatacaataaacatagaagtccgcacgaggttgccacgaaggattgccagtctcatcatctaatattgttacagcagatgataatagagtctcaaatgtctcgatgattgaacttggaactacaactttgctgcacatcagaccactgagaaatcgcagcaatatcctaatcctatcacgattttcattgtgcaaggcatcctctaggttagcctgtgtggtatctacaatagccttactgaagtcttcattttctaagtttatcaaaccaatcaaaactccaaagaaaggaatcttgtgaggcaattgttctgtgcattgaaggagaaactcaaatattgcatctctggagtgttcatattctcgggatagtacaccataacaagtttcgatgtgttccttgtggtcggcggagcccccatactcggcgcatctatcgccgatgcgcagcaacagcgtcctccagcccgcgctcattgcgcccgcggcgatgaagtgggcgtagcgagcgatgtcgggtgcgtggggcggaggcggatcgaggctcgagagggactgagggagaggagggttttggttcgtgtcgcaggtttttcgtccggccagcctcga

SEQ ID NO: 24801 - DNA, 2054 bp, Zea mays
gcagacatcttcataaagtgggttctagcaacctcaatggacattcatttgatcgtgtcggtgaaggaggtaagtttgtaaatttggacattctaatctccatttttatgtttgaacccattgtcatttctattccttaaacatgtgttttgtaataaagctgttaggtttatcaggattgtgaaaactgaactgtgaaaatttgatcaattaatgtatgttatttaactgttccgttcatgattgcatctgtaacaaattttgcagctatgggattttcaagaagtggaacgggtcctgtccatggtcaccagctaatgtggaatatttcaaataacttacaacgtcatcccaattcccctgtgctgtggcaaaatccaggatcatttgtaaataatgtaccgtctcgctccccagcacaaatgcatggagttccaagagcaccatcacacatgattgagaatgtccttccaatgcatcatcatcatgtgggctctgcgccagcaatcaatccatcactttgggacaggcggcatggctatgcaggggaattgacagaagcatcaagttttcatcttggcagtgttgggagcttgggatttcctggtagccctcagcttcatggcctggagctaaataacatattttctcacactggtgggaatcgcatggatccaaccgtgtcttcggctcagatcagcgcaccatctcctcaacagagaggtcctatgttccatggaaggaatcctatggttccccttccatcatttgattcacctggtgagcggataagaagcatgagaaatgactcaggtgctaaccagtctgataataaacggcagtacgagcttgatgttgaccgcataatgcgaggggtagactcacgaactacactgatgataaagaatatcccaaataagtatacctccaagatgctcttggctgctattgatgaaagtcataagggcacttatgactttatttacttgccaattgattttaagaataaatgtaatgttggctatgctttcatcaacatgaccaatgctcagcatatcattccattttatcagacttttaatggtaaaaagtgggagaagtttaacagtgagaaggtggcatcacttgcttatgctagaatccaagggaaaacagctctgattgctcatttccagaactctagtttgatgaatgaggacaaacgttgccgccccatactcttccactcagatggtcctaatgcaggagatcaggaacctttccctatgggtacaaacatccgagccaggtctgggagatcccggacttcctctggtgaagaaaatcaccatgatatccagacagtcttgaccaacggtgacacttcttccaatggagctgacacttcaggtcccaccaaggacactgagtagctgaactgcagcttgctgcgttgctgaccacaaaggcccaaactataactttttgcaaacccattttcagttctttcccccctttcccattttggttctgttttgtaaagtctcccgatctgtatttattgacttccacgatgcgggtcaccgaagacttaggttgctgcaaaattttgtccctgacgggaagctatatgcaagagggtggtactggctatgtgcttgttaacctgaaggccgagaaaggtgaaaagcgcagggagagcctccagattttggtcgctgtaagaattaaccccatgttgtacagcaggtcccagtaacttgtagtgatgggagagtggagtcattttcatcagtttttagtggtggttgtgtggagaggaagagtcttgcctgcgttttcttttggaaccttctcttgtgcctttacatttttttagtcgagggttcctcttaaattgtgtgcagagggggctcaattttgttaaccggaacaaggcgcatgtgcgtcttggatcaaccccggtcttgtcttcaggcactgttaccttatttatcaaacatatgtacacctccatctatatatagtatgagttttgatgcctaaaaaaaaaaaaaaaaaaaaaaaaaaaacta

SEQ ID NO: 24802 - DNA, 1486 bp, Zea mays
gttggttttttttgttttttttttttttttttttttttttttttttgatccctcaagggaaagtaataaggttctgtcaggattcaaaaatctctgttatgcatcgcggacctagttcaagaaacttccaaaaagctggactcctacttttggatgagctacttttcccggctagaaaaactgaaaactggagcagttgaaggggagcaaccgaacaataccaatgaaaaaactgacagaagggttacaacaacaactaccacagatggtaggaaaggagcagactggatgcacgagcggcatctcttttttctgaagaaccccgtagggttcccagcttcttttcctgctttattctgtgaggaggaaatgtggtcgcaggcgttctgatctggtgaacctgcatgcacttgtggtagatgggcagggcctttggtcagctgtacaaaggtggcggtggcggtgactggtgaggatgaacacgaacacacacacacacggtgtgctgtagggctgaggtggtgccatcgttcatcggcggcgtgtttccaggaaagcgtcgtcaggagacgtcccgtagtcccccgttggagccgaggcattctagaggattagcgtagaagtagtcctcttccttgggctgccctgggacgacctttctttccgcaggctggcccgtgcggctcctgtgtgcctccttcactgcgtccgagaattcgtcccaggatagagcgcccccttggaaaaggtccaacagctcgacgagcttctttctgtccaagacgatggtcttgcggaaacccatatacctgcggtggccttcgacaacccttgccatatttccgtcgtagctgggaatgaaaatgtcgcttgctagagagaccatgtaatccagcgctgccatctgggtcgaatggttctggaacggccgcagttcatcgggagataaaatcttctccttccttactagtttagggtacgcagccttgagcacggccaggcgcctttcaccgccatagatttcaccggaagcaatgtatatcagagtgtcctttgtgaaccctagagctttaagcactagagtgatctcctctggtgtgaggggacagagtccttggagcctcttcacttccgaatcgatctctttctctttccaccatggataagcatatctcatcttagtgagctcctcagtttctttaccagagcagccatgtgtgcagcctgaaaaggcccacgcgtccgtttcgtagcgcaagtgaagcacaacaaactgcccacttcgtctctggagagtggagatgagctttctgccaagggcctcgatctgtggtgtgaatctcagagcctcaaagttcactcggcaacgcagcatctgcagctgaatcggaaggccattgtttgcaaggcgggcgtctgatttatcgaaatgaaccaccttgtgcttcctcgcaagaggtaatatccgctttaggtagtatgtttc

SEQ ID NO: 24803 - DNA, 8922 bp, Zea mays
  misc_feature (6233)..(6233): n is a, c, g, or t
  misc_feature (6531)..(6531): n is a, c, g, or t
  misc_feature (8183)..(8183): n is a, c, g, or t
ggtccggaattcccgggtcgacccacgcgtccgtaaagctgttatgtttattatgattgtgaaagctaaactgtgaaaagttgatcaattaatgcatgttatttaattgatccctgcatgactgcatgtgtaccaatttttgcagccatgggattttcaagaagtggaagcggtcataactgtggtcaccagttaatgtggaataattcaaattacttccacggtcatcccaattctcctgtgctgtggcaaaatcccggatcatttgtaaataatgtaccgtctcgccccccagcacaaatgcatggagttccaagagcaccatcacacatgattgagaatgttcttccaatgcatcatcatcatgtgggctctgcgccagcaatcaatccgtcactttgggacaggcggcatggctatgcaggggacttgacagaagcatcaagttttcatcctggcagtgttgggagcatgggatttcctggtagccctcagcttcatggtctggagctaaatagcatattttctcacactggtgggagtcgcatggatccaactgtgtcttcagctcagatcagcgcaccatctcaacagagaggtcctatgttccatggaaggaatcctatggtcccccttccttcatttgattcacctggtgagcggatgagaagccggagaaatgattcaggtgttaaccagtctgataataagcggcagtatgagcttgatgttgaccgcataatgcggggggaagactcacgaactacactgatgataaagaatatcccaaataagtatacctccaagatgctcttggctgctattgatgaaagtcataagggcacttatgattttatttacttgccaattgattttaagaataaatgtaatgtcggctatgctttcatcaacatgaccaatcctcagcatatcattccgttttatcagagttttaatggtaaaaagtgggagaagtttaacagtgagaaggtggcatcacttgcttatgccagaatccaagggaaaacagccctgattgctcatttccagaactctagtttgatgaatgaggacaaacgctgccgccccatacttttccactcagatggtcctaatgcaggagatcaggaacctttccccatgggttcaaacatccgagccaggtctgggagatcccggacttcttcgggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttaggctgctgcagaagttttgtctctggcgggaagctatatgcaagagggtggtaccggttcgttccccagaatctatgtgcttgttaacctgaaggccgagaaaggcgaaaaggcgcagggagagcctccagattttggtcgctgtaagaattaaccccatgttgtacagctggtcccagtaatttgtgctgaggggagagtgaaggagtcatttgatcagtttttagtggtggtgtgtggagaggaagagtcttgcctgcttttcctttttgaactttcttttgtgccttcacctgtgttacattttgagtcgagggctcctcttaaattgtgtgcagaggggctcgattttgttaccccagaacaaggcgcatgtgcgtcggcgtcgtcttctgccaccgtatctatcgaccttatgtacatcttcatctatatatagtatgagttttgatgtcatctatttcttggatgtctcacaaggttatttatttgtatctacgtgtctgttatgcttgtggtgtgtaaagcctctgtgaatcttatgcttggttgcttactatgtgagcatgaatgcaagctgtgagcgtgtaatccttgttcaaatccagagtatacacaccattagctaattgttggtacattgctatggatttctatatgtagatcttgcttaaatgggatatttatataaacatgattcaaacttatagattcttggattgcgccaaagggagacaatcgacttgcagttggtgcgcctatgtattgagacaaaccaatgcagcggcggtgtcatccctgttggcatggcggattcggcggtgcgtctcacacggttttaacgcgcggtggcgtgcccctaggctttgatcatgtggattcggctgcgcctcgcggtgcacctagagttttgccctagacacacaggtggctttgtggcaaggagaaaggtggagatgacgggtggaatgcccctagggtttgatcatgtggattcgggctgtgcctcgcggtgcacctagagttttgccctagagacacagggtggctttgtggcaaggagaaaggtggagatgacggatgacgacatgtagatgtggggtgagacaagatgaaattttctcttgtttttttccacactcgtgagatggatggtgagggagggagtactagactatagatgatcaaatgggctgtgcttgttaacctggcttgagacacgacccatttaatagtgtcgtaagtacgattcaaagtgggtagtgccgatccagttcaagattcatgtcattttttgtttgccttctcgatccgaaatgctgacttggtccgacacgattataatttttattttaaaatgattggtatatatattttatttttaaattattagtgtatatatatttaaaatatcgatctttcgtgtataacacaaatgaatgagggtagagctctcactgtttaacgacaggtccagggatccaaccacataaataatatatatataggaagcgattttacaaatcacaagtcgtggccctccatatcacccacccggctacgtcgaaagaatgccaaagtggactgattaaaaaaaaagaaggcaaaatcgtgttgtttaccctccgaatattttgcttgaacttttgaaaaacgactacaccgaacaaaaccgatgtaggggcagctttcgtgtacagaatacataaactggggttggtgatataagataaggccacgataggaaatacaggagctgccgaaagtaacccggcgtcatcagcagtcagcaccactcgcaagtagtcaaaatggcctgctgaggctgtcacctgtgacatcatagggactgattgcgactgtgaataataaaactaacaaacgcaagctcgtcagaacagaactaatcagtaatcacacacacacacacacaaaattacacaagaaagataaagaatccaaagagtacgtgaatggaacaaaagacgagcatgccgctcacgagcggccgccagatacaatatctataaattggagtgcctctgttccacttagaatcaaacaaaacagtgtcaacactagaatagaacagttctatcataacatactctagaactaaacactaccttagtctacacacaccaaattattatgagacaaaagttaccacaggaacatagttaaggaaatgtgatcacaattcacagaaaaaataaaataaatgtaccaagtcgagacctaaactgagctacagaacaaagttttcagccttgtcagatacaagggaggagcaactactgatcatccacaatcctattggcaccagcagtttgtaccaacaggataaagaatccacaaatatatgcctatctatctcgtcagtgtatgcgtgtaattctcaatcccgtagcttctctcaacacatgttcatcatagtcatatggtcactggtcagggacgaacttaacctcccgcctccgccctctacccggtcagtctgttgacttgatgtctcaccactgcagctacttatctggtattgacttggactcctagtcttagaggccgggctctctgtattgtcacaggactaccaggatgctatgggtatatgatgtcgtagtgctcctgcgtgtacagcacggtcactcggggaacttcatgatcagggggtacctggtgataacgacgtggccaacacgtgcttcttggcatatcatcttgggaatcttggccgccagtatagaggtcttgaccatctacttgaaagaggtactccactcgcagaggcacccgaagcgccctgactagtgctgttatctgaatatgatctgtaaagaccttacgctggataacttctcgaaagcaccactgttttaaataaagagagatacgaggatagaaccaagtaatccaagaatccaaggtaaactagcggtgctacttacctcggtgagagtgtaaccttggctgagctcaggtataagtggttcaaactcttgcctgtgcgagcatatccagatagctgctaccaatctgaggaaagtaaaaactggccaacaaaatgtgtttgaacaatgaactagaaattaggattacaagtggaggaagggctactcactgtcgtctatcctcttgttatctctgaagaactcaagaagtttctccatgcggtagctgaaaaatggcacatgttcgatacattatgtgaaatgcagtggctgcaacgctctgatggaattgctgggaagaaacatgttataaacctgttaattgtcggtacatgcttccctcgtctttgtgtcttccatctcattactttatttattagcttcttaaatgcctaaacgaatcagatattttcttgcaataaggctttacacagtactgactgtttataacaaggtgcaaaaagatatgaccaacgtaagatttgtctgcgccacttctaccagtaaacaactataagatagtagttgagaaagaaaatatttaataagcatgtaggattagtatttgatcagatggccacacaaagcagcatgggtgtgcattgtcttggtgtaaggaagaaacatgatctcttttatctctctacaacgatgtctcatgatgctgttctgtaaaaatgaacttatgtcaacatgtatatttattagcattagattgttacatttccaataaattcaaatttgaacccatgaacaggttgtaaaattgtgatggcatgcccctattccactacattgaaacaatggtgcatatcctgcaaacgacagaagggaaaaaagtaaagtgagatgccagatccagcttgcagtttgatgttggttgaagaaatggtctattaaacatgtttatctcagaaatggcaaacgtggaggtgagagcttactttgtggctcctggaaaattcggaggcccacgcccacccaaggcgtgcatgttgcctagccactcctttaacagcagcaagaagacggtgctcctcatgtgtatcctgcctatcaagaacttgctcctgttttagagtggcgcaaactggggtgttaaccacaaaacataaatattattcaaaggaaaagggaggacatttacgaggtatgaaaatatgaagctcctgtagaaacactctccatctccatgcacaggcctaaattcagaatattcacgacaaaggttcagagcatgtaaatgcaattccactccttgtacagcaaccattgcaaagagatcgtaatgcctaatgagctcggttatgtgaactttctgcacaaaaacaagagcaaaaaaaaaaaaaatcaaaacaaaatgatctgaaccaggaagcaacagttctaaaatgggattgtaatttgttaagttttcatgtttccacattataagaaaaccttaagccactaataaatgcaatgtttttgctgatattgatttgttaggtgaatgaaggcagggctggtgcagtggtggaaaagactagtctcggtttatcactttctcagaccccactcatgtggagtctttggtattgggtctacccttttagtttgttccgtgaatgaagaaagaacatatactgcatttcctgaattcaatataaactcgaagccgattaaggtctcatcccatcacaaaccaatactatcaattagaataagcatgtaaataatgtatggagtcaaacctggtagttcacatcaggtgtcgtgtaatttcggttggagtttcctatcctgtcaaaaaactatttcacataaaatgggttaaaaatttcacattttttngcaggattagattagaagcaacagtaaataattaatgccaagacccaacagttcacagaaggaaacaatggagaaggcaatggaactttttaaagatattactacagtaatatccaagatcttatgtatctgacaattgcctcttttactaatcatatactaacttcagctattagactattcatcaacatcagaatcctgtatgtttggcttcagaattccttagaaacacggcaacaaggacaatttgtggtacaatgaagaataagacataaatactgaccgttaataatatcantgtaagcaataacacttcgcacttttcaaaattataaaaacatcacaaaaatgttgttttttgcacttgaaattccatttctgatcacaatagtaataaaaaatcatataatcttggcagaacagaaactataaacatctgccattgctttcatctctatgctacacccattttgaacatgatctcctgccagaatatattttatcgtcccaatatttcatataagcatggatagaacaaagactgaacaatcctgatccaacatctgaaacacaaaaaattggcacaagagtgctcacaccagttaccaatcacaaccaaagatgaagaaatattcaggtcatattgtacctttctccagagcggtttcttgtctttcacctgttccaaaactaacatcaaatattcaaataaaggagcagtgataacaaaattggcacttatcgagccttgtcagctactcaaaatatgattatgctttagtccagaaatcagccaggcaaaggctaaaaccagcaatgcatgtattcagcctatgatctaaagaaactacattggtttatgctatctcaaataaacatagggatgggcccttacatatttgacggtgaaatgaaagcatgacaacaaactgaacagaaataccgattacaacagcgcaagaacatgcacctaaaaaagtctctgcaagatcgttgccactctaagcaacaaagaaagagaaactggccccaacgtctgcctaaggattccacccctgctccaggatgccatccaatctcgtgcccccggactccagtatcctaaaatcctccccacaagatccccatgaacggcaggattcgatctcccaaatgcaaaatcacaagaaaacaggaatcgctcaagaacgtagtcaaaatatctaggaaataacacctgcgcattccgttccctcggtattacctcagcctgatatagactcaaaatctctcttagatgctgatattacctcagcctcggctttctggtccgtttccccgttccgccggcactccaccatcagttcatcgaacacgtccttcaaatcgaagcgactctctctgtcaccatctctcatcgccatgctgctcccccacacctcgtggaatatgctgcggggcggagagggcgggctggggggcttgccgcccgaggagctcggaactctggttctcgaggcggagggagggcgtggaggaagagggggcttgccgcctgcggagctcggacctctggttctcgagatggagggagggcgtggaggaagagggggcttgccaccttcggagccccgtcggaaaagagacatggtctcgtcgcccttccgttcggccgccgcggctgtggcggcggaggggtcccggtctccggcttccggtggcccatggacctcttcttcagtgatctcggactgcggagcaagggaaggcggctctgcagagacggcggggcggcggcgttggactcctgctgctcgcgcagcaaatgggccgagtctttcggtttcggtgtcttcctggttctttcctgaacaagaggccatcgtggcgggaagaaaatcctgacgggaaaggggtgcggagggtctgtttcaacaaatctggaagaacgagggggcggaagtgaaatangtggagggcgtcgtttttaactgtggagatgatggggggctatttataaaagccgtaacggtcactcggtcagtatcatgaagatacgagaatggggcagcacaagggattagtcattggatgattgttgctgttaatcacaggacaaagtagattaaagttttagtgcatatatactcttgtgaacttgcatatgtcaaagcgaatacgtatcttggatacgctgcaaacctagtgtcctagtgtatccatgcatcatagcttgcatagactggatatttatgtagatgcagtgctaaagagtatttggtttataggaactaatgtttagtccctatattttattttattttagtatcttcacaaatacgttccatatttaacaatttatggactaaaatataataaaatgaagagactaaagattagtccatagaaaccaaacaccgtctttgttccatgctagactttcaattatttgttgagggagtgaaggacccacttgaaatggctattcttgatggtcgtcaacttgcactgaaagtagttccatatcattttcccgatcccatcaaaacatcgattcaaatttgaactatttgaatagtgcttgtcggtactctgaatatgaggtgcacactcctgctatgtttaagtgaaatcccgatggccaccattgaggatttcacgggcaactcgcccaacgtggggttgaggcccatagtcggtacccctaaat

SEQ ID NO: 24804 - DNA, 4816 bp, Zea mays
ctctctcctttccaaattataatttgtttgatatttttgtgccatgtttgacggtcttatttaaattttttttgaaaaaaatgaaaaatttaaagttacatttaaaatatattatatgctaaataatattgtatcaaaaaataacaaataattatgaatttttttaataagatgagtcgattaaatttagtataaagtatttaaacgaattataaattagaatatgcacacgcacggacatgttttctgtccgctgcggcgggtaatggacgcggatggacgatggaggcatgggcatgtgattgattttactcgctgcaaggatttacctgctgtaccacctcatcctgtgctctcccacaaaataaaagactctcccgcaaatcaaaatcacctcacccactcagctttcccccttccgcaactcctcgccggcagccggcggcggcgagtatctctcctgccgtttccacggaattttccccattgcggccactcttccccttccctcgtcctgcttcgtcgcgccttggctgtgctcctctcttcttcctccgagtccaggtgcgcggtgaacaggcgcagggactgggaggaggtccagatgctactatgctgctgtacttttccccaacaaatccagacctgtgctccgcgctcgtcgtttcacccaagctgcttgccgcggagcttgctcagctccggcgagcaggggaggagcaaaaagagcaagctccaccgcgtcagggcgcatgttttcaagtccaagaaccagtctttgcgctctcaatcccacctggttgatagccacgggggccctgcggataaaatcccgagaaaggattttccttgttccgcagcgccgtcgctgccggacgcggaggcggtcgcgttctggctgcgtttctgccggagggagctcgacgtccggagagcgcacgcggttgccctgcggtcgctcggcagcctgggggtgttcgtctccaacaatctgatcagcgcttatgtgcggttcgacgaggttgctaatgcgaggaaggtgttcgacgaaatgcccgagaggagtatcgtgtcgtggacagcaatgatgaatgggtatcagaagcttggctgccacggtgaggttgcgaggcttttgatggatatgctgatcgctggcgtccaaggtaacagcttgacttttgtttgcctgttgaaatcttgtggggagcgatgtgatgccaggttggggcaacaggtccactgttgcgttgtgaagggtggctggagcaatgtgatagttgacagcgccatcacacacttctatgctcaatgcggtgatgttgctgctgcttcaactgtgtttgataggatggcatcccgcgatgttatctcatggacaacaatgatcacggcttatgtgcagcatggccatagtgacaaagctcttcagatgttcccaacaatggtgtctgagggatttcgccccaacgaatttactgtttgcagcgccctcaaggcttgtgcagaggagaaggctctaagatttgggaagcagttgcatggtgctattgtgaagaagctatacaaatatgatatccatgtcgggagcgcacttgtcaccatgcggacgcgtgggcggacgcgtacggatgctcagacagtgttcgataagatgccaagaagaaacactattacatggacttcaatgatctctggatatgctcaaagtggctgtggtgaagaagctgtcttgttgttccgcaagatgaagatgcgcagagtatttgttaaccaccttactattgttagtctccttagtgcttgtggctctatgcagtcaatttatcatggaaaagaacttcatgcccagataataaagaattgtatggaagagaatctccagattgggagtacgcttgtttggttttacaacagacgtggggagcatacttatgccgcaagaattctacaagcgatgcctgaccgtgatgctgtcgcatggacagctatgatttcgggctataacaatcttggccataatgttgaagcgcttaaatcattggatgaaatgttatgggatggtgtggtaccaaacacttacacctattcctcagctttgaaagcttgtgccagattggaggctctgcaagatgggaggaggatccatggtgttgttaacaagacccaagctttctcaaatgtgtttgtgggatgctcactgatagatatgtacatgcggtgtgggaaagttgatgaagctcgaagagtcttcgacgccatgccagagcacaacttagtaacatggaaagtaatgattacaggatttacacaaaatggccgcagtgaagaggctttgaaatacatgttcctaatgcaacaagaaggttatgttgttgatgaatttgtgctttcgacagttttgtcgtcatgtggagattttcagttgaaatcagaccgcatctcgttcatagttcaataaccagtctactttcagtgaagttttagactagttagcgaatatcagcaaaatgctggtaaaactgtacaaagtcactggttggtctcaggatgctgcaacaagtttctttgtctgattgcgcattggaaaatacaatcagaagctggtgatttcaaggtgtgggaatatatctgtacttcaaagcaacctctactaaccatttttcttcgctttcttttccttacgaagctgtatatacaccataattcaagcattgttagcctgttgcaaccagcatagttcttgcagtttactatatcctgggccaatgggaatttgtccacttctgtaaaaaggttgtcatcacgataatttagaacaactccagcaggatttctagttttctacttaatcctctatagctaaatatagatgtctaaataaaaaaaaacatatgagagcaccgaaatatcccaaatccagcgcccagatcttccctccggcacccgttggttcgtagactgtgggtcaagccccgaacgggctagcccctctctccgtgtgtgggttgtgggccaagccttcccttcagcatccgttggtaggggtgataatgaaaacaaaaatttacaattcctctctccgtgtgtgggttgtgggccaagccttcccttcagcatccgttggtaagggtgataatgaaaacaataatttacaattaccggaaatcgttatcgaaattttaccgaaatttagggctaaatggaaatggaaacagttactgaaaatatgaaatgaaatcggtagaaaaaatcagaaacgaaaacgatttgagtcccttctgaccatttctataaatttccatatttattcggtattttatggttggtaacgaatttggtaatttttcaggaaaatattaaatctaaattgaacattgtaaattcataataaatttgtcttaactcaaaaaattatgaaactaattttattatttttctaaaatcaatatctatctaatgatatgtagtttagagttgttttaaacttttatatatcttacttatagtttctttccaattattacacttgatacatatatttataatttgcacgagggcctgagaaggaccaggatggtaccaattatgttgactttctaactatatgtatgtgtgcatagtacttatcacttgtatttatatattattactatttttatgtggatgtacgacttgtgtgaatttttgcagtcaattgatggtacatgcgaagtattatagattttgaccgtaaccggtgtgttttccgtaccgaactttcgtttccgatgttttcgaattaccgatgttgtttccgtttccgtagttatcgttttttattccgtttccaaggaaaacatgaaaacagaaatgactttagtgtttaccgatcatttctgaccgtttcacccctacccgttggtgtgggctatgggccaagtccggaaacaataaatttcatctatcgtttcctcatgcgcgtgtgaattcttccctctcccactcgcactttttcttagcgtgagtgctgccaatccgctcgacttcttgcatgcgacctagtgaggcatgaccccctgcccttcgcaacccccacccctcggcgagcttcatatggtgttatggctgagatggcacacatgtatatggtttgtgaaaccatatccatgaagcaaaaccaaattcagtatactcatataagctcgtaggtatggatctgtacccgtaccttacccgatggatacacattactagtctgtccactatagttttagcatttaacaccaaacaacaattttatcataattcaacaattgcatcattctagtcgcatcaaacaacattttcaacaccaaacaacatgtcatgaatggaaattggaaaacagaaattaaagaagtgtattgaacttggatggcccacatgtcagatatccatcggataataggtataaccatacccgtgaaaaattacttgcatatattttattatatccatacccacagataaaaaattccatcatattcgtacacgatagataagtacccatggttatttacccatacacgtacccactgccatccctggttctgggtgagtctaagcgccagcttctctagccgagtcatcatctatttttgggcatgtacccctccgtcgacagactgtgttgcatggattggaagggcaatgtgtcatagggccatttctacctgttttggtgattaagtgctcaatacgtcatcttgaaccaactatcttcatatgagcatgagcacatttacttaaagacaacttgaagagatcaagtccaaatgacctaatctggagggcc

SEQ ID NO: 24805 - DNA, 699 bp, Zea mays
gggttgtcgtctctcttcgaacacatgaagaaagaagtcgttgagcaggggaaaagaagcagcaagaagagccaactaaaccacaccatgatccacttttcttctttagttttttttcacttcttttgttggttcatcatctaccactttctatacacaaatgcaaaaaaaaaacaaaaaacaggcacctaaagaaaagagatgcagagtgccaaccatacctaaaaaaaagagcaaaaagaacaggatgcaaagatgttcttctgatcaggaaagaagaagaactgcttgagggtcggttgatgcatcaagctctgtacgtactggtcagggctgactaccgatgctagaactactactagaatgggacatcagatgctctcttctcctcccttgattttgctccatctgcaaggacagacggcacgtctctctctagaagaagtcagctcccagcgccggctgcccctgtggctggctcgccggcgctgctggcggctgtcacccatggggggcttaggaagggctcgccgacgacgtcgaagagcgaggacgtcggtgccccggcgtcggcatcagcgtcggtgctgaggaacaggagctcgtcctcgccggccatctccatgtcctccaccagcagctcgtcctcctcctcctcctcctcgtcgacctcctccatggacggcgtgcgcagcggcg

SEQ ID NO: 24806 - DNA, 2964 bp, Zea mays
ttctgagaccctggtttgtttacctaaaatattatagagttgtttggatcgctgcctaatttaccacactttacctaatttttctatttaaggttaattatttaattcaaacgactaatcttaaacaaaacacgttagtcacgaaccaaacatgccctatataatccagtttttaagagacaaacaaacaacaccaattattaggtggattatataatctagataactagattatagtttttaataaatagaccaatcaagagaccttttccatagtctgctggaacaaattgtcttcggtaggaaaaaagaaagacagattttgctcctggatatcaggtattagccatttcacaccactaacaccgaatctagtggtatgggaaaggcgatatttcttaaatatctcccaaaccataattttgaattggcacatcacgcaaaacctgtacaaacacatcaccaacgtggcggttgagaaaacaatcccatcatcacgtatcactagattagctggagctcggtctggcacattagtttgtgcaaatcatgtgcttaaattcctcctccctccgttgacgtttcaagtttatacacggaaatttagtagtagtaaaaagatatagtacacagaaaataaataaaaacatagaaaaaatagagatagagagagattagcacaagaaaaggtatattaaaaaaaaaagtcgttagaaggtaagattaaaaactatttcagaacagagaaatgtcaactattttaggatggagggatgagctaaaataaaaaaaaatcaaagagtttggcaaaaacccagacgtcggaaaatgttctggccggtgtgtgcggcagaacatgtcccccaaacccaaaggcagccaattccaatgaagccaaccagagagctctgacaggatccccccctcgagttttttttttttttttttttttttctcagaagaaaattgttcctcttctttctccacaagttcaacagcatacagaattacaacgaaaacagatgaagagactggaagggagaagaatacagtttgttagagaagagtaacagaatttccaaaactgtcgcccgcttgtcctccaaaccagttaagtacccctttcctcttagctcggctgatggatcatcatactcgaaccttcccgcgtgttgtagctcacagacacacactactgtttcacgtccggcagcacctgaactgcatctctgttatgggatatgacaagagcatttccacttggtctagatactacagcgcagctgactcgcacagaaggccaggtcataacacatcaatgtctctcagctgtacccagttgaagctcatctgactgaaatctcgtttgcagtaacagctcattcatgtctacacaatcacagcgagatctaacagttgcgccaagccaacaggtgtccgtctaggtaaacctcatatcacttagccactagcgctacaatttgaactcacaaaagcagtactcgggcagagccgaccccctgcctctgacatactcctctcgatgagcgtcccacatagccttagccagttgctgccctgctagcccagcggcagtgtagtttgcgaaggccctcctgctcaagaccagtgtcctctggagaccttgcattgttctcatcgcagttaccatcttgtccatatttccaaagaatgtggcgacataggcgtcgctgttgaccgaaacatagtagtcgagagcagcctttgtgttgccatgcatgttctcgaaagcttcatgggtcaggagagacgatttggtgtacgtgttcttgtaaacggacgtgaaaccctcgagttccattagcccgtcaccagcagctaaataaatgtttgtgtttgtaggaatgcctagcgcctggaggatgaatgctgtttcgcttggtgtcagagggcacttgccacggttcctccacaggcgggcagcgtcaccggtcaataccttcctaccctccctgcgtgcagcttcaatggagtccattgatttggaagaaaggccagtgtatgaacaccgactgtaagcgaccatatctggttcgaatctcaggtgaagggataagaagggttttggtatggcttggaggagctcaacagctttggattccacattcttattcaacctgagagcgctgtaacagccttgacagtatgaagcttttgcatatgcggggtttctatcccttctttgattcatggcaggtgtcaatgagatgtattgatgctccaagagagctggaagtaccgtttcaacgtaatcaaaatgtcctttccgtttactgcagtcaaccttaaatggttctctggacgctatctctgcaggcaagtccttaacaacttccacatatcctctagtctgctcaatgaagtaatcaacatcaaaaacatctagattcattccaataggcggcaacctcaaacttgggtagaaccattgttgcgttcagaagtcgtgcaaccccaattccgtcacataaatcacgtcgcagctggttgagaccgccgtagcaatctattcggatgtacccgttcctcctggacggagcttgcaatggcgccgtccgccaccacccgcacgggcgccactccaccaaccaccgctgcgcccatatgagccgcgagcttaaaggaggcagctctccggaggcggggaggctgacgaagggcggagaggacggcggcgacaggaggaagaagaggacgggcgcgaggaagagggacggtaggaggaaccggaggcggtgctgcgcgcaccacgccgcggccggtgtcatggacgccggcgactcaccgtcgccggagccgccgggttaggcgctggatctgatcagccggcggcagcgtgtgatttgaggagaaagaaatcccactaggttagcacatcggagtgagaaattcgactttttctctcctccaacagctcccgac

SEQ ID NO: 24807 - DNA, 810 bp, Zea mays
gagagcgctgtaacagctttgacagtatgaagcttttgcatatgcggggtttctatcccttctttgattcatggcaggtgtcaatgagatgtattgatgctccaagagcgctggaagtaccgtttcaacgtaatcaaaatgtcctttccgtttactgcagtcaaccttaaatggttctctggacgctatctctgcaggcaagtccttaacaacttccacatatcctctagtctgctcaatgaagtaatcaacatcaaaaacatctgcaaagccactagattcattccaataggcggcaacctcaaacttgggtagaaccattgttgcgttcagaagtcgtgcaaccccaattccgtcacataaatcgcgtcgcagctggttgagaccgccgtagcaatctattcggatgtacccgttcctcctggacggagcttgcaatggcgccgtccgccaccacccgcacgggcgccactccaccaaccgccgctgcgcccatatgagccgcgagcttgaaggaggcagctctccggaggcggggaggctgacgaagggcggagaggacggcggcgacaggaggaagaagaggacgggcgcgaggaagagggacggtaggaggaaccggaggcggtgctgcgcgcaccacgccgcggccggtgtcatggacgccggcgactcaccgtcgccggagccgccgggttaggcgctggatctgatcagccggcggcagcgtgtgatttgaggagaaagaaatcccactataggttagcacatcggagtgagaaattcccccccggcccggccggcctcgag

SEQ ID NO: 24808 - DNA, 4375 bp, Zea mays
gggggggtgtggatgcgagagagcgccttgcgcgtggtgcacgaccacccgggtcgtgccgctccgttgtgcaaagtccacggcgcgtcaccgtaccaccggctccgggtgccaatgtgcatccggatctcccagccgcggcaggtggccagtaccatcccagtttcagccgtaccggactaaaaattccaaactaggtgcctgcccgattacagactaagcgtaggtgccgagtggcagctttcaggaagaactggtcaagcacacgggaagggaaatattctgctgcgacaaggacaacacagcgtggcacgagcacgcaacagctcacggacgacgagtaaacaatcaatgcgtaggcaggattaagtatggacaggtattctacgatacagttctgaccttgttgaatgtaataaacccaaaaacaaaaatacaacagtgcgttacactccgatacaaatataccgtagccaaaccacagataagaaatcaagtcggcatttggaggcaagaaaacaaaaattacaacacttttttgttctattttacaccccatgagcacaggcatattacacaacatgcaggccgccggccccgatgaggaaatgaattgagtgcacaggagactacactgaccttggtggatgcgtttacaagccagccatgagatatatagcgctatcgccctgctgcagggaaatctgcgtggccataaaacctcgtcgtacttgacttcgttcccaagcagtgcgatccaatcacaaatgacaccatcaaaggaagattccaacagagggcgcacccttatctcttctttggtgtccttttgaccttgatcactcttcggttcgacttgtcaccgccaccacccccgctgcccaacgaaaagttcccaccctgaaactctagactgccaacagctgggaaggacgggttctgctgtgctgaaccttgttggcccccgaactgaaaaacaccacctggctggaccgcgggagcaccaaataccggggcagcagatgagttgttctgctgtccaaatgatgaaccaaatactggcgctggcgcaggtgctgcctgactagtgtcatctgccatgctgtcttcgttcatctgatcatttccgggggaagccatgctgaaggctgtgttggtatttatcattccaaatgcaggctgtggagacgaattcatgctagtgttggctgaactaaatgagaaaagtgatggttgagatgggaacgttggagctggctgcgctccaaatgcaaaagtgttgcctgaagaacctgattgcccaaatgtaaatgtgctgggtggggatgaacttgagccaaaagggttgctaaaagctgaggctgaagaagctgtagaggtgctggcaaatacactcgtactggccgctgttgatgcaccagcagaagagctaggtgaagaaaatgtgaacccagtgcttgaactagagctaaatggattcgcaaaagtagctccagttccaaatggtgaattgccaaatccagtccctgatgtggaagttgctgcaccaaaagaggcagtgctaggtcctgatgaggaagttcctgccccaaaagagaaaactccaggtccagaagagtgagctgctgccaccaaaagttgataaagttccaggtgcggaagatgaagctccgacaccaaaagatgcagtgcctgaaccagttgaggaagctccaagtccaaaagatagcgtcccaggtccagacgaggatgctccaactccaggagtcatgaccgggaatggtgagccagattgtggttttgaactctgggatgtttgttgtattgttccgtctgactgcgtcggcttactaccaaagagtgtgctagcagctggtggttgagaggtactaccagcaagtgacgatgtactgaggccagtagattgggctggggagctgaacccaaaaaggttgtttccagagctcggaaatgtaaatgaaggggttgaagcagactgtaaacctggtgcagtggaagtactagatggtgcagccacagatattccagcagcatcacttgaaggtgcaactgcggtgaaagtaggcgtagatgtggcgggggaacttgaaaagcttgcaatacttgatgacacaggtgaaataaaaagttccgatgatgccttgctgcttgcatctggtgcaacagatttcacttcagcttttgtaccccctataccaaatgataaggtgctagctgccttattttcagcagttgtgccatcagatttagctgatgttaccaatgacaatccaaccggagcactggaagaaaaactaaatcccgtaaatgcaggagacgatgaaatagctggactgctactggatacggcaaatatggaagtggaaacagctgagctgatagcaggtttatcagtaggtggaggagttgtgagctttggtggtgagtatgacaagccattgctcaggctcgaagtagatgccacagatgtaaaatggagaggtgcattcagtgttgttgatgcagctgaagccaacaccttctcggatgggttggctacatcttctgctttttctgttttatcacctctctctgaactagtgctggctaatcccgtgggcttgtgacactggaaaaataaaaagcaaaacagattagcagacttgaaaaacattgaaaacactgggcttgcattccaggaggatcagattaagactatattggttttttaaatgcatcactaaggccctgtttgtttgccctctagattatataatccaggaaataagttaagaggcaaacaaacaacacagattattaggtggattatataatctagatacctagattatgataatccataagcaggtcattaggtgcttatataatccataagctggattatataatcctagaaggaaacaaacagggccttaagttgaaaaaaaatgttgtatctccattgtccatcaaggatccacatccaattactaacaccaagtctaaccaatttcatgataaaacaaatatccagtctcacggtaacaaataagacattgaaattatgtgcacattcttaatactaataacgaaaatggtccatgaagcgccaaaagagagacaaagataaaagagaaatcacctctgcccgagtgttgatttgttttttgcagttgatgtttcaaaatctgacgtaattggctgcttgatgccgaaaatgaaatttgaagcaccagtctgtttatcgttattaactgaagcaagtggcattgctgatacaccagttgcagggcgggtgccaggaggcccatttgagaatgcaaattcggtattattgtccacagaagctttgggaactgccttcccaggatcatttgataaaaataaaccaccagatgaagtgacagttttagacagtgatgctacaggctgttcactaatcgtagaaccagcaatgttcttcaagttcggttcaaccctttgctctaatatattttgttcaaccttctgttcttttctatttgaatcaattttctgctcagttgtttcaacctctatcttacttgattgaataaggacctccagatcatcatccaactctggtaagtccttgaaaacataagaaaaactaatcaggtcacaagtattggatatatgactgcactacattcgataaaaacaacacatttctcatacctctatcacagccattttaaaggctggcgtccatgatttagaagcagaaaccgagttccccaaaagggcaggtctatcagaaaaggcagcttttggcgatccgtcttttattatatttagcttgtctttcttcagcagggaaccattcaagtttgtatcatggggtccatttgcaccatccaaatcttgaaacttcagggaactagattggttatacatactgcttgacccagcatcttgaaaaacaggtttctttgacatagagttactagcattcagagtaacagactgttgttgttttggcgatggagctattatattaagctgctcaaatatcttttcagccatcttgtttgattgagctggtatgggtggaatgctatcactagatttaccatctccctcattcttttgggattctaagggtcgcagagattgactactcccaaccaataatttttttgagctcggagactgaatggatgcaccgtcttcagtgaaatcagtactacttatatggctagtaagaaggtttcctttaggatttgcacgagaatctctaaatgaagacatcatatttgatttctgccgaattctacgaatggggcctatagatccaagttcattctctaattcagccccgcttcgtttcaagacctgcctgccaccaacatgcaag

SEQ ID NO: 24809 - DNA, 820 bp, Zea mays
agttccgatttataagtcgttctggtcacgtaccagaagcatccaagacaagtcgttctagtatgtaaatcgctaccctgctctttttgttacacatctaatgaccaaatgtataaaaataaatgtcacaaataattattacatagcggaactatcttaaaaaataaatgataccaataaagcgaactaataattattccttggcgccataaagctgactgagagacgccacctagataagctcgtactcctcgttgtagacctcctcccgggctacctgctcttcacctttaatgagctcctcctcagtactttccacctgctgggtaccggggtcctcggtcgcttgctcgtataaatggttacgtagtgcctttccctgcccacggcgcgccctggatttgcggccacggcatcaaattggcgacgcccaggtcgcactccctcccagccaccacctcaacacgatcctggagcttggacggactctcccgacctcgcacagggcaccaattagtgcactgcatgccggacgaccgtggaggcctccggtggctccctgttctctctctcggaggtgagtatcccaattcggggtgctggtgcgcgtggtcgacgtggttccctcccttggcgaagatggcgcacgtctaagtcagctggagatctcgagtgcagtggaagggttggagggagtcggcgcatggagatgtcggggcttccgttagggatgggtttggcgcgcggggtccacgagtagtgagacaccagagttcgagcacgggagacggctgaccccggccggcctcgagggtcccaa

SEQ ID NO: 24810 - DNA, 1499 bp, Zea mays
accggggggtacccccgggtccggccgggcataaaaaatgattttccctatatgccggggcccagcgtattcctcttcggttcctccattgctcctcgcgtgcgctccctctcccgtctgcccctccctctctctctcgtggagacgactgggccgccgtcgttgctgccctacgcggctacacccacgtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttcttttgcaagagggagatatggtgttcataaaaaatgccaacctccccaagggcacatatgtgaagttgcagcctcatacaacagactttctagatatttcaaaccccaaagcaatcttggagaaaactttgcggaacttttcttgtctaactacaggtgacagcattatggttgcatataataacaagaagtactacattgatatagtagagacaaagccctccaatgctataagtattattgagaccgattgtgaggttgactttgctccaccacttgactacaaagaacctgagccagtaaaacctgctgttcctgcaagcacggagcctggtaccgacgttccagctgaagaagaaccaaagttcatccccttcactggttcaggaaggcgcttggatgggaagccttccaaagataaagatgtgctagcctcttcccctgcaaagcgacaagctaatgcgaccaacggtgtgcagccttcaacagccaccacatcacagggcagttcatcgcgtaaggccacaggaaaacttgtctttggctctggtggtagccgagccgaaaaggcacctgaaaaggaagcagaggagcccaagaaagaagacccaaaattcgcagcattcacaggaaagaaatactcactgaagggctgaataaataggaagacaatgtattatcagtatttccggtgacggacattctcagggagaagcgcttaccaaccctgttatgtgggagggtctttcggtgggatagtggtctctgtttctcctgaactattacccttgtgtagttgtgtcagccacaccggagcaactgatgtataaagccgctcttgtccgataatggatttctgttgagcttgcatgtacattttctaaaaagataactgaaatcgccaaaaaaactacagaatactgtctagaattctgttgaaattttagattttatttgcactt

SEQ ID NO: 24811 - DNA, 1568 bp, Zea mays
ctcgaggccggccgggattaaaaaatgattttccctatatgcccaggcccagcgtattcctcttcggttcctccattgctcctcgcgtgcgctccctctcccgtctgcccctccctctctctcgtggagacgactgggccgggggccgccgtcgttgctgccctacgcggctacacccacgtcttcttcgggcccttagccgcgacgagcaccaccagggagtagaagaggttaaccttctggttggaaacgatgtacttcgaaggctatggcttccgtggaagtactttcgagcagacatatcgctgctatcctgcgtctttcatcgacaagccacaacttgaggctggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttctgttgcaagagggagatatggtgttcataaaaaaatgccaacctccccaagggcacatatgtgaagttgcagcctcatacaacagactttctagatatttcaaaccccaaagcaatcttggagaaaactttgcggaacttttcttgtctaactacaggtgacagcattatggttgcatataataacaagaagtactacattgatatagtagagacaaagccctccaatgctataagtattattgagaccgattgtgaggttgactttgctccaccacttgactacaaagaacctgagccagtaaaacctgctgttcctgcaagcacggagcctggtaccggtaagactattgtcctatgtgattactgttccccatatggttttttcatgcacattatttttatgtttattttttcagacgttccagctgaagaagaaccaaagttcatccccttcactggttcaggaaggcgcttggatgggaagccttccaaagataaagatgtgctagcctcttcccctgcaaagcgacaagccaatgcgaccaacggtgtgcagccttcaacagccaccacatcacagggcagttcatcgcgtaaggccacaggaaaacttgtatttggctctggtggtagccgagccgaaaaggcacctgaaaaggaagcagaggagcccaagaaagaagacccaaaattcgcagcattcacaggaaagaaatactcactgaagggctgaataaataggaagacaatgtattatcagtatttccggtgacggacattctcagggagaagcgcttaccaaccatgttatgtgggagggtctttcggtgggatagtggtctctgtttctcctgaactattacccttgtgtagttgtgtcagccacaccggagcaactgatgtataaagccgctcttgtccgataatggatttctgttgagcttgcatgtacattttctaaaaagataactgaaatcgccaaaaaaactacaaaaaaaaaaaaaaaaaaaaaaaaaaaaagaaaaaaaaaaaaaaaa

SEQ ID NO: 24812 - DNA, 2259 bp, Zea mays
cggacgcgtgggcggacgcgtgggcggacgcgtgggctcaaatctcatgtattttcagatttttcaagcttaggaactgggaaggaaacagaagattccatgctattgcagcagctatctgatgcttgtttggtggttgatgcattggaaccatctgtaagggaagaactagtgaagaacttttgcagcaaggaactcacctcatataggcagatctttgaaggagcagaacttgccaagttagacaagaccgaaagaagatatgcatggattaaacgtcgactaaggtcaaatgaagacacctggaaaatatttccaccttcctggcatgtcgactatctgctgtgtatccagttctgtaagattacaagggcccagcttgttgatatccttaataatctcaaagaaaaaccagatgttgcaactttgttattggcgttccagagaaccattgaatttgaggaagaattggcagagaaattcagtggtggaactacaaatgctagaaataaagagacaacaagtgatgatgaagatgagggtgggggacacaataaaattgtttcggacatacgaaagaaatatgagaagaaattggctgcacccagtgacgaggacaaagataagcagaaagatttgtcagttcctggtgctgggttcaactttcatgggatcatatcttcttgttttgaaccatatatgactgtatacattgaacttgaggagaaatctttagtggatcaattagaaaaacttgtccaggaagaaagatgggaaatcgaggaaggaagtcagacgaacattctatcaagcagcatgcaggttttcttggtgattagaaaaagcttaaagaggtgcagcgcattaacaaagaaccaaacattgttcaacttatttcaggtatttcaaagaatactcaaggcctatgcggctaagttatatgccagattaccaaaaggtggaactggtattgttgcagctgccactggcactgatggacagatcaggacctcagacagggacgagagaatgatatgctacattgtcaacactgctgaatattgtcatcagacatcaggtgagctagctgagaatgttgctaagatgattaaccctcagtttgctgacaaggtggacatgtctgaagttcaggatgaattctcagccgtgatcacaaaagcactaatgactcttgttcacggacttgaaaccaaatttgatgctgaaatggttgcaatgactcgcgttccatgggctacccttgaaagcgttggtgatcaatcagaatatgtgaatggtatcagctctattctgtcaagcagtattcctgtgcttggtaccctgctttcacctacctacttccagtatttcctggacaaacttgcagcatctcttgggcctcggttttatctcaacatatacaagtgcaaacatatatcagaaactggtgcacagcagatgcttttggacacccaagcagtaaagactattctcctagacatcccagctcttggaaaacagagtacaggtgcagctagctactcgaaatttgtcagccgagaaatgggtaaagccgaagctctacttaaggtcattttgtcgccagttgattctgtcgctaacacataccgtgccctccttcccgaaggcacgcctcttgagtttcagcggatacttgacctcaagggcttgaagaaagcagatcaacaagctatcctggaggacttcaacaaacacgcccctgcaccagcccccgccatcaaacaccctgccgttgctccgacggtggcgacaccagttgccacagcatctgtccagattgtgccctcggtggcaactccagctgtttcgattacaccaagcatggcctccttgaagggagcactggcgaaccaagaggacgtcctcgcccgagctgccgcccttgggcgcggagcagccaccacgggcttcaagaggttccttgcattgacagaggccgccaaagatcgcaaggatgggccgttccgcaagctcttcaacgcctaaaatgtcgctcaccgttgtgttcatagtttgtgcccctcgtgcagtgaacatagatataggaaattctataacaaccattttgacagattatcctatcccatcctgcggagaacgattagctcagttgtagcatagagattttgagacagtttgagctattagataagttttcccccctggtttgtgcatgcaaacccaagattctataagagagaaaaaaaaaaaaaaaaa

SEQ ID NO: 24813 - DNA, 2315 bp, Zea mays
ctttgacatttttaattacagaaatatctaaataggattcactcttgcgtgccagatatgtgaatggtatcagctctattctgtcaagcagtattcctgtgcttggtaccctgctttcacctacctacttccagtatttcctggacaaagtaagttcagtattcaccatctttgtaattgctaaaacctcacatatcgttcatcttttgttatcacatattgtctgtcagcatggtcagttaacttgtttgttctgatccagacttgcagcatctcttgggcctcggttttatctcaacatatacaagtgcgaacatagatcagaaactggtgcacagcaggtacatgttaaatgccaggctaattttattttatttactactcattcggacatatctcattgctttgcattttgcccccaagatgcttttggacacccaagcagtaaagactattctcctagacatcccagctcttggaaaacaggtaaccttaatctgaacagttgtctatgtcagatattatctcaattgtatgcatgtcttatattgtctagcagtctaagtggactaattcttctgtttcatgtcttattgagtctggaatgaaatctggctggaaactgtgcatgttcagctaaaatgatctgattcttatgtacataggctgcaaatgcagcggatctgtggttgatgctggattacagcatatatatatgtatatattatcatggtatgtatcttatatgcggcttccttgcattgtgtgttgcagagtacaggtgcagctagctactcgaaatttgtcagccgagaaatgggtaaagccgaagctctacttaaggtaaattggggaggacactataatgattgctgaaaaggcactttgctgaatgattaccaccaggtagtatcaactgatggcataactccatgcaggtcattttgtcgccagttgattctgtcgctaacacataccgtgccctccttcccgaaggcacgcctcttgagtttcagcggatacttgacctcaaggtttttacattaaaatccggccccttttgtatgccaacttcaacctcccaggctaatctgacacccaactgtttgcttctgctgttactgactatcacagggcttgaagaaagcagaccaacaagctatcctggaggacttcaacaaacacgcccctgcaccagcccccgccatcaaacaccctgccgttgctccgacggtggcgacaccagttgccacagcatctgtccagattgtgccctcggtggcaactccagctgtttcgattacaccaagcatggcctccttgaagggagcactggcgaaccaagaggacgtcctcgcccgagctgccgcccttgggcgcggagcagccaccacgggcttcaagaggttccttgcattgacagaggccgccaaagatcgcaaggatgggccgttccgcaagctcttcaacgcctaaaatgtcgctcaccgttgtgttcatagttcgtgcccctcgtgcagtgaacatagatataggaaatcctttccacatcgtgtacacaccattaccgttaaccgacagtctataacaaccattttgacagattatcctatcccatcctgcggagaacgattagctcagttgtagcatagagattttgagacagtttgagctattagataagtttttccccctggttttgtgcatgcaaacccaagattctatactcgtgattgaataaaaaacccgccccgtgtcgtccgctccttttgacgatctgaaggacgtcgtcgttggccgtccgtccattcagtacgtccttccttcggatgacgacacgagcctagcaatttctgcaggggtagttggaagatggtacaatatcaattaccgacttaccgtgctgcgagcctgcgactgacatgctttggcaacggcatatgcaccctaaaggaatattcgctacgcaatcaagcattgaacattcaagctggattcaacaaaacatagcattattttatagtggtttccttcagccatttgaaggaataggatattgcagctccaagcatgcagcagtgctcaatccatatctgccgtttttgagcgtgtgaaaatgcttctttttcctcatgagaactgccaatctgccatggagatggagtggcgagtgagcgaccactgaccggggagtaggggtggtaatggatcgtgatccaaatagttcttcacaaaatgtcaatgccctaaataaattatagttaaaaaatgactagaaataaagcccgatcctaacccgcttcgatccttaaatc

SEQ ID NO: 24814 - DNA, 1049 bp, Zea mays
tcgaggccggccgggaacattgggaacctcgaggccggccgggaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggacctccccggctggctcgtgcactggggccacccgggtaacatggctgtggtgctcttcgcaatgggtggttacgggacatacctgggcttcaggatcaaactatcagacgaccttgaagagaaggccaaggccaaagatctccacccgaaactcctcgccgggatgttctttttcttcgccctgggcgcgaccggtgggatcacagctcttctcacctcagacaaacccatctttgaaagccctcatgccgtgactggagtcatcggccttgcgctcctgaccattcagtccgtcctgccaaaactgttcgagggaaacccagggcttaggactacacatggtctgctcggcagtggcatcatgactctgtttctaatccacgcggcacttggcctgcagcttgggatcagtttctaacttgtggctacaatatcttggggtttgcttctctttttctttaactcactctaagtattatcacacgaagcatccccttaaatgaaaataatgtaagagaaagcaaaattattttccttggctttgttggcaactgcagtccatgttatatgataatttgatattgccatacggccctag

SEQ ID NO: 24815 - DNA, 4697 bp, Zea mays
  misc_feature (1154)..(1154): n is a, c, g, or t
  misc_feature (1416)..(1416): n is a, c, g, or t
  misc_feature (1471)..(1471): n is a, c, g, or t
aacgaaatataaattgaaatataaattgggaccgaaggacggaaggagttgctgtacgcctgtacccgtacaccgacacatctgctctcggatctcgaattggttcgttgaacctagacgccttcatgtcgccattcactttgtcacgctttgccgttcgggcctacttctatataagaagatgcccggccgggtaagccaacccaagcctgaaaactttgaagagtataagcttgacctctacaataacgctggagtacattattgtatcagcagcatctcgctcgtagccatgatgacgacgagaaaagtggccgcggcgggaggcggggaggcggaggagatgaagcggaggaacgccgagctcgagagggcggcggcggaggcggcggcaagggaggatcggctgcggcgggagctggaggcggccctggcgcggctggccgtggccgaggaggccgaggagcgcctgtgcgtgcagctcggcgagctggaggccgaggccgtggagcaggccgtcgagtaccaggagcgtgtcagggcgctgtccgagcgcctcgccttccttgacggcgtgctcagatcgtccgggatccggggcttcgccgccggcgtaacgacgatggattaaacaatcgagatgtaccgtcatcggtgtatgtcatcgccgataaaaccggctgctcctcgagtatcgatgacgggtgtgtagagctgtacattttgttatttctatcctcaatattgattaagtgtgtatattgtccggagttgtatattagctcgagagatgtgctccattcatccatcctataataaacgtacttgtaaatttaaaatttgtgccaagataattacgtctctaagaatacaatataacatatgactctagttgttttattctattttcttttttgtaaagaatacaatgattgcatttttaacattgatcttttcatcacaattttaaaaaacggaaggagtacacaaggtggtaaagaaatcagtgggtactgattcgcgctttctagttcgctggtttcattatcaattaataaaatcgggtcgcggtatttgccctctgtttcttttttttaaaaaaaatccttcaacttatctaatttgcaggctttgatggccgccaactcacatgncagttacaaaagcggtctaactagttaaattggatagccaaaaatcaccaaacatgagtaagatggtttcgatgttaggcaaaaaaatctatttaaatgtaatattgaaagtagacctcagcgtggtcgcttgccctgaataatccgacctaaccgctcgaaaaccgattcgatccagcctaatcagtaaaacggatggatagagatcataatttttaacccacaacaatccattagccagacacgagccatattttttgantaaactttgatccgatccaaataacccgactcaaagcaatagtaaagcataagcnaaaaaaaacgacctaaccctaaaaatactcaacccgacatacccaatagtaaagcatgagccaactcgacccgatccgatactaggcatgggtcgcgtataggccatgtcgaacgacccacaagccaaccttgattcaactcgatctgacattttaataggtctagtgaaagaatgcaagatctcaacatataggttggtttcagccctagtgtgttgtatttgtcgtcacattattattgacaagtctatatctatcaatgtcagcctttatctatcgtaattctctaatatgcaacttttacccagcctacaaccacctcagttccacataattctttttatatttttgttgcaaataaaatacagtctttcattgaaggacaaaaccatgggacacataaaaaaacaaataaaagttatatagttcataaatagaattaaaaattacattacttaaaattacataatatataggtcaaattaaaataaaattacacaataaaaaaataaaatatacactacttgaaaaaaaatacataactcataaaaataaaatctatttttacggtgtagttcctaaatatgatctattaatttattttgaagctcaccatgcactacgcttgtatggagtgcggcctcgggctaaagcatagttgcaaaagtcattggtgctttaggagtgacggttgatgtacaatgaaggactcaactatctcaaaatttcccatattatatgatcctccaagctcatccttagtgatcatattatgcagaatgatacatgcatgcatgatcatattaagtatctgttgggaaaataaatggcatatgataatgcgaatatggaatcgagctttgagcatccaaatgccctctccacgtccttttatgtgccctcttgatatgcagtaaacatctgctgcttgtaagtttgtgggaggggaatggtctttatgaacaccgaccaccgaggatagatgccattggcaaggtagtacccatggttgtactcgtgtccattcaagttcatatttggtgcttcactcttgagcatgtcagtgaacaatagtgattagttgaccactttcatgtcgttgtttgaccccgccaacccaaaaaaacatgctagatccacaagtcatatgaggcaactgcctcgagtatgatggccgaggatccaatgtccctccttgtaaattgtcctctcagtccaatggatagttcctccacttctaatgcatgcaatctatactccctattatacaaggagatctccttacccctccccctagctaacagccgcctaaggtcgtcaatagtagtacaacgcctgtaatcctcaccaaaacatgaaataacacatacaaaatagtttgagacactctaaggcagttttgatgtcctcatcaatagaatcacgaaagctaccatacacaagcacgcgtagggtagctatacgcttgtagtgaggggagaaaccgccacaattgaatgcatcaatttgaagagtgaagtagggggggtgctcacccagcctcttcaagatgtgaaggaagaggctccttcacatgtggcaccttagaaaaaagtagagcggtggatagatgcatgagtcattgatgtagtcttgcattagctagtcatgggtagatacatggtcgcagtcaatgtatctccaattttgccttggtttcctcctcgatgtggaagactcagaggcaattcccatcacctatcgcattatagtttgttgtagtaactcgatcacctcttcttgaccatgtgatcatgtcgatgtccgaactagacaaagatattgcaacaatgctctacttgaataaaacaagggtgagatgagtatgaggagacagaagaaaaactataagtgtgagctgtgagtgagcccaaataccccctttattataggttagattcagtcttttgaatatttgaatatgttttgagaatttttaaaattcaaacggatattttgtccaccttcatactatggattgtccacgttgattctttttttgtcaatgatcttctgggagattttggtcggtgacatcttggtgtcactggttaggaagttgtgcacctttgtgtcgtggatagcagccctaacctatgcatgacataatgagtgattgggctttggcagcttcttgaagatagatagaccaatgagaggattcatggaggttgaaagggaaatatgtcttgtgtcatttctataaatgttttggtgattaatgaccgacacaacactatggactaacatgcatgtttggcaagtatatgtatgcatgttcaaaggaatcaactttagataaaaggtgcttttgttgcagtacttgagctaaaacaagaaaattaagttggggggaaaataaagaaataaagttacatgacttggactggttggattggattgtcattaaaagtatttttctatgtcattggaatactctcaaagtgagtcaaatttatttggaaaagaaaagaagaaagaactcagcggactgggcacaccggactagtccggtagcacaccggactcaaataccagagagccctgtagaagggttttagtggtctagcgcaccggatcaatccggtggtgtgtcataccactttactagagacaactacataatcaacttcaactgcttagcacactgtagcagtgtagtggtgccccagaccatcgggtaaatcaaccttcaacgatcatctcaacaactagctaacgtgtggcaggcccggtggaggaccagaccggtctagtgcctcgtggaaagtcaagtctgaggcatatcttgttgatggcgtgtgaccattgaggtctggtggtgtattagaccggtctggtgaacaagcgcatagcggattttttggcaattcttgcaatggctctttggggcatttagggctataaatacccctcctatcagcatagtcgagtaccaagtcactcaagagcaaaattccagagagatccaagcacctatattcataagtaagagtagcctagagagaggtgtgctgcaagttgtgcttgtattcttggttctttggtgggtggtggtgtgctcttgtgtgtgttctttctccctcttgttttcattggagttccaactcacattcattgtgtatggctagcaagagtctccaatatctatggagtaccttgcgagaaggacttcaaatcaaaggaa

SEQ ID NO: 24816 - DNA, 1671 bp, Zea mays
cgtgggcgtgctgcgttatcaataaaatgttaaatttcgtgtgtataatttgctgtgccctgttttctcttaggtacaattgacaattctaatgacaggatttttcttttttttttttttttttgaagtaacaattcaatatcattgcttgggcctcatggccataacatataaattggatgttttacagaacaaaactgtggagtctggcgtagtagccaaaagaacacagccatagtagtaatcaaattcaagcccaaaatacaacatcaggaacctcaccagtcacaaactcccatacatctccaatgagtaaggattctcctaactaatccccagatgcttcttttgcttcttatttatatgttctacctgctctggagcattgtcataattgtcacctctatccctcttctttttcctcttcttctctcggtctagatcaccatcagtgattttcttctccttcacaacctcagtgcattcctcttgtttatgcttctttttcttcctttccctctcagttatggcaactctttgttctgctgcactgtcattgacaattttctcttccacctcattcacattctcctccagtttcacatgatccttctcttttttcttcttgctcttcttttcactcaccagctcttcttccaccacaaaactaggctcctgcttcacatcgacgatgatttccttattcggacgactcttcttcttactcttctcagtggcaatttctggtgaagggagaatgtgggagttaggctcctgcttcacatcgacgatgatttccttattcggatgattcttcttcctcttctcagtggcaatttctggtgaaggggggatgtgcgagttagcacgggcaaccgctctatcctccagtggatccccattcttcttcttattgcccttcttaccggaggcaacatctagcttcgcctcagcggcagaatcgcggttggaatcatcagcggcaatcgccatgtcccctttgctctcctgatcttcgtgatttctattgcccttcaccggatcatcatagtagtgggcatcggagttggcggcaccctgcttgtggctgccgccgagttccttgcggaagcggctgagctgtgttgtggcgtcggcggcgttgcggaggtagttacagcagtcggaggagggtaggtgggaggcggcagactcggtgaagcgtttgaggaagagggcggccttgtggaggggacagggctgggaggagacgacgccgccggtgatagccctcatcgcgccgcccccggcgagacgagtgtggggagttggggttagggttttttaggacgaggagaattcggcaggccgcgcctccttccggccccgccgcccctcatggggccctagaagactctggactggacttgggcgtgccgaactggcccatgagtcagccgcagagatcacactttacattgaactatacgtgtacattctcggcccgagcccaaaaaaacccggtttgaattttggttcaacacaactcgtgattattttgggttatatcgtggccggtccattgattcagatatcgggctatgtgattgtttaaatatgtcgaacttatttcggacgacctaaaattcattttctgtctcaaaaaaattacattaagcccgaaattcacac

SEQ ID NO: 24817 - DNA, 1843 bp, Zea mays
ctcctccatatttaaatttgtataaggagaggatttaatccactccaatcccactcaattcaccaataaccgaataagccatgaagggactaatctccaatccctttgctctcaaacaagcttgagcaactccaaaaggctctctatattcttcttaatctatataaatagagattttaaaaaaaatccccttcaacaatttatctaaagggctatcaattatagccatattctattccgggtttctcgctagccaaatttagaaaatgtaaatgcctctctagagggcaaacaccctatagaaaggctattggatattgagaagatataaaaagtggtttttatacaaatgactctaaatgatagtttagagcgaaatttagaagaaaaaaaactattggagacgctctagggttcaattgcacgaacagtcttttaagtgaagcaagcgtttctaattcagtctttcaccggtccagctgccagtccggtccagtccaaatatctacgcttcaacatccagagtgtgtgcgagggtgtggacatgtggtgatacacgccgagtgacaaagcaggccaacacatgagggtaaaattgcacaaataaaaaaagtagaactgcagaaaaaagaactcaatgtgatcgattgaagcgaacagaccgctgaaatttctgtcagttcgtactgagtaaaattcaagaataaattatttttaaaaaaacttgaatgctagctgaaagtgtttccaaaacattagcggtgaaatggctaaaatatcagcacagcaagaacctggatcaatgtaaatgaatttgtatagcaagaaaaaaatttaacctaacagatccaactgtaacaggtattaactccgaatgcaaggacattgtaaagctgaataaggatacgtaaaaggatacggctgaatgctaataccacagagcccttattatttagctactgcaagatgacatcaaatagctgagtaaaagcaggtgctaaaaacttggaaaccccaacataatttaacaagcatgcctggacatgaagcaacaataatctgtatagccctgcagtgattatgatcacacttcctttcataatgtgcatgtcaatgtacttcatcatggtatatctcatgctttcctttagtagcatcaccaagcatggttgtcggatgatctccatcagaatatgcgctttggggatcatatctatcactgaattaatcttgagttatagataatgatttatgtcacttctgagttctgactagctctacgtctatcaaagcacccttcctcctggcaagtgagaatattctgtctcaggggatctttgtgactgtattggccatgtacaatcatttgattcatcacggtggtttgagacatccttcttaaacttatagccattgggtgtgtaattctcttgcgggtaagagtaaatttgatctacttcaccttctgaccctatattccacccatttccttctcagatatatactggtaatggtttctatgagtttcgcaccctgagttattgtatgaatctcttgtgtcactgctccttgatgaaaatcttcccaaagattcagcacatgagttgtcacagttagatgaccgagaagccaaagctgtcttatcatgagaagagctgcttgcaaaatcataacttccatgatatgcaccgctgtgagagttgcccttcagctcattccaagcaatatcagcaggagcttccacaagacaaccaatgccacctgcctgtctgatttcctccatatgttcatcaattatgtctcttagtatcttcataaagaaagaagacatcagattcatatc

SEQ ID NO: 24818 - DNA, 1665 bp, Zea mays
aatataacttggtttttattaaccagccggagatacatctcatttcaacatcatgtttggacgatgattccataagcgatggcaggctggcagctacactcttttaggccatgacctgcctcacaaaacaagattaatacttgttagcttattacaaggacactccactgtagtctaaggactgtcaagtgatagaacgagtattaactacctgatggtgtggatgtgaaggggcgcatgcatctctaaatcctagaatcttccttacactgtatttggccttgtcagcaagtgagagtatggaggcaatgcaaagcatgttggttcctggcacctttctcaccgccacgcagcacgcaccgtgccgggatggagtatagtcaggtgttgagttcagtggatcacactcgcgcaggatctctctcttctgatcattgttacacggtaaacggccaagcactggttggtagagaactagcgtccagcaggctaggaggacgactgctactttcccagtgaccattttgtagtgctatatgtggattgggtgaaggtacaacagctcaaactttgttactgctcgatcgcgtgggattcctgcataagtgctcctatttataggaaaaagactcgctattattcttggatttttaatggtaagatatcatattatttatggcgatataaatatcgggggataagatatgttagcatttataaatgtaatacaactatattagcgtatccgccgtttaatttattatatgtatatcgaaaggttgccgtctcaactaatgtcgaagaatccttaggccgtttacagcagatcgcgtatatagccgcgcaagatatctgcgttgtagacacaaagtggagattgaaattgaaatataagatgggataggagacgcgaaataaagatgtgataggagatgttgctgaggataactttgctagtcaatttgttgagttgaaactaatgaatgggctgaaccaatgaaaaagcaaaaataaaataaaattgtaagctccagggatgaattgattgtgtcggtttactattttagcagaagtaaaaatgttctacgggtgtaggaccagattgtgtttaggaattaaagtggatgaactgttcacgatatataaggtcattgttgtgccattttttatgaactttatcttgagcaccgatagtcgtattaactatatttattcttgcatgtgcagataggttatgcattatgtttatatgatggcaaagacaaagagaacaagttatttcgataaattcattgctggaacaaaatgaggaatgaagccaagaggtattcaaagcagaaggaatttgtagggcaggaaaatggggtgctaacaagaaacaaaaagtggcaagaatacaattccaagaaatgccattctaacatttttgctcctttaagagctcattgaactttacttgtagactgaaacatgtgctcagtatggttcatttcggtgctctttctctcagaaaaatggcaaagaatgtagaagatagtaacagataaaggccttcaccaaagaaagttacgtcagattaatttgtggggtttggattggatgtaaggaagctgaagcggaaatgcaattctcaagcgaggaaaggattgtttcaaccaaagactg

SEQ ID NO: 24819 - DNA, 559 bp, Zea mays
ccgggctcgagtttttttttttttttttttatcacaagttggctcttgtggtttaatataacttggtttttattaaccagccggagatatatctcatttcaacatcatgtttggacgatgattccataagcgatggcaggctggcagctacgctcttttaggccatgacctgatggtgtggatgtgaaggggcgcatgcatctctaaatcctagaatcttccttacactgtatttggccttgtcagcaagtgagagtatggaggcaatgcaaagcatgttggttcctggcacctttctcaccgccacgcagcacgcaccgtgccgggatggagtatagtcaggtgttgagttcagtggatcacactcgcgcaggatctctctcttctgatcattgttacacggtaaacggccaagcactggttggtagagaactagcgtccagcaggctaggaggacgactgctactttcccagtgaccattttgtagtgctatatgtggattgggtgaaggtacaacagctcaaactttgttactgctcgattgtctccgcgtgggtc

SEQ ID NO: 24820 - DNA, 1251 bp, Zea mays
  misc_feature (1217)..(1217): n is a, c, g, or t
  misc_feature (1219)..(1219): n is a, c, g, or t
tttttttagaaaatctgactatggaaaaaatcaatctcaagctaatttacaactccggacaatatacacacgtcacacatgaatcaacgtggaactgtacatatatacttgttttgtttggatgtcggagtgatttggtgtgtaatcgagggacatacaatacaacaagccgtagataacaacaatacccgtatacgtcgatccttcggagcacccagctctgccttagattagattatatataacacaccgatgaccgctcagctcgatgaatccatgctcgttacgccgccggcggcggcgaagccccggaccccggacgacctgagcacgccgtcgacgaaggcgaggcggtcggacagcgccctgacgcgctcctggtactcgacggcctgctccatggcttcggcctccagctcgccgagctggacgcacaggcgctcctcggcctcctcggccacggccagccgcgccagggccgtctccagctcccgccgcagccgctcctccctcgccgccgcctccgcgaccgccctctcgagctcggcgttcctccgcctcatcccctcctccgcgtcccgcccggctcccgcggccacctttgtcgtcgtcgtcgtcatatggctacgatcgatcgagaagacgagaacgagatgctgctaataacacaatcttgctccaacgctgttatatgttctcttcaaagtatttcaggggttttcaaagtatttcaggggttgggttggcttaaactttgggcctatatatatatcctgatgcaggccggaagaatggcgaggcggtgatcagtgtgaatgacgacacgcctgcgtccagattcaatgaactaaccggagctagagctagctagcagaggtgtcggtgtatgggtacagcgacgtagctatacatacatggtgacgggccggtgaccgcatcgtcgccgagagccatagaagatgactttgcccctacgtctctctcttttcctcgttcgtggtaacgcgatggacgtgtgcgtgaatcggtgagcgcgtgaccagtctgctagcgagtcaaaaacgctgcagggcgatggagacacgtcgctgtttcgttgaaacaatggattgtgttggagagaatcgaagaacaaatacacgagtgcttcgaattatatatagttgttgcgtcattgcatatgtgtttcaatgtcaatgtgtgtgaagtcaaatttngnatacaggtaagaaattaagtagaggagtctag

SEQ ID NO: 24821 - DNA, 2105 bp, Zea mays
ttttttttttttttttagcacgctagatccgaggtcggtactttacctggattacggcgtcttcttattcggatgttattttttccacatctagtacataattacatgatgcgagtcgctataccctagagtattccatagaacatcctatccctgatccatgatgccaccacctcgtcgccctcgacgactctgcgctctaccacgtttctatagccagccgtccatgccttccggccgccggttggtcccgacaaggtcgtcgggacccgagaggcccgtccttctccgccgcggttcccggagcgcgggaagaaacaccaccaccaacgtgtcctcctggatcacaactcactccactgcccacggcacgcacgcaatcttctaatcagactatgtaaaaaggggcgatatcatgtgtcagctacactccaccgcccggggccatggtgtgatgtcgtggtctaggcgtcttgccgcgtggcctccgcccccgtgcccgtgcatgctccggtgttccagaggaagtgcgcgtaggccgcggcgtggtgggcgttcccggggtcggccgcgatggcctcctggtaggcgtcctccgcgccggcgaggtcgttccgcgccttccataggaaagtagcgtaccggctcagcgcctccgagtccgccggctcagcgcgcacggctctttcgaagtagtgctccgcccggtcgtggtcgttctgcacgaggtagaggaactgcgcgaagttggcgaggatgagcggattgttgggctcagcggcgacggcctgctcgtatctctgctgcgtcagcgtgtgctcggcgtggtcctcggtctctagctccgcctccaccggcgcgacgaggcttcttagcacgtccggatcgctaagctcctcggtgcgcgggctggccttcaaggcctccgcgagcatcatttcccaaatggcctgctcgtccgcgtccgcagcgtcttgggcgacctcagccacagggggtgccgacggctgctgcggcgacacacggcttagccgatataaggactcgtccgaccggccgtcgccggtggcacccgcgacaggcggggtcttgccgccaccgccgctgtcccccccgaccgaggccatccggtcgacggagaacgtcttcaccgaagccgcgtcgaaccgcggacgtgacggctcggcgcgctgggcgttgacaagggcgacagcaggcggggtgggcgggatggtggcggccgcagcggcgacgctgtggcccatcgattggacggtgaagttggcgaggaggagcatgagggagaccatgaacgccggcgtgcccgcgaagatatgctggaagagccagacgaaggaggcgtgcatctcgccctgcacacgcgccaggacgccctgcaggtcgtcgcagagcagcgcgtcgcgcatctgctgcagcgcgaagctctgcagctcccgcacgatgagcaccatggaggagaaggcgcggcccaccgactccccggcggagcccagcagcccctcgtcccagcgtgaaggacgcgctacagcctgcagctgcgcctgctgttgctgctttttccgcttcagcatccgcagcgacagcggcagcccgacgttgctcgcgctcagctccacgctcgcgggccagccgcaacccgacgcaccggccggctgcaccccagccgccgccgcgatctcctcgatcctcttcatgaactccgcgtccccgccacccatcccatccaaactcgcgctcagcgcgcacctcgctggcgtccgagccgggcgcgggcgccacaccatcacgccggttccccagtttacgggtgcccgggatctcgcgagcccggcgcatccgccgccgcctccgaggaacggccgcgaggaggtcgagggcgacgataaggcggaggaggagcgcgcgcacggcggcggtgccacggcagccacctggaagcccatgaccttgttccgctgcgatatcggacgaggacgaggactcaccgcctcaagcgaccccggctgccctttggttgggccaccgccgcacgaggtgtgggaatagcagcttttccgattaggatctaggtaatggtctcgtgc

SEQ ID NO: 24822 - DNA, 3458 bp, Zea mays
gttctagatcgcgagcgccgccctttgtttttgtttttttttttttttttggcccccccctcgcgttcttgtctttcggacgagacggtaagagtgcatgcatgaaacattaattctactcatgatcgaccacgacacacaacaattgagcacgcatgcaagctgttttttttattcagaagattccgaggagcggggacgacgacgacgtcctgctgctcctgcatgcatgtagtcctctacgcacgacggcggtcgccgcagctcggcgcgggctcctcctcctcggcggccgggccggcgacgaggtgctcgtagacgacgccggagaggccggcgccgaccatgggccccacccagtacacccattggtgtctccagcgacgggagcccacgacggcgggcccgaacgcgcgcgccggattcatcacggcgccctccagcgcgccgcaggccagcacgttagcccccgccaggagccccacggcgagcggcgccgccagcgctccggcgccggcgcggaccctccgcgctttgtccatcaccgtcgcaaagtaggcgtacatgagcccgaacgccatggccgcctccagcaccgccgcgttccatccgctcacgccccccgccagcgcgtactccggcagatgctgcgtgaacgcgcgcgcgtgcaccaagcccacatgtgtcagtcggcgtcaatattgtagcacagctgcataaggtcaggcggcggatcgagtacgtaccatccctccggtggcgagcctgagcacgagcgcggcggcgacggcgccgagcagctgcgcggcccagtagacgagggagcggacgaggcagatccggccggcgagcagcgcgccgaaggtgacggccgggttgacgtggccgccggagatgttggcggcgcaccccactgcgcccgcgagcgcgagggcgtgcgcgagcgccaccgccaccaggccgccgccgcccttgtcatggtggtgcatcctccctgcgcgcgcgcggcaccggtgcacacgtttacgacgtacgacgagtgaggagacacgcgcgacgacaagcacacagcatgcaccgttaatttatacacagtatatatataacgtaagtaggtaggtacgtaccgagagagagcgtggcaccctcggcggcgaagacgaagatggcggtggcgaggagttcggcggccgcgtggcgcagcgtggcggggtctttggccgtagccaggtggccgacggtgaaccggcgccgtactgccctgatcatattcatggctgccagctgatggatcgatctatctagttagctgttagctagctaggttaaggaatatccggcctcgttaggccggcgagctaggccgcgtgagccgcgccgatcttgtttggacaacgatgtgtgtgtgtgtgagaggggcttgtcctcctgcggcgcgggcggcaagggtgcttataacgcgcgcgcgggtggccggaaccggaagagacgacggagcgcgtcactttttggagcgtgcagcgattgcatgcgtacgtggtgcctcgtcaggcacatgccggccatatcctatcggttgtcggaggaacaaagcacggccgtcgtcgtcgatgcacctgcttgcgttggcagcggttcatgctttgcgtgcgtcgttttggccaaattaaagtggctttatttcttcgtctcgtccccgctcccgggtttgagtctcagtctctgtgtgctgccctttgttagattttatacttatatgcaggattataattagcctaattactgttatacagtagactttttctagttatattttaatctagaaaaataatattacataattaatgacaatatgtaggtgtacgcagggatagtaatcgattatcaagatctaaatgtttatttacaatttattttgttagggtcccaaattaattttagtttaaaagtaaatagaaatatggcccgatatgattcttaaattatatagtataaagtttagagtccatggtcacatttaggtatacgtgtgatgtaatatgtttactatgaatataatggatatatgcataattgataacaattgaaaaggggaccatagcctagatcagatatatggttgattgatataattggcccagtcgacgcaatgcagaattgtagcagtgtcgatcgaacagtagtgtcgatgacactcccataaatgtgattgcacatcacttagaggtttaggctatctcccgcagcttatctatttccatgcccatattcaaacttcactctacgaacagtgcattctacaatgcagaacaatgcaacatagtatttttggtaaactttgggtaaactgctgcagatgaccttactcttgcaaggtccatgcatgtagagcctcacaatggagatactaccagcaaaatcacagatgagaagggataggtctcctaagggcatgtacaatctagagactctgactcgattttttaagtaaaaaaaacatcaaagagactatataatacaatcttgagtctctaaatcataaaaacagtcataatacaatatgtatagagtcatgtagaacaaacttttcgtgaagagtccgtcttaattttttttacttaaccttctagagacctctcaagagacatctcatttaattaggttatacatgcactaatgcactaaggaagtgccaggttcaccgaacatggattgtgacctaatgggctacgatggccaacaatccaacagtttcagctaactaacgctttgatgatcaccattctgcggttacagccttacaggtaactgagcgtcctttgaatgcctgatggctcgacacgccacaccgtggctaggcccggtctggctaggcgaggccagcgtatacgagtctccttttcctacccagaaaatacacaccaaatccacctcttaaggccttgttccgttaattccattagccataaattggatgtgattggaaaatattaagaagaagcttgacttgcttgtgatttaaactcacccaatctcactcaatccacatgaattgagagctaaccgaacaagctctaagttagttacagttttgctccaccgacaatgttggattaaactctttaactcccacctagcatctattatgggtcatgtaatattaaatgaaccaaatggtctgggccattaaatctagtaatctccaccaaatatttcgaggcacacaataaatactctcaagtggttttttatatactatttcggtggcgattgttaagttaaacatccacatagaactaaggcaacacttatccacaactcaacaatggactatattttgaattgacaattttgtgcaaacaagcctgaccaaagctcttaagtcatattaaggtgcaaaagcatctcccatggtttgaagtgtgtaagactatccctagtacattacccatcctcat

SEQ ID NO: 24823 - DNA, 479 bp, Zea mays
ggcgatcgaactacacccagcgcacaagccagattattgaagcaaacaaggacataagtagaagacggtaagagtgcatgcatgaaacattaattctactcatgatcgaccacgacacacaacaattgagcacgcatgcaagctgtttttttattcagaagatcccgaggagcggggacgacgacgacgtcctgctgctcctgcatgcatgtagtcctctacgcaccagctcggcgcgggctcctcctcctcctcggcggccgggccggcgacgaggtgctcgtagacgacgccggagaggccggcgccgaccatgggccccacccagtacacccattggtgtctccagcgacgggagcccacgacggcgggcccgaacgcgcgcgccggattcatcacggcgccctccagcgcgccgcaggccagcacgttggcccccgccaggagccccacgcggagcggcgccgccagcgctccgg

SEQ ID NO: 24824 - DNA, 1217 bp, Zea mays
attgggtacccggccccccctcgggttttttttttttttttttttcgatcgttttacacccagcgcacaagccagattattgaagcaaacaaggacataagtagaagacggtaagagtgcatgcatgaaacattaattctactcatgatcgaccacgacacacaacaattgagcacgcatgcaagctgttttttttattcagaagattccgaggagcggggacgacgacgacgtcctgctgctcctgcatgcatgtagtcctctacgcacgacggcggtcgccgcagctcggcgcgggctcctcctcctcggcggccgggccggcgacgaggtgctcgtagacgacgccggagaggccggcgccgaccatgggccccacccagtacacccattggtgtctccagcgacgggagcccacgacggcgggcccgaacgcgcgcgccggattcatcacggcgccctccagcgcgccgcaggccagcacgttggcccccgccagaagccccacggcgagcggcgccgccagcgctccggcgccggcgcggaccctccgcgctttgtccatcaccgtcgcaaagtaggcgtacatgagcccgaacgccatggccgcctccagcaccgccgcgttccatccgctcacgccccccgccagcgcgtactccggcagatgcatccctccggtggcgagcctgagcacgagcgcggcggcgacggcgccgagcagctgcgcggcccagtagacgagggagcggacgaggcagatccggccggcgagcagcgcgccgaaggtgacggccgggttgacgtggccgccggagatgttggcggcgcaccccactgcggccgcgagcgcgagggcgtgcgcgagcgccaccgccaccaggccgccgccgcccttgtcatggtggtgcatcctcccgagagagagcgtggcaccctcggcggcgaagacgaagatggcggtggcgaggagttcggcggccgcgtggcgcagcgtggcggggtctttggccgtagccaggtggccgacggtgaaccggcgccgtactgccctgatcatattcatggctgccagctgatggatcgatctatctagttagctgttagctagctaggttaaggaatatccggcctcgttaggccggcgagctaggccgcgtgagccgcgccgatcttgtttggacaacgatgtgtgtgtgtgtgacgggcgcgcgtag

SEQ ID NO: 24825 - DNA, 1158 bp, Zea mays
  misc_feature (4)..(4): n is a, c, g, or t
  misc_feature (19)..(19): n is a, c, g, or t
  misc_feature (36)..(36): n is a, c, g, or t
cggnacgcccgtgggcggnacgcccgtgggtttttnttatttgaagcaaacaaggacataagtagaagacggtaagagtgcatgcatgaaacattaattctactcatgatcgaccacgacacacaacaattgagcacgcatgcaagctgtttttttttattcagaagattccgaggagcggggacgacgacgacgtcctgctgctcctgcatgcatgtagtcctctacgcacgacggcggtcgccgcagctcggcgcgggctcctcctcctcctcggcggccgggccggcgacgaggtgctcgtagacgacgccggagaggccggcgccgaccatgggccccacccagtacacccattggtgtctccagcgacgggagcccacgacggcgggcccgaacgcgcgcgccggattcatcacggcgccctccagcgcgccgcaggccagcacgttggcccccgccaggagccccacggcgagcggcgccgccagcgctccggcgccggcgcggaccctccgcgctttgtccatcaccgtcgcaaagtaggcgtacatgagcccgaacgccatggccgcctccagcaccgccgcgttccatccgctcacgcccccggccagcgcgtactccggcagatgcatccctccggtggcgagcctgagcacgagcgcggcggcgacggcgccgagcagctgcgcggcccagtagacgagggagcggacgaggcagatccggccggcgagcagcgcgccgaaggtgacggccgggttgacgtggccgccggagatgttggcggcgcaccccacggcggccgcgagcgcgagggcgtgcgcgagcgccaccgccaccaggccgccgccgcccttgtcatggtggtgcatcctcccgagagagagcgtggcgccctcggcggcgaagacgaagatggcggtggcgaggagttcggcggccgcgtggcgcagcgtggcggggtccttggccgtagccaggtggccgacggtgaaccggcgccgtactgccctgatcatattcatggctgccagctgatggatcggtctatctagtcagcgggttaaggaatatccggcctagctcgttaggccgccgtgagcagcgccgctcttgtttggacaacgatgtgtgtgtgagagagaggcttgt

SEQ ID NO: 24826 - DNA, 986 bp, Zea mays
acggtttcccggcgctcgtggcctaacacaagcgagcctcttcactcgctctcaaaacccaggctgtgagaggagtggaaatctagcttataagctcaccacggcttcctccggctagagaggtggtactaaaatcgggcgctgacgattgggctcctgacacttcatcaggtttgcagaaacatctagtggatcagctcgtacgatcgcgtgtatatatggcatctactgttcatcaggtttcctgatattcctgagtgatttttcgcgtgtatatatggcgtccttggttgctgggcactggcagtgtagctagagttgcttcctggtttgtgggtggtcgcatgtatcttgggtgcttccaaccgtatcacattgtgttcctcatcagtaaacagaagcaaataagcaattcactctttgtaaattatgacatcttattccattctctacggatactccatcgacccccgagacagctatatttataaaatcgctgcacagcagcagtgcggcgctgcgaatgattcacacacgtacggctcacagctagtggccgtagagttcctggtgggcgacgacgagccgcgcccgcgaccgccgctcgatggtgtagcgcagctgctccttcacccgccgcagcgccaggagaacggactccacgtcgccgcgcccagcggcggcctgtcgctgcggctcagctagaacgatcgcgagcctgtcgctctcctcctcttcttcctcctcgtgactcctgccacggcggacctctcctgcctgcgttcttggaccgccgcctgccgcggctgcaacgagctggggatctaccagcaccagcgctagcctgtcgtcgctctcgctgacggcttcttcgggtttagctgggccacagccacgggatgatgcatcgaggtgttgcctccctcaaccacgcatcgcacgagtcatatatgcaggctgcagacagtagaacgcgtggaactggg

SEQ ID NO: 24827 - DNA, 1144 bp, Zea mays
  misc_feature (164)..(164): n is a, c, g, or t
ctcaaaaaaaaaaaaacagacttttagaggaggaatgcaagtctggaagaaggcagttcctctggccaaagacagtagtaacaaggaagctaaaaatccagcacctacgatgatgaaacccaaaacaaatacttaaactaagcaagtctctctctctctttttnaccaacaagaaagttcactaccaattggcactgagttgatctgcacgcgaacgtacctctctgaatcacggtcaccgccgccgctccccgccgaacggcagttggtggtgtgtccggcaggatccatgcaaggaccaggctgggattgctctgacgcaacggagcaccagctcccgtcctgggaggacgagttgagctgggtgcacgatccctccgacgacacgtccctgtcggcgtctccggaaggagcggatggcgcagagccatcggtggtcaacgagccagggccgttcctctcctccgcctccgcccccacctccgcctccggcgcctggtgaccggagcgtccgttggagtacagcgacccggtggagccgtccgagagcccgacgtccagaaccttgagggactccagcttcctgatggccctcctgagcctccgctccgccctgttcctcaccttgacctcgtcggcgagcttcctctctagctcgtccagccttttggccagttggtcggcctcctcctttgcagccttggacgccaccctctctgcgagaagcctccctctcaggcactccaccgtcctcatgccaccgccaccgccatccccaccgctcaccctgcattgcgccgcctgcgcagccattctccgatccttcccgactctgacttttgagcttgtgatattgataccggatgttgcttgggctgtgggagactgggagtgctgtgggtaggtaatctgcgcagcctttggcggcggccccggggcgcttctgcttcttgcgtgcggctctgacttttgagctcgcgggcaggggacggcgcggcggcttgaggcggaaggtgtcggacggacgcctctgttcggggcgtgaggcgtgaggtgacgaggcaccgcgccgcgccacagcccacaggcacagagcactacgctccctgtgggatgtctgggacactgggagaggacagagggg

SEQ ID NO: 24828 - DNA, 1042 bp, Zea mays
ttttttttttttttttgagcaattcactctttgtaaattatgacatcttattccattctcgacccccgagacagctatatttataaaatcgctgcacagcagcagtgcagcgctgcgaatgattcacacgcacggctcacagctagtggccgtagagttcctggtgggcgacgacgagccgcgcccgcgaccgccgctcgatggtgtagcgcagctgctccttcacccgccgcagcgccaggagaacggactccacgtcgccgcgcccagcggcggcctgtcgctgcggctcagctagaacgatcgcgagcctgtcgctctcctcttcttcttcctcgtgactcctcctgccacggcggacctctcctgcttgcgttcttggaccgccgcctgccggggctgcaacgagctggggatctaccagcaccagcgctagcgtgtcgtcgctctcgttgaaggcttcttcggatttagctgggccacagctaccggatgatgcatcgaggtgttgcctctctgaatcacggtcaccgccgccgctccccgccgaactgcagttggtggtgtgtccggcaggatccatgcaaggaccaggctgggattgctctgacgcgacggagcaccagctcccgtcctgggaggacgagttgagctgggtgcacgatccctccgacgacacgtccctgtcggcgtctccggaaggagcggatggcgcagagccaacggtggtcaacgagccagggccgttcctctcctccgcccccacctccggcgcctggtgaccggagcgtccgttggaggacagcgacccggtggagccgtccgagagcccgacgtccagaaccttgagggactccagcttcctgatggccctccggagcctcctctccgccctgttcctcaccttgacctcgtcggcgagcttcctctctagctcgtccagctgatgcagccggccccaagcccccaaccgaccgtcagaatcgacagaagagaagagagttggatcagtatatcgcgaactgctgcagcaaatgaaggt

SEQ ID NO: 24829 - DNA, 1384 bp, Zea mays
  misc_feature (1345)..(1345): n is a, c, g, or t
aaacagaagcaaataagcaattcactctttgtaaattatgacatcttattccattctctacggatactccatcgacccccgagacagctatatttataaaatcgctgcacagcagcagtgcagcgctgcgaatgattcacacacgtacggctcacagctagtggccgtagagttcctggtgggcgacgacgagccgcgcccgcgaccgccgctcgatggtgtagcgcagctgctccttcacccgccgcagcgccaggagaacggactccacgtcgccgcgcccagtggcggcctgtcgctgcggctcagctagaacgatcgcgagcctgtcggtctcctcctcttcttcctcctcgtgactcctgccacggcggacctctcctgcctgcgttcttggaccgccgcctgccgcggctgcaacgagctggggatctaccagcaccagcgctagcctgtcgtcgctctcgctgacggcttcttcgggtttagctgggccacagccacgggatgatgcatcgaggtgttgcctctctgaaccacggtcaccgccgccgctccccgccgaacggcagttggtggtgtgtccggcaggatccatgcaaggaccaggctgggattgttctgacgcaacggagcaccagctcccgtcctgggaggacgagttgagctgggtgcacgatccctccgacgacacgaccctgtcggcgtctccggaaggagcggatggcgcagagccatcggtggtcaacgagccagggccgttcctctcctccccctccgcccccacctccgcctccggcgcctggtgaccggagcgtccgttggagtacagcgacccggtgggagccgtccgagagcccgacgtccagaacccttgagggactccagcttcctgatggccctcctgagcctccgctccgccctgttcctcaccttgacctcgtcggcgagcttcctctctagctcgtccagccctttggccagttggtcggcctcctcctttgcagccttggacgccaccctctctgcgagaagcctccctctcaggcactccaccgtcctcatgccaccgccaccgccatccccaccgctcaccctgcattgcgccgcctgcgcagccattctccgatccttcccgactctgacttttgagcttgtgatattgataccggatgttgcttgggctgtgggagactgggagtgctgtgggtaggtaatctgcgcagcctttggcggcggccccggggcgcttctgcttcttgcgtgcggctctgacttttgagctcgcgggcaggggacggcgcggcggcttgaggcggaaggtgtcggacggacgcctctgtcnggggcgtgaggcgtgaggtgacgaggcaccgcgccgcgc

SEQ ID NO: 24830 - DNA, 829 bp, Zea mays
gcacgaggccacatcggttggcgataatttcgtgtattcgccttttttaaaaggaatcgccaccgactggcgcacgggagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctaggtacttacgccgggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccaccctctcctgttaatgatctgaatgtaaacatggtggcggtcatcggtgtaaatttagacatggctatttgcatctaagatccatcctctcctgttaataatgtttggagactacgtacgcctgaagcaatgcaatagcaactttgcgagaaaaaatgcagcaaaaaaggtcttttagctttgaggctttgagtagagttgtgtgtgaggccagttctcccactgctatccgttgctgctccaaagtccagcccaacgcagccctgcaaatcccgcacctggcaaca

SEQ ID NO: 24831 - DNA, 587 bp, Zea mays
  misc_feature (584)..(586): n is a, c, g, or t
ctggcgcacgggagccacggagaggcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagctgaaggcagctggtgcttcatggatcctcctgggggtcttcggcctcatctggtccctctacaccatctacacctctgacctcgacgaggacgaggagtccggtggcctctcgctctagatccacctcctctcctgttaatgatctgaatgtaaacatggtggtggtcatcggtgtaaatttagacatggctatttgcatctaagatccatcctctcctgttggtttaaaagaaagaagcaaaaaaaacnnng

SEQ ID NO: 24832 - DNA, 737 bp, Zea mays
cgatttgcagccacatcggttggcattaatttcgtgtattcgcctttttttaaaaggaatcgccaccgactggcgcacgggagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccacctcctctcctgttaatgatctgaatgtaaacatggtggtggtcatcggtgtaaatttagacatggctatttgcatctaagatccatcctctcctgttaataatgtttggagactacgtacgcctgaagcaatagcaactttgcgagaaaacttgctgcacacaattgtactagagagcccgcccttgcccatccacccctcgc

SEQ ID NO: 24833 - DNA, 920 bp, Zea mays
ccggccggggcccacgatttgcagccacatcgccggccgccaacttcggggtattcgccttttttaaaaggagtcgccaccccggccggcccgggagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccacctcctctcctgttaatgatctgaatgtaaacatggtggcggtcatcggtgtaaatttagacatggctatttgcatctaagatccatcctctcctgttaataatgtttggagactacgtacgcctgaagcaatagcaactttgcgagaaaacttgctgcaaaaaaaaaaaaaaaaaaaagcggcctttgaggctttgagtagagttgtgtgtgtggccagttgtcccactgctatccgttgctgctccaaagtcagcccaacgcagtcctgcaaatcccgcactggcaacactgcaccatcgctagggtcccgaccagtggcagtggacaccaccacgacattcgtcattacacacgtctcatc

SEQ ID NO: 24834 - DNA, 1004 bp, Zea mays
  misc_feature (999)..(999): n is a, c, g, or t
gtcttgcgaagcccacatccacatcctcctctcctctggccctcttccccgcttcattcgctagacgacacgacaccgcgttcagccgctctagaaccctagctccccgccccgcgagatggccactgccgacggcgagccccagcccgtggccaccgaccccgcccaggtccaggctccggctccggcaccggcaccctacccctccccggccaagcgcaagcccgaggcggatgcggaagccgacgccaacctcgcgccccctaaagccgcgcgtcccgacgtcgacgaggaggccgccgctatggccgaggctgccagggccagtgctcgcgcggctgacaagggtaagggcaagatggtagtcgaggaggaggaggaggaggaggaagacgacagcgaggagagcagcgacgacgacgagggcggcggcggcggcagcagcagcgatgacgacgagctcgttgaagacccgatggccgaggtagacctcagcaacatcctcccctcgcggacccgccgccgcgcccccccgcagcccggggcgtacctcgtcactccggaggaggctgccgcggaggacgacgacgacgacgctgacgtggttcctgaggaggatgagggagcggagggagaggagagcgattaaggctacctcggcacggactcactaggaatgatgaatggtggcttttggtgctgggtatctgtaccatcctgtgcctggggaccctagtagatgaacgtgctttctgttaggttttgttcgtggatagcctaatcttcattcggcaatcattatgagttgtgcctgtcaccatgatttatatggcatcagtagtagggtgttacttgagggacacacgtttagttctaactttgtagtaaggcttagtatctggtgaacgatcatgattgaacagttaacggttcgcctctgcggctccagacttgcagcttccagcagctattgaccttatgcttttgatggcgacgcanaaaaa

SEQ ID NO: 24835 - DNA, 1864 bp, Zea mays
ctcgaggccggccggggttggactggacgtgcccttatcctcttatcccagcagccggcgcccgccgcgcgctcgacaaactgccgcgaactctcccggcctcacactccttgcgcccgccgcggcagatgccgctcaccggcattgccctcacgcctctcctcgtctcacctctcgcgccttccccgcgccgtagccgtgtagccacttccgccgcgagaaggccaagggctctccagcgagctcggtgctcggctacagccgcttccggtgaagccggtgagctgtcgcgcgcgacactgctatggagggcggcgaagctacccatctactccgtagcgctaataccactcacagtagggagcgcttctgcttattatcatgcaggcttattctttaccaagcgctattttgttctcctgacagcagcagtcctcgtgatcacttggctcaatctcagcaatgatgtttatgactcggatacaggggctgatagggacaagaaagaatctgttgtcagcattactggcagccgagcaatgacacaaaatgcggcgaacttttcccttttcctcggctttgcagggctactttgggcctttgcagaagccaaggatatcagattcattttattggtgatctctgcaatcttctgtggttatgtttaccagtgtcctccattccgattaagctaccaaggactaggcgagccgttgtgtttcgctgcatttggtcctttggcaaccacagccttttacttctcaaacagcagcttaaatacttcgagcggaggagcggctcttctccctctcactaaaacagttatagcttcatctgttctcgtcgggctgacaactactctgatactcttctgcagccatttccatcagatcgatggagatctcgccgttggaaagatgtctcctctggtaagaatcggcactaaagcaggatcgcggatagtgtcgattgggattgtcatgctttacattctcttggctacgtttgggacatgcggatctctcccgccatcttgcattgtcctctgtgcccttactctgcccatgggcaaaacggtcgtggactacgtgctgaaacatcacgaggacaacgcgaagatattcatggcgaagtactactgcgtgcgcctgcacgcgctgtttgggatggcactggcctctggtttggtcttggcccgaaatggtatattagcctgacagacaggctcataggcggcgctgaaatccaggagagggtccagagcaccctggagtttcagaatcagcgagcaccctgttcctcaatttatgttctgaatctgaactacttctgattcgactatcgaacaggccgatgagaatggggcgcagtactgagcagctgcagttttgccaagaaacggtggagggaatgggccctaggagaagtagaactactacagcgtcagaactcagatgcacaccggcccgtatcggacggcaagttcggtgctcgagttcatttggttcagcgtccttgtacgctttggtccgctctcgggggcttgcttgctcgtgcacggtcagactgccgttgcgccggggtccgggggatgccagtgtatgtatgcatatggattgaatcccaagcaaggacgagtcatgcactcatgtacaagcattacttctgtgcacagacgaccatacagattatatgagatctcactcacaccttttttttttgcatttggtttagccagcgaccggtaattgcttgtcactgcagcgtcctgtttcgacatgtctgtcgtggcaagctagagtattaggctgtccgcagccgttccccctaaaaaaaaaaaaaaaaaaaaaaagggcggccgctc

SEQ ID NO: 24836 - DNA, 2308 bp, Zea mays
atataacatctcattacaacagacccttcaacataaagttaacttgtctagtgagagttgctagccaaatttggctagtgagggagttaatttagagagccggatagcttagcaagtgaaatgagtctgttggagaactgttatgctattaagtagctaaaatttagcttgacaagttatttagctagtattttggagatgcttattatacagaataacccgccataccttgtccgtagatatcgacaaactcactcaagagggcaaccttctaaaagattcctctatcctactggcaaatcatagattagctccacgcaccgacactcctacttctcccccctctcttgaagctaaaggagtccaaacgaagtctaaccacagacgctcccatcacaagcaagcaagataaaagcaacttgacagaccccaatcccacgacactagactggattcaagcagccggtagcagaatcagtcaccagaacccacaaatcgaagatgcgcacgcacgcacgcacgcacctgtgtgcgaaccggagccggagcagggaggggaaaggagcgaagccgaggaactatttgggggaacgagcggagcgtagaagtaggcgagcacactgacgggcgcagatttttctctcctcaggttcgtctccggtgcgcggtggcgtggggattgtctcggggaggaggcaacgtgggcggctgggcggccacagcgtcgataaggaagagatgagcccacatgacatagacgggagtagtcgccaggtcttgaggcgggtgaaatgtccggaattcctcctggccagtgcaaaaatctatgaaatgtccagagcgattggagtttgtgcttttcttgtgtcgttttttattatgtttttttatttttaatgacttgattcgcgtaagattggaaggagggcgacggctagtggctggtagcagcggtagctgtttgtaattgtaacccagagcgcccgtttctacttccagacgaattcatgatttcacattgcaactcctgtgtttgggtggcatgaagccactccacgacttgcaacacatgcagggtctgaggaccgcatatcagttaaccgccaccacatcagtgaaacatttctccaggtgttccacaatccacgaaagtgcgatgatggcactgtgagcgagagagagagaacggtgtgactttagagcaaaacatttagtataaattcagattcttttctttttttgattttttaatactaaacggataaaatagcgtcatagccagaccggccgttttggcagtagagattgcgaggaagggagtgaaagcgaacgctacttgctagatgaacaatgcaacacgcctgaaagcgctatatctcttcgaacttgtgtatcattaccacctagtaacttgtactattattaccacctagtaacttgtattgacaatctagctaaagcatgtgtttgtcacctaaaaaacatgtgtttattttaattttatttttttgaactaagggagatcatgtaaaaaaattaaaactatcaataaaactgaaccaaaggatgtttaataaggagcaaaagggaaatcatccgaataatagctagtgcctattttggggggtaaaagtaaccattaaaccctctcgttttttttttttttttgcaactcaaaaccttcatatatttttgcaactcaaaaccttcatttcagaagggaacatgtggctcgtaagcatctttcatgttgacacaaagggctaccccaggtaacaaaggtaccatgatcgcatcatcaattcatcatttgtatgacataataaaacactcttgacaacaaatcaatagccgccttcacaaaacaattgtttgcgttggttctctttatgacatgctgctcttcccacggcatgtcatcctctggccccacgtatggcatcatcagaaagatgtcaaggaacgtaagacgtatcccctcgcagagttttccctttggatacgtcgacacaggactgagttaaaccgtagagttttcccttcatgcttttcgtttgctgcgcttcaggtcgtacacaacacatgcatccgcagcagttttcatctggatgacattggtgacttgtttcactgcccagccaactaatgtggaaataaacaccaagataatgatggggctttggttcaggagacctttgcatgcactaagcaagcttgttgacttctcatcagcaaagagaaagaggataatatacaaaacctcacaagaaacacagcagaaggcccccacggcctggtcccataatat

SEQ ID NO: 24837 - DNA, 4104 bp, Zea mays
  misc_feature (21)..(22): n is a, c, g, or t
  misc_feature (884)..(905): n is a, c, g, or t
  misc_feature (985)..(989): n is a, c, g, or t
  misc_feature (1148)..(1152): n is a, c, g, or t
  misc_feature (1181)..(1186): n is a, c, g, or t
  misc_feature (1283)..(1287): n is a, c, g, or t
  misc_feature (1382)..(1386): n is a, c, g, or t
  misc_feature (1397)..(1423): n is a, c, g, or t
  misc_feature (3019)..(3041): n is a, c, g, or t
  misc_feature (3132)..(3136): n is a, c, g, or t
  misc_feature (3158)..(3162): n is a, c, g, or t
  misc_feature (3183)..(3185): n is a, c, g, or t
ccacgcgtccgattcctcaannagcggtggggccaacgccccgtccccgccgaaagtttcccgcccgagcccctcgaaccctagtaccatcaccgactggcgacgcctcgccggcggccggcgagatgcacatcaaggaggtaactctcgaggggttcaagtcgtacgcgggacggactgtggtgccggggttcgacccgctgttcaacgccatcaccgggctcaacggttccggcaagtccaacatcctcgactccatctgcttcgtgctcggcatcacagatctccgtcaggtacgcgctgcctcgctccaggagctcgtctacaagcaaggccaggccggggtcaccaaggctaccgtgtccatcgtcttcgacaattccgaccgctcccgctccccgctcggctacgaggactccccggagatcactgtcacgcgccagattgttgttggtggaaggaacaagtaccttatcaatggccatcttgcacaaccttcccgggtgcagacccttttccactcagtgcagcttaatgtaaacaatcctcattttctaattatgcaagggcgcataacaaaagtgctgaacatgaagcctccagaaattttgtcaatgttagaagaggcagcaggtacaagaatgtacgaaatgaagaaagaatctgctcttaagacacttgaaaagaagcagaataaagttgatgagattaataaactccttgatgttgaaatcctccctgcactagagaaacttagaaaagagcggtgtcaatacatgaaatgggccaatggcaatgctgaactggataggctcaaaagattttgtattgcctatgactttgttcaggctgagagagtgcgagatggcgcactgaatgatgtnnnnnnnnnnnnnnnnnnnnnngttgagctggatgaaactacagaaaacataaaagcagctatacaagaaatggacaataacatttctaccttggctgctgnnnnngaagctaaagtaggtggtgaaatgaaggttctgtcagacaaagtggataaactatcacatgtacttatcaaggaaacttctgtgatgaataatcaagaggaaaccctgaagtctgaggaaaagggtgctgagaagattctcacaaacattgaggacatnnnnnggtctatactcgagagagatgctgctgtnnnnnntgtagagaatgaggcttctgacatgaaaagaagagcagaggatctcacaaaggagttggacgagaaggagaaagaataccagggtgtgctagcaggnnnnngcagtgcaaatgagaagaaatgccttgaagatcaactgagagatgcaaaagctgcagttggagatgcagaatctggactaaagcagctagctacnnnnntaaagcattcnnnnnnnnnnnnnnnnnnnnnnnnnnntcgcggggtatccaagcgtgatgaggctattgctgctgagaatgagctgaaaccaaggacaaaagacttagaaggtatcaaggcatccatgggatctattaattatgatgagggtcagatggaagctttgcaaaaggaccgttctgcagagttagaaattattcaaaaattaaaggatcgtgttcgtaacctttctggtgagcttgctaatgttcacttcagttatcgagaccctgaaagaaattttgacagatcaaaagtcaaaggggttgttgcacgtcttattaggattaaggacagctcaacagcaacagcactggaggttgctgcaggtgggaggttattcaatgtggttgttgacactgaagaaactggaaagcaacttttaaaaaatggggatctacgaagtagagtaaccatcatacctttgaacaaaatccaaacttacatgatacctgacagagttcagcagacagctcgtagactggttggtcctgacaatgtaacattagctctagaattggttggatatggtgaggaagtaaagaatgccgtggcttttgtctttggctcaacatttgtgtgtcgtaatatggatgcggcaaaagaggttgcgtttaataggcaaattagcagtactacggtgactcttgagggtgacacttatcagccaagtggtcttttgactggaggtagtaaagggggtagagggaacttgctaaggaaactcgacgaactagctaaagctgaggctgatctatctgatcatgagaaaaagctctttgtcattgaacagcagattggagcccttttaccattgcagaaaaggcacactgagttgaaatctcagtttgaactgaagtcatatgatctctcgctgtttcagaacagagttgagcaaaatgaacatcacaagttaggtgagctcgtaaagaaaattgaacaagagcttcaagaatctaaacaagagttgacagaaaagcaagtgcagcatgaaaaatgtgtgtccacagtttctgagttagagaaaactatcaaaacttatggcacggaacgagagggcaaactcaaagcgctggaaaaaagaatcaaatcaattgaatcagcctctccctgtcactttcatcagccaaaggcttatgaaagtgacagggagaggctgatcatggagaaagatgcggttgttggtgagcttgctacactggaagagcagctaacgacttcaaaagctcagattacttctctgtctgaaaccttggaaaaacagaaggacaaggttacatccataaagcaagattatgatcaagctgaaagtgagctcaacgttgggcgttctaaactgaaggaatgtgactcacagataaaccgtatggccaaggaacagcagaaacttcaacagaagttaagtgattcaaatgttgagaggaagaaaatggaaaatgaggttaagaggatggagatagagcagaaggattgctcttcaatagtcgataagctagtcgagaaatataattggattgcaactgagaaacaattgtttgggaaaagtggtacagattatgattttgaatcttgtgaaccacataaagcccgagnnnnnnnnnnnnnnnnnnnnnnncaacaatccagtcttgagaagagggtcaataagaaagtaatggcaatgtttgagaaggcggaggatgagtacaatgatttgatgtcaaagnnnnncatcatcgagaatgacaaggcnnnnntcaagaaagtgatagaggagnnnaaagagatcgttcggcacgacttgaaggtcacttggctcaaagttaacaaggatttcgggtctatattcagtactcttttacctggtacaatggcaaaacttgatcctccagaaggggtacttttttggatggtcttgaagttcgtgtggcatttgggacagtttggaagcagtctctgtctgaacttagtggaggacaacgatcccttcttgctcttagtcttatcctggctctgcttctttttaaacctgcaccactttacatattggacgaggttgatgctgctcttgatctgagccacactcaaaacattggtagaatgatcaaggctcattttccgcactctcagttcatagttgtctctttaaaagagggtatgttcaacaacgccaatgtgatatttcgaacaaaatttgttgatggtgtgtccaccgtgacacgaacagtgccttcgaaacagagatgaccagtttacacatcatgcatcttctgaaccaaaactaggcatataattccaaatctgtcattttaaggagctgctataatcaaacattttcgctgtttattcagccaggaaaattattccatgaaagctgaaccccacaattacttgacgctgatgcctcaagcccctcgcttgtcaggcaatgacatcaaaataggtgctgtaactgtaatctcatggcgtgacgttcatgatgacctcgactggcttctacattatgcgctttcttctgacctgatgtgtaattagcggttgaactattttgtgttgaaggtcgaccgtgtagcatgtatgtaacagccatttataaccaaggtcatgtataattctgacttgcaaatttaccctatgttgatttaccttttattacttagaacaaaaatctcatcatagttttagaaagtcaatgctct

SEQ ID NO: 24838 - DNA, 2000 bp, Zea mays
  misc_feature (39)..(39): n is a, c, g, or t
  misc_feature (146)..(146): n is a, c, g, or t
gagtaagtcacaaattctttagtaagatacgttcatttnaaaaagttaagtatgtgattgcttttgatgaagatactggacatctttcatagagggtatattaagatcagttctgtgaattcttactctgatagtggccataactngttcttttatcagtttatgtctactttaacagtcatcctgacaatttgatctttaatatatcccatatttaggcttatgaaagtgacagggagaggctgatcatggagaaagatgcggttgttggtgagcttgctacactggaagagcagctaacgacttcaaaagctcagattacttctctgtctgaaaccttggaaaaacagaaggacaaggttttgcaagatgctttattatatttactttgtacttggtgttgttcctgagctttgcatttaattagttaaatatgctttgtgctcatgaaacaggttacatccataaagcaagattatgatcaagctgaaagtgagctcaacgttgggcgttctaaactgaaggaatgtgactcacagataaaccgtatggccaaggaacagcagaaacttcaacagaagttaagtgattcaaatgttgagaggaagaaaatggaaaatgaggtagttcctggttcttctgcattttgtactttataattgattgcttcaacacgttgtagaggaagaaaatggaaaatgaggttaagaggatggagatagagcagaaggattgctcttcaatagtcgataagctagtcgagaaatataattggattgcaactgagaaacaattgtttgggaaaagtggtacagattatgattttgaatcttgtgaaccacataaagcccgagaggaacttgaaaatcttcaagctcaacaatccagtcttgagaagagggtcaataagaaagtaatggcaatgtttgagaaggcggaggatgagtacaatgatttgatgtcaaagaaaaacatcatcgagaatgacaaggcaaaaatcaagaaagtgatagaggagttggatgagaagaagaaggaaacattgaaggtcacttggctcaaagtaaacaaggatttcgggtctatattcagtactcttttacctggtacaatggcaaaacttgatcctccagaaggtggtacttttttggatggtcttgaagttcgtgtggcatttgggacagtttggaagcagtctctgtctgaacttagtggaggacaacgatcccttcttgctcttagtcttatcctggctctgcttctttttaaacctgcaccactttacatattggacgaggttgatgctgctcttgatctgagccacactcaaaacattggtagaatgatcaaggctcattttccgcactctcagttcatagttgtctctttaaaagagggtatgttcaacaacgccaatgtgatatttcgaacaaaatttgttgatggtgtgtccaccgtgacacgaacagtgccttcgaaacagagatgaccagtttacacatcatgcatcttctgaaccaaaactaggcatacaattccaaaactgtcattttaaggagctgctataatcaaacattttcgctgtttattcagccatgtttattcagccaggaaaattattccatgaaagctgaaccccacaattacttgacgctgatgcctcaagcccctcgcttgtcaggcaatgacatcaaaataggtgctgtaactgtaatctcatggcgtgacgttcatgatgacctcgactggcttctacattatgcgctttcttctgacctgatgtgtaattagcggttgaactattttgtgttgaaggtcgaccgtgtagcatgtatgtaacagccatttataaccaaggtcatgtataattctgacttgcaaatttaccctatgttgatttaccttttattacttagaacaaaaatctcatcatagttttagaaagtcaatgctctaaacacttcataatattattgactatcgtgtgcattgccgagaaa

SEQ ID NO: 24839 - DNA, 1962 bp, Zea mays
  misc_feature (985)..(985): n is a, c, g, or t
  misc_feature (1039)..(1039): n is a, c, g, or t
tttttttttttttttttgcgccgaaccctggcgggtttttaataagaaagtaatacgcgttcttgcgatggagcacatgtagtaagctaggtccaggcttcatgatatggctacaagttgtggaaggagcatgcaaaacagggcgcaggctgttaggacattggaatctaaacgggagatggctttgatttgatgccggggactgcactgcgtcgttgagccagccgtctaggatccggacacttcatctcccatggattggacttgctaggggcttcaccgcgcgcagcatttccttggcgcccccattctccggctggaccgccgcggaggacgcccccttctggcccgatatcgccgacgccagcgcgacgggcatgaggcacaggcccttgctctgcaggtactgcatcgccgtcgtcatgtcgctctccatcagctgcgccacctcctgctcgaacgccgcgccgtcccggacctcggacgacgacggcggcaggctgcctccgcgtgcctgctgctgcctgcctgagcctgacctaggggacagcagaagaccaccaccggagctctcggcctgagactgtgtaaggagcggcacgacggcttccgtcgcgcccagcctgctcatgctgagaaccttcacttgcagctggagaaatttgacgtattcgatgatctcgtcaagcatggatgccttgtcagtcctgttggagttcggaacgagctcctgtagattcttcatcctgtcagagatcttctcccttcggagcctctccgcaatgctgtgtggatcagttgcctggccccggcgagccctgacgcgcggcttaggagctccattcccagcagccccattggccggaaccatgaacggcggcgcattcagcccagttccgccgccgctggcctcgttagacgactgttcaagattacgcgttgcatcaaacgacgagagctgctgcccagagctcaggtgacgcangaccgctgagttccttttgactgagctgcagatcgccaaagtcaaggccaggangcgaacgacagcatctttccagtgttgaactcaacgtcatcctctacatgtagccgcgcattgcctatctgtggatacttgttcacgtccgcgacacaggaggatccacggacgagatcgttgtcgctaaccgcgccgaaaccgaagctccgcgaagtctcttccccggccagcgacgagatccgcgggaacgcggaaggccacgacgcgggctgctctcccaggactaggaaccgcggcggcggcggcaggccggactgctcgctcccgccgctgctgtcgttggaggagctgcacaccaccggcgcgctgtcggcgagcgataccgcgcagggcgcgctcaggaccgggcccagcatgccggccaccagcgcgctgttcacctcgaagccgaggccctcctcctgggtcacggtcacgtcgtcgcccggcaggtgcgcgctcaggaactgctggtgcagctccaagggcggcacgagcgccgtggaggagccgtcttggaggtgaaagcctgcgccttggcctggtgcagcctgagctcccaggtacgcgtacgtccctgcagggtcggcgagggaagtggcgccggcgccggcgcatggccaggatgagccgatgaacatggcgtcctgcggccatgccggttccgggacgaaggggtccacgaacccgtccatcttgctggcttgtggggggtgccagttgacggagacgagggggggaagacaacaaccgcttcagctcccggtcctggctccgctttccgctggggatcggaacggacgagggggagaggcgcggttttgtttcttgtgcctgcctgcgcgcgggtccgtatctttgtgcgcgtcagtagtacgtgccttcgcttcgcgttcctttccctcgatgttcttgtccccggccggcctcgaggtcccaat

SEQ ID NO: 24840 - DNA, 1526 bp, Zea mays
ccgggcctcgagttttttttttttttttttttagataaaagacatcttgcatatatagtcgaccgcaactcattctacacaattacgtacgtcccagttgcgaaatacgtttgcatcgcatcgcgtcgaataatattacaaatgacagtagctccggcacctactacagttacagtacaacactgaatgaatctacagcagatctatcgctcaaaaactctacacgcctgcaccctaccctacgtattctgaggctttcttggtgctgcgggtgacctcccttccatcgtctgcaggcgctgcttcagatgaaagacttcaacctgaagctggaatgcccgtgcgcgttctcctgcaagaactccgcgagtcgagtgcagttccttctgggtctcgtccatgacggccttgaggaacgccacctcgcgctccagccgcacgttgtcggcgtggacggtgttggagaggctgttggcctcctcctgcgccagctccaaccccgtcgccttctccctcagcgcctcgacctccctgtccttctcggccagcctcttctccaggccgtctttgctgtcgatgaccagggacaggttcttctccgcctcgtccttgctcgccagcgccgccgacagctgctcttccagcgccacgttcctcctgaccagggcggccacccttgcgtcctggtggttgttcatgtccgacgagctcctgcccagcagccttctcgctttagcgtcgacgacgacctccggggacgaccggcgcgcgtcgttccgcggtttagggttcgtggccgagggcggttgatgctcggagcactcgtcggcggcgtccttgtacctgtcgtcgtcgatcggtttctgcagcttttgcgccaggctgctgcactcctcttcctgacggaactgcctgcggagcgacgagcccccgaggttcgaggtccgtagcagtgagtccgggaggggtttcctcccgcaggagttctccgctgtggcggcgagaccgctcctcgccgcggagctagtaggatacggtggagcgcagctgctgagatggtcggcgagttcccttgagcctggaggagactcgtcgtacagtaagggttccacctcgggcgcagaccgccagctgaaacagtgctcgttttgcaacaccactagtacttcaaccttcacagatcgcaaagtaacgtcagtttctcatgtactgaaactgatcatagaaatgttcctggtgtttctattgcaaaaaaatatgtggaaggcagaataactaatcctgaaataatgtcaccaaatgagctttccatttctcaatgagattcagttccttcaccttgtcggatggttcctttttgttccctccaaaagcaacaagcacgatcttgtccctgtagtacaatggaaccatgctgaaaccctgcaaaaagttttgggttcaattgtgcagcatgtagagaaatcgttaacatataaataaataaacataaatctcgtggattcttcctatggggactctttttt

SEQ ID NO: 24841 - DNA, 500 bp, Zea mays
gtaccgggccccccctcgtttttttttttttttttttagataaaacacatcttgcatatatagaccgcaactcattgtacacaattacgtacgtcccagttgcgaaatacgtttgcatcgcatcgcgtcgaataatattacaaatgacagtagctccggcacctactacagttacagtacaacactgaatgaatctacagctcaaaaactctctacacgcctgcaccctaccctacgtattctgaggctttcttggtgctgcgggtgacctcccttccatcgtctgcaggcgctgcttcagatgaaagacttcaacctgaagctggaatgcccgtgcgcgttctcctgcaagaactccgcgagtcgagtgcagttccttctgggtctcgtccatgacggccttcaggaacgccacctcgcgctccagccgcacgttgtcggcgtggacggtgttggagaggctgttggcctcctcctgcgccagctccgggggggggggg

SEQ ID NO: 24842 - DNA, 1492 bp, Zea mays
aggagaactgggcaatgaaactcccgaattaactcgctaatagcaaggattagccacacaaaaaatacactgatcaacacacgtttctcccagaggcagggagctgctgtcttgctgaggaaccagctactgccaataccacacactagcttgctgaggaaactatctcgctcgaatcaactgcctcctgtatccctccatctgctccggggctcctcccctcgccctcgccctcgccctcgccgacgcagtccgagccctggaacgagccaccaccaggcttgaacaggcagtcgttctccaggctgtcgagcttctcagcagactctcccttgagcagctggacgacctcagacatcgtgggccgaagctccggcctgtcctgggcgcagacgagcccgacgagcaccacccgcttgagctcctcctcgacgaatccgccgccgagcttggggtcggcgatctcgccgaacctcctggcgcgggccagcgggagcgcccactccgtcacggtctgcttcgcggcggcggtggggctcagcttctccacgggcctcctcccgctggccagctgccagcagcgtgaccccgaagctgaagacgtcgcagctctcggaggccttcccgagcatcgcgtactccggcgccaggtagcccagcgtgcctttcaccttggtggtgacgtgcgtcgcgccgtccgggaccagcttggcgaagccgaagtcggcgacccgcgcctggaagtcggcgtccaggagcacgttgctcgccttcacgtctctgtggatgatgtgcggcgtcgcgctgtggtgcaggtaggcgatcccttccgcggagtccacagcgatcctcatcctcctctcccagctgaggttgcactccgccgcgtgctgcccatggagctgagagtgtatgctcaggttcggcatgtaatcgtagactatcaggcgctcctggccttcggcgcagtacccgcgcaggcttagaaggctcctgtgccgcacgcgtgccagaacctccacctcgacagcgaactccgtttcggccttgttgctccagctcttgagcctcttcacggcgatctgtgatccgtcccagagctggccccagtacacactgccgaacccgccctcgccgagcttgttgtcgtaattgaaattgttcgtcgctgactggagctccttgagtgagaagatccgccacgccgtgtccttcttcttcctcctcctcctgccaggttcagccccgtcagaccgcttgcagcaggaagcccaccccatcgcccgcccgaccgcctgcagcgcctccagagtccagagctcccaggtcacagcgcgagccggcgcgtccccagctagagccccgccgagactggacgccggcgggacagcagcaacggggagaaaccgggggccgtgtgtcctgtgctgtgtctgtgtgtgtgtcggctcatcggctgacgagcgcaccaccgcttccccactatcgtacc

SEQ ID NO: 24843 - DNA, 2447 bp, Zea mays
cactgcactggtgactgttttgtctgaaaacttcattgcagtactcgtgctcgaagaaatgaaccttgcatgatgaaaacctcaaaaatgtattattacggacttgcacacaaaaccattgatgcactgaagtagcgaaacgctaacaccagtgcagtgaacatctggaaccatagaagatagaaccatgccttctcgttgtgttggcagtcacataggagaactgggcaatgaaactcccgaattaactcgctaatagcaaggattaaccacacaaaaaatacactgatcaacacacgtttctcccagaggcagggagctgctgtcttgctgaggaaccagctactgccaataccacacactagcttgctgaggaaactgtctcgctcgaatcaactgcctcctgtatccctccatctgctccggggctcctcccctcgccctcgccctcgccctcgccgacgcagtccgagccctggaacgagccaccaccaggcttgaacaggcagtcgttctccaggctgtcgagcttctcagcagactctcccttgagcagctggacgacctcagacatcgtgggccgaagctccggcctgtcctgggcgcagacgagcccgacgagcaccacccgcttgagctcctcctcgacgaatccgccgccgagcttggggtcggcgatctcgccgaacctcctggcgcgggccagcgggagcgcccactccgtcacggtctgcttcgcggcggcggtggggctcagcttctccacgggcctcctcccgctggccagctccagcagcgtgaccccgaagctgaagacgtcgcagctctcggaggccttcccgagcatcgcgtactccggcgccaggtagcccagcgtgcctttcaccttggtggtgacgtgcgtcgcgccgtccgggaccagcttggcgaagccgaagtcggcgacccgcgcctggaagtcggcgtccaggagcacgttgctcgccttcacgtctctgtggatgatgtgcggcgtcgcgctgtggtgcaggtaggcgatcccttccgcggagtccacgttagttggaacaagttctgaattggattagtaagtaagtaagaagatggtcgctggagttttggtgagatgagagcacgaattgactcacgcgatcccttccgcggagtccacagcgatcctcatcctcctctcccagctgaggttgcactccgccgcgtgctgcccatggagctgagagtgtatgctcaggttcggcatgtaatcgtagactatcaggcgctcctggccttcggcgcagtacccgcgcaggcttagaaggctcctgtgccgcacgcgtgccagaacctccacctcgacagcgaactccgtttcggccttgttgctccagctcttgagcctcttcacggcgatctgtttcgcggcgttaaagagagagtgatgactgatgagagagtggtgagttacagaggatatgatattgatccatgctggggtgaagagtggatggaattaacatgaggggatcgtccctttgagaaactgggactgatcgaaacacagagattgaagagaaaagaccgcaccgcacctgtgatccgtcccagagctggccccagtacacactgccgaacccgccctcgccgagcttgttgtcgtaattgaaattgttcgtcgctgactggagctccttgagtgagaagatccgccacgccgtgtccttcttcttcctcctcctcctgccaggttcagccctaacaacccacccaacaagaaaaccccacacaaaatcaattgcccgcaccgagaccttaatcgcaagacaaggaattcgccggcacccactcacccgtcagaccgcttgcagcaggaagcccaccccatcgcccgcccgaccgcctgcagcgcctccagagtccagagctcccaggtcacagcgcgagccggcgcgtccccagctagagccccgccgagactggacgccggcgggacagcagcaacggggagaaaccgggggccgtgtgtcctgtgctgtgtctgtgcgtgtgtcggctcatcggctgacgagcgcaccaccgcttccccactatcgtacgcaagcaaagccactaagccaggctcagcgacaggcagccggggcgcggtccgctcacccgcgggctcccgagccaccgcgcccacgtggcgccgcgtggctggctggttttgaaccggtcgcagtaacggtccgctctgaaccggcgggggtaacgtcactcggcaggtgacgtccggggtccaaacgaccactgacgtgcgggccacgcggggtgaactggcaccggcgtggcgggccccgcagggtgtctttagattttagaacgctggctgctggtgggcgatggctacgtttgaccaaaatgagaaaaaaaggaaggatccccggtgacgacttggctgagataagtac

SEQ ID NO: 24844 - DNA, 1745 bp, Zea mays
ttttttttttgggttccgggcccccgcgctcctttttttttctcttgctcgaagaaatcaaccttgcatgatgaaaacctcaaaaatgtattacatattacggacttgcacacaaaaccattgatgcactgaagtagctaaacgctaacaccagtgcagtgaacatctggaaccatagaagatagaaccatgccaacacgaagatagaactgggcaaggaaactcccgaattaactcgctaatagcaaggattaaccacaaaaaataaatacactgatcaacacacgtttctcccagaggcagggagctgctgtcttgctgagaaaccagctactgccactctgccagtcttgctgaggaaccagctactgccaataccacacactagcttgctgaggatactgtctcgctcgaatcaactgcctcctgtatccccccatctgctccggggctcctcccctcgccctcgccgacgcagcccgagctctggaacgagctaccaccaggcttgaacaggcagtcgttctccaggctgtcgagcttctcagcagactctcccttgagcagctggacgacctcagacatggtgggccgaagctccggcctgtcctgggcgcagacgagcccgacgagcaccacccgcttgagctcctcctcgacgaatccgccgtcgagcttggggtcggcgatctcgccgaacctcctggcgcgggccagcgggagcgcccactccgtcacggtctgcttcgcgctcgtggtggggctcagcttctccacgggcctcctcccgctggccagctccagcagcgtgaccccgaagctgaagacgtcgcagctctcggaggccttcccgagcatcgcgtactccggcgccaggtaccccagcgtgcctttcaccttggtggtgacgtgcgtcgcgccgtccgggaccagcttggcgaagccgaagtcggcgacccgcgcctggaagtcggcgtccaggagcacgttgctcgccttcacgtctctgtggatgatgtgcggcgtcgcgctgtggtgcaggtaggcgatcccttccgcggagtccacggcgatcctcatcctcctctcccagctgaggttgcactccgccgcgtgctgcccatggagctgagagtgtatgctcaggttcggcatgtaatcgtagacaatcaggcgctcctggccttcggcgcagtacccgcgcaggcttagaaggctcctgtgccgcacgcgtgccagaacctccacctcgacagcgaactccgtttcggccttgttgctccagctcttgagcctcttcacggcgatctgtgatccgtcccagagctggccccagtacacactgccgaacccgccctcgccgagcttgttgtcgtaattgaaattgttcgtcgctgactggagctccttgagtgagaagatccgccacgccgtgtccttcttcttcctcctcctcctcctcctgccaggttcagccccgtccgaccgcttgcagcaggaagcccaccccatcacccgcccgaccgcctgcagcgcctccagagctcccaggtcacagcgcgagcccagctagagcaccggacgcaccccgccgctgcggcgctgccttctctcgagagtcgagactggacgccggcgggacagcagcaacggggagaaaccgggggccgtgtgtcctgttctgtgtctgtgtgtgtcgtcttcccgccgcctcgaggtcccaatctccccggccggcctcgagg

SEQ ID NO: 24845 - DNA, 1266 bp, Zea mays
ctcgagggccggccgcaacatcatcaccacacgccaaatttacagctagttagctgaattcgatcgatatccaggaactaataatccaccgacccccctcatggcggcttcgtcgcgaatgggcttatccgtctacctcgccatcatggcggcggtgctcgcctcggcgctcggagcggagctcaccgcggactactatagcgagacgtgcccgcaagcgctgaccaccatcaagctcctcgtcggcgccgccatcctgagggagcccaggatgggggcgtcgctggtccgcctccacttccacgattgcttcgtcaatggctgcgacggctccatcctgctggacgacaccgacgacatggtcggcgagaagacggcgaagcctaacaacaactccgtgagaggctacgatgtcatagacaccatcaagtcggcggtgaacacgatatgcttgggcaacgtcgtctcctgcgccgatatcttggccgtggccgctcgcgattccattgtcgctctgggaggaacctcgtacgacgtgctcctggggcggcgcgacgcgacgacggcaagcatggacgacgcgaacaacgacatcccgacgccgttcatggacctgccggcgctgcaggacagcttcgagtcccacggcctgtccctgcacgacctggtggtgctctccggcggccacacgctgggctactcccgctgcctcttcttccgcggccgcctgtacaacgagaccggcacgctggacccggcgtacgccgggtcgctggacgagcgctgcccgctggcgggcgacgacgacgcgctgtcggcgctggacgacacccccaccaccgtcgacgctgactactaccagggcctcatgcagggacgcgcgctgctgcactcggatcagcagctttaccaggcaggcggcgccgctggcgacctggtggagtactacgccgacaacccgaccaagttctgggaggacttcggcgcggcaatggtcaagctgggcagcctgagcccgctcaccggcgacgaaggggatgtcagggagaactgccgggtcgtcaaccaggtgtgagtgtgacttcgccgccatcgtcgaatcaacgaggcatcagcttcgttccgtacgtacactctggctgctagctgcaccggcaagctatgcaccaagattctgtagcgtgtgtctgatcattatttgtattcgcgtgcctacttaattttgtgagaaattggtcttatgtttggttaaaaaaaaaaaaaaaa

SEQ ID NO: 24846 - DNA, 3311 bp, Zea mays
gcacgagaccattacctagaacatcctaatcgaaaaattccattccctgcgctagcccggcgcccgctcgccctgcctgccactcccgccgcgtgctgcctaccagcaggccaggccaggcacccctgccctgtccgccaccagcacaaccgcgtgcgccggtccggtcggtgcatgccaggatggagaccccttcgtcgacgtgcgacgagggctccgagctcgacgcgcgctcgcactccgactacgccgacttcgacgacctggacctcccgccgcggggccgccaccgccgggaaccgtcctccgacgcgtcctccgagtgcagcggggagcccgggagcccgtacgcctcctcgccgtacccgcgctggccggtgtgcacgcttcctgcgagggtgccgccgccggccgcgccgctgctcaagaggctcggcacgacgcggcgcggcgcccgtgtcggcgcgtgtgacgggaaggccggcgacggcgagctgcagctgatcaaggagaggttctccaagcttctcttgggcgaggacatgtcggggagcggcaagggggtctcgacctccgtggccatctccaacgccatcaccaacctctacgcgactgtctttgggagctgccacaggctgaagcccctgccgccggagaagaagtccatgtggcggcgggagatggactgcctcctctccgtctgcgactacatcgttgagttcttcccttccaaggagatcttgcccgacggcagcatacgagaggtgatggcgacccgaccgcgatccgacatctacgtcaacctccccgccctcgagaagctggacgacatgttgctcgagattctgtacagctttcagaagactgaattctggtacgtcaatgacaaagggcagaaagacgattccgtcgcgacgccgtgccgtccggtgagccaccgcggcgaggagaagtggtggctgcccgtgccgtgcgtcgccaagcccgggctgacggagacggcgcggcgagacctgcagcagaagcgcgactgcgcgagccagatccacaaggcggccatggccatcaacaatgccgttcttgcggagatacggatccccgacctgtacaaggaagcactacccaagtgcgggcgggccagcgtgggggatctgatctatcggcacatgtcgttcccgggcaagttctcgccggagtacctgctggactgcctggagatctcgtcggagcacgaggccctggaggcggcggaccgcgtggaggccgcgatgcacgtgtggcggcggaaggcgagccagaggtcaccctggatcgcggtcaaggacctgatggagtccgacaagaacgtgatgctggcgagacgcgccgaggacgtgctgctctgcctcaagcagcggttccccggcctctcgcagaccacgctcgacgccagcaagatccagtacaacaaggatgttgggcaagcaatactagagagctattcgagggtgctggagagcctagcgtacaacatcgtaacatgtgtagatgacgttctcttcgcagatgaagccgccagaaagatagcatgagtgatcatttgttcatccttcctgcctgatccgggaaaccaaaaaataaggggtccatgtccatgatccatccacagaatgtacattatgccataacttgtagcagtagtaccatctaccaatggatgatagcacgagcagttaactcatctaggcagccatgtcttggttttcatcacaatggtccctcagtgcctttgcaaaaaaaaatctctttcatcaccaattcaccatatggatgtcagttgccacagctgtgtgattggctggaggtatcagctgaactgaagtagtagtgacttgtgaatcttttgatacagggcatgggcaacgcctgacagagtgaccggcacaagttcacagctgatatattcacaaaatgtttcaagtaattcttgaaacacagaagcaatagagtatctcataaactaacggaaacaatattatgttcacaatgaaaatttaccataaatactggggtactttatatacaggagcacttattttttatgtttccatgcctctacagagaacaaagggagcttaaagaaatcaaattcaaaagaaaatggaaatcaactatattgatgaaatgcctagctctacaacatctggcagtctgccgaactcacttttccctatcctttcgcaaaaggtttctgtatctattaaccccatgtcagtactagtcgaatatgcctctgcatgtattactacaaagcactacagtatcaaagccacaaatcaaaaaccacttcctccagcaagtcatcaagtaaaccatcccacaactcaactacaacacttccagtatcgcctccaagatccagccacgacccactgtccaagtctttcatcattacctgttctaaagtgtgtggaaattctttacctacaagagaatcgattcccttagccacctctcgaaccagccgtcttcctactggagctggccgtacattgtgtttcagagaattaacccaagggtcgctaccaaagaacttgtcccttatctcgagaagaacctcttccacgtagtcaaacaagagcactgcatcgtctgtcaggcagtacgagtttcctacttcagccagtacagatacatcaagcagtggctcttctgtgtaccaaatttgcgaattttcctcagacagcaatcctgaagcttctagcacggccttgatgaaggacacccttgtggctctgtcatccaaaatggctacctgtggcccattccacaaagctggggatgctgaaggggcgtcaacctctttgaacagcactctggaagtaggcatggagaattcatcttgctttggagttttgtgtctaggactggtaacttctgcaatgggatcaagaacggattgtggactcaatttctcctctttgtcattagtattttccggcgagtaaggaaatgtcactacagatggtttgactaattcaacaatttctgacggactatggttctcttgttcattaacgaagtcatctggagaatacagtgccggttctggcaacaaattcatggattgtggttcctccaatgaacattcatctggatttttctctcccactccttcctgcgaagttccagtctcagcacagagcgatgagttctccattgtatctagcatgatcttaaccccttcacggaccaactcctgtgagatggcgccctcattttgtggatagctaccatgatctatcgtcggctcaatcaacgtttctgtgggc

SEQ ID NO: 24847 - DNA, 1247 bp, Zea mays
gcacgagaccattacctagaacatcctaatcaaaaaatacaaaaaaggcagacggctacccgttcgaaaaaaaaaacagcagcagccggcggcggccatagcccaggagcccggagctgtttcttcgtcgcaggaatgggcaaggacggcatccagtacgcagtggtggacgccttcacggcggagccgttcaagggcaaccccgccgcggtgtgcctcctcgaggacgccgccaaggccgccgacgagcggtggatgcagtccgtcgccgccgagttcaacatctccgagaccgccttcctcctccgggaaaagtcctccgcggccggcgccgtcccgctgttccagctccgatggttcacccccgtcgctgaggtggagctctgcggccacgccacgctggcttccgcccacttcctcttcacatccgtcctcgcggagcacgagaagctcgtcgagttctcgaccaagtccgggattcttacggccaaaaaggtccctgcgccgcagagcacgggcgtgtcgggcgaggggaagctgttcattgagctggatttccccacgattgaccttgttgattgccatccttccgagctgccggcaatccccgagaccctcaacggagcctccattgtcagcgttcacaagtcaacgacggccggtgacctcattgtggagctttcatcaggaaaggaggttgctgatatcattcctaacattcatgaaattgaaaagtgttccggcagaggaattattgttacagggccagcgcctgctggatctggctacgacttcttcacgcgttttttctgcccaaaatttggaatagatgaggatcccgtttgtggcagtgcacattgtgttttagcaccttactggggtgggaagctggggaaacacaaactgatagcgtttcaagcatcccctcggagtggaatactatacctggagttagaagctacaggcaggagagtgcgaattcagggagaagcggtcagtgtgatgactggcaccctcttagcataacccctgctcaatgaacatcctatgtcttcacttcagttgtgtggcatgatttctctgcagctaggaataaattaagtctcttttcacctgtccaaaggtgttagatacactgcttccagactatgaagcagagtgtatgaggatgtttcttttgaataaatcagtgggtgttcaatgtgtgtgatataaaaaaaaaaaaaaagaaaggggcggccgccacc

SEQ ID NO: 24848 - DNA, 1385 bp, Zea mays
gggtaccgggccccccttttttttttttttttagtgctttgacaatattattattattatttattattattataaccacgaaagaacatcaatctcgatacaaaaaaaaggttaatctaacccgttagatacaaagaaacacgcccacgacgatgcccaaaacaccaaacgcctctcctatagacatttgtatacgggaagagttcacatgcaccacaaaattaaaacgtctcagcaaccgcgttgcacccttacaagcctcgcaccagaaccacatcgggaggatgatctgaaaagcatcagtgcgtttcattgacagcatcacctgttttaggctgtcaccggttcctgcacaagaccagcgattattcctttgctcaactgtttccctagcctctcctgtatccgatccttgatcgcagtttccatattgtggcagtgttgctcaaacttctctaggaaaccagcaacccagcgatccgcattagcaagccattcttcatgattcaaaccagcagtctttgccactgtttgcaacttttcctgatgtgccttcacagtctcccgcagtttattgatcttcatattaacttgcaattgtttctccttgacatagctcacaccaagatctttcctcgagtagccccgtgctaaattcctcatgacatactggttatagtccttcaagatcctcattatgagatctgaagtagaaaccccgtctgtcctttttgtttccttgaattttccaatctttttaacaaattcatagacatcatttgctgttccgctagtatcagcataaggcagcgcatcatgagcaacatagtcaatctgatgcttatcaataaactcctgtgtgagaacccacggtgcatcaggaatgacctcatcaacccacttgcagtgccgcagggattcgtatcgctcttcctgggtcatgacggtcttgcccttgtagcggtaggttagctcgtcgttgcagcatccgacgagaagataggtgttggggaacagcatcttggcctgctcgagggcgcgggcgtggccgaagtggaagagatcgaagatgccgtcggcgtagacgcgcacggggcggtcgtcctcggccttcctctttgcggcggtgctggtgtcggtgctgctgagcgcggaggcgggcttggcgccctgccgcttcttggcattggagacgcgcgccatctttctcgctgggatggtaacgatttgcgcaggcgaaggggggttggaggtggatggctgcctggtcgaactgctcagttcggcctcccttcctgggagggcaaggccgcgtgcaggctcgccaataaaaaggcgcggatcgctgcggaactcgatcccggccggcctcgaggtacccaatg

SEQ ID NO: 24849 - DNA, 910 bp, Zea mays
tttttttttttaaactgaaacgctacactttatgaaatggacatggacgtaatatataagtgtcaagtcgagctcgtgaatagagccatttcagtattgacagcaagatctcttcaattaagcattttttatccattacaatgcgccttgctcccagtatgacgaaatacagaaaacaaaaggaaagagaaaaattgaaaggtggaggaacccagtaactctgcatgtgaaaattttcttgataacaacgaaaattttcttgcctgagaattatttaccgagggtatggacctgagccccaccaaggcgcccaatatgctctacggaacctgacattcaaaaaccttcttttttcccgttttggacatgaacggaacaacccaaaattgctagtgaatcgagcttgcgtgtgacctatcaatgctctcttattctgatggtaaagaaacccaccctcgccgcagcttctctacagagaccacagcttattcacattggagaggcctatcagaactgtgtcaagtgatagaaaatttatgatgagaggatcactcccaccagctcaataaaatcagcgcccaccaccagggctcgaactgccggcacttgtaggagtctgagtttgcataatggtatcatgatggaataccccttttggcaagattgctccaacaggcgcgggtcctgccactggtgatactacatgattgatagatggatctttagttgaaatatattctggggaagacgaagatggagccaacgtggcaacggagaagctaataggatagggagcaattggcatgtcagatagtggcaaagcagatgaactgtagcctagtgtacccagggagcgaccacgcttgcatgcaactccatatctgcaatatccattttgggcatagtacgc

SEQ ID NO: 24850 - DNA, 2096 bp, Zea mays
gggagtgggccaggcaaagtcggctcttgcgtcgacatcgacggggagaaacagctgtgggcaggcgatgaactgtagcgcgtgacagtgaggggatttggttggatccaatgtttggtcggtctgcgcacgagaccattacctagaacatcctaatcgcaatataaagcgacggggcccttgcgctgggcgcggagactggagagggcgagagtcctcccatccacaagttcttagcttttgcgagattgagatccggctggggacagaccgacagaggaaggtgaattgtgggaaagaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaattgcgctgcaggcctccgtcatcataaacaatgtcggcgtgctaattgtttacatgattatcattggtgatgtattatctggaacaacatcaggcgatgttcatcatcgtggtatattggagggctggtttggagctcatttgtggaattctcgtgccattgttcttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttggatgggttgctcttccccacgtcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttagggattcttacggaatcgcgagcaagcgcgacaagattctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattccgtgaaggaacgatttctttgtcagcacctcagaatttggccacttgaaagaatctgatgcttgaagtttcctggttctgtgtacacaagtcggctcaatgtcagaattgagccgcttgaaatatatttagttatattctatgcggagagtaggtcttggaaacagccttttccacaataatgtacagttattatgccaatttctgagttcagttaaattttgtgaaatatggacatgggcgtcttgtctcgattaaaattgagaatggtatgattgcacattacgtcgctaaaaaaaaaaaaaaaaccgccccc

SEQ ID NO: 24851 - DNA, 4168 bp, Zea mays
  misc_feature (3975)..(3975): n is a, c, g, or t
agaggaagaagttgaaatagattccaagacaagttagctaactccaatgtagatgtatacaatcatttcaggcttggtcgaaccacaggataagtcacttgtctcttgtttgatttcttatttgtacttctctacttatctttgatatacactattcttgaattgcaagatcttttgagatagagactggtatttcgctacgatttaatcgagctgatctttatttcggtgtgatctatactttgagtagagtaagaaaattctagtttttggattaactttatattggactattcacctccctttagggtctgttcgtttctgcaggaacgcaccaagaattgttcctattgatcaaaacttaaacaaattagagaagtaatccggttcggaatagttccggtactccgttccataacaaccgaacgggcccttaggggtatcagatccgttttccctcaaaggaaactttcaatgtaaaaataaaaacattggaggagttatttggattgaccatgttcgttttcttctctcactggtcaatgatccaatcagattttcagaagcttacttatctttataaaacaatacaatatttataaaacaatacaaaataatggtttgaatgatacgagcaccacctcgccctcgccagattccaaagggagtgggccaggcaaagtcggctcttgcgtcgacatcgacggggagaaacagctgtgggcaggcgatgaactgtagcgcgtgacagtgaggggatttggttggatccaatgtttggtcggtctgcttgcatcacctggttgcagctctgcattctctggctataaagcgacggggcccttgcgctgggcgcggagactggagagggcgagagtcctcccatccacaagttcttagcttttgcgagattgagatccggctggggacagaccgacagaggaaggtgaattgtgggaaagtgcgtgctctcggctcttttcccgtcttccttgccttgtggttttgttttggaagagaggattcttgcttgggtaggattgggtaatttgagagttcatttctcgggattttgtggctgtacgaggcttttctgaggccaatttaagtagatgaaagttgttcatttgagtttgagttgttgagttatgtgctatctgcaatgttgtattgtttcatagagtagttgtttgttgatgtgaattgtgttggaaaaatgaattttgggcgtgctttagccgacctacttaactagtatctacaccaagacgatcctgtacccttaagatttgttattaggccctttgctttggctgtcctcttacttttgtttcaggaagtttttttgtgtgcatactgtttgactatgaatggaagacgtgttatcggattgttttgttcatataatggatctatatatttcattgctttaaggcactgttcatacataattacatgtatgagaaggtttgttctgagtaaacaatatatagaaatggaaatcaaaatagagagtgcataactcaaggcaacctagatctcatcatagtaatattctagtaagaaaacaattgtaactggctattcaaatcagtgatttattgcaccaagtttctgacttaaaaattttcacatccaggaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaatgctgccctgcaggcctccgtcatcataaacaatgttggcgtgctaattgtttacatgattatcattggtactcttaaactcagcactctacatctaatcttatttttgaaaatttgagatgcacactaaaatgactcggtatgagtagttatcccagtatactttttattcattcagcccagtatactttttagtcctttttacctgagatcatgacacactctttttgagcatgcctctggagccccaaatcaatttttcctaaggatgttcatatacaatattttttttaaaaaaattcgttccatagctttagatatgggtttcttcagtatattactctctgttaattcaagaaacttacctatgacctttatgatgatagtttctctcctgttagagagagaaagagagaaatattcccgttgtgcaacaccttgtgccttaaactgaacaacctatgcaatggagaatgtactgaaattgatactggttcttgatactttgataggtgatgtattatctggaacaacatcaggcgatgttcatcatcgtggtatattggagggctggtttggagctcatttgtggaattctcgtgccattgttcttcttgccacagctcttttggtgttcgctccgttggtgagctttaagcgcttgggtatgtgtacatgtttgcgcatttaaaaaaattatccttcaacatatgcactattgttagctgcatactattaaactaaatcttgtcatttcctgcagattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacggtatgtgctatcattgtgaagatactcttctgattattcaaacatccagattctaaatccaccatgttcatgtttccacagttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttggatgggttgctcttccccacgtcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttaggtaactcaatgtttagttcttggtgtatgttgcctactactagccaagccattttgtatagcatgtaatatcgtggcttgaatttctgcagggattcttacggaatcgctagcaagcgcgacaaggttctggctgtaaccatgatcgtgcttgctgtcctgtcaaattctgtcgccctatacagtgacgcgatgaacatcttccgtaagaaggaagtggcctgatctcagatttcaaaagtagtcagtgctggatgaagaatggtctcgcaatgcaagactcgatggtacgaaggaaaacgatgcgcttggattcccggaaggaacgatttctttgtcagcacctcagaatttggccacttgaaagaatctgatgcttgaagtttcctggttctgtgtacacaagtcggctcaatgtcagaactgagccgcttgaaatatatttatttatgntctatgcggagcggaggtcctggaaacagccttttccacaataatgtacagctattatgccaatttctgagttcagttaatttttgtgaaatatggacatgggcgtcttgtctcgattaaaattaagagtggtatggttgcacattacgtcgctaccatgtttgtttttgccttaaaaaaaaaaaaaaaaaaa

SEQ ID NO: 24852 - DNA, 1519 bp, Zea mays
tatggacatgggcgtcttgtctcgattaaaattaagaatggtatgattgcacaaaatttaactgaactcataaattggcataataactgtacattattgtggaaaaggctgtttccaagacctactctccgcatagaatataaatatatatatttcaagcggctcaattctgacattgagccgacttgtgtacacagaaccaggaaacttcaagcatcagattctttcaattggccaaattctgagttgctgacaaagaaatcgctccgttggtgagctttaagcgcttggattcattaagatacacatctgcgctatcagttgccctggcagtagtttttgtcgtaattactgctgggattgccatcatcaaactccccgccgggaccggtgcgccggcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgacgacatagtgcgagtgagctatgcggcacatgtcatgcttgtctttcccattgtcttctttgccctccggctcaacttggatgggttgctcttccccacatcaaggcacatctctcgtgacaacaagagattcgccatcatcaccgtctctctcctcgcagtaatttatcttgctgccattctcataccaagcatctgggacgcgttccagtttactggtgccacagctgctgtcctgattggttttatatttcctgccatggtcatacttagggattcttacggaatcgcgagcaagcgcgacaagattctggctgtaaccatgatcgtgcttgctgtggtgtcaaattctgtcgccctatacagtgacgcgatgaacatcttccgtaagaaggaagtggcctgatctcagatttcaaaagtagtcagtgctggatgaagaatggtctcgcaatgcaagactcgatggtacaaggaaaacgatgcgcttggattccgtgaaggaacgatttctttgtcagcaactcagaatttggccaattgaaagaatctgatgcttgaagtttcctggttctgtgtacacaagtcggctcaatgtcagaattgagccgcttgaaatatatatatttatattctatgcggagagtaggtcttggaaacagccttttccacaataatgtacagttattatgccaatttatgagttcagttaaattttgtgaaatatggacatgggcgtcttgtctcgattaaaattaagaatggtatgattgcacattacgtcgctaccatgtttgtttttgccgaaaaaaaaaaaaaaaaaagcggcc

SEQ ID NO: 24853 - DNA, 1377 bp, Zea mays
cgggttggatccatgtttggtcggtctgcttgcatcacctggttgcagctctgcatttcctggctagataccattggggacctcgaggccggcccggagactggagagggcgagagtcctcccatccacaagttcttagcttttgcgagattgagatccggctggggacagaccgacagaggaaggaggacagaaaaatggggattggagatggatcttcaaatgggaaccagcaaccggtgcataaggaaatacgagatgagaccacaccacttcttccagtcaaggtggaggaggacgaggggtttcatgagttcaatggagcttcattctctggggcagttttcaatctgtcgaccaccatagttggggctggaattatggctcttccagcaagtatcaagatgctgggcatcatcccggggattctgttgatcatccttgtggcactgctcacagaggcatccatcgacatgcttgtaaggtgcagccaccagggcaagattacatcatatgggtggctgatgggcgaggttttcgggcagtgggggagaattgcgctgcaggcctccgtcatcataaacaatgttggcgtgctaattgtttacatgattatcattggtgatgtattatctggaacaacatcaggcgatgttcatcatcgtggtatattggaagggctggtttggagctcatttgtggaattctcgtgccattgttcttcttgccacagctcttttggtgttcgctccgttggtgagctttaagcgcttggattcattaagatacacatctgcgctatcagttgccctggcagtagtttttgtcgtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgacgacatagtgcgagtgagctatgcggcacatgtcatgcttgtctttcccattgtcttctttgccctccggctcaacttggatgggttgctctttccccacgtcaggccccatctctcgtgacaacaagagattcgccatcatcaccgtctctctcctcgcagtaatttatcttgctgccattctcataccaagcatctgggacgc

SEQ ID NO: 24854 - DNA, 1930 bp, Zea mays
tgcagcggcggcctccaaatacgggagccaaccgccgtcaccagagcaaagcaaggggagtttcattgggagcactgtagcgtctcgttacatagttctcccctgtttaataaagaaaaaactagtaataaaaaatgaacagaattagataataatattttatagttgtagtaagatataagaaaagaatatagaggaaccgctgcggaagatgaaaaaatagaaaatgaaacgttaatgtgccgtaaaatggtgatatatggggaaaaaatcaggataaccgctgccaacagtatcgcacgcacgggtggagccgcagtgccagccccccggcgcggcacatccatcagcccgcaacgacgccggggccgccaaaccaattgcaaaatcggtttcggctctcaccacattctcgtatacagcaaaatcgacaacattggctgcaagtgcaaagatccataaccaattgcagagagcggacaacaggcttccacttccactctgtagaatcctagcattccgcatgcatattggtccaactcaacgtcagtgttgctaggattaacagtcaaaattctcaacaggcaaaacaagtgagctccagagggcagggcacgacaagcagccaaggtgaccctacaaacatggttacttacatggcgctgtcctatttacaagatagcgattacgggagtaaaacatagaccgcaggctatccccactgaccaagctcgctcaccaatctttcagaagttcactaacgacatctctgtaactcacttttttcttctttggtggagctgcacttggctctggggctggaaccccggatgttccagcatctggcaacagaatctcagaattggatgtggagcttcctatcgcaggtggatctgtctcagccttcgccaagggcgccttgcttgtatcttctgtccttttctggcccaggagtggcaacatatccagaagcatggcgtgcaacggatcagccatttgttctatcttctcaccaggcgtgctactcatcgcttcagcagcggttgttctctggaaagggatgtcttgtttctcctccacggtgttcaatttgacacctttgacctcttgctcccccaacgtgaaaagctgagcacctggcggtggtccacagtcattatcaatgttatctacttccattttagagatgtaatctgtgtccaacttctgatcatctttcccagtttcacaaggcccagatccaccgtcgcccatttttgtatgctgatttccttttgtagcccttgttctccaggctggttttgaagcaggtgcagggagtcctttgtttttgttggtaataccttcttcaatcttagaggtatcatctgtgtccaaattttcatcatcttggcattcgctggggccactttcttcagattcaacatcacctatttttgctttctggtttcctcttctaggccttattcggcggactgctctaggagcagcccttgcagttcttgaactggttggcctactccttttccttggcatattttccgcatgagatctttcaaactccttgtgttcctcaaacttatgctccggaggctgaacattttcctcactcctttcaatttctagttcttctagtgtatctggtttaaggctgtaagcagtttcagagagcttcatttgtttctccactgaatcttccaaccacttattactgacaacatgtaatcttttgtcatgtagataacgtctttcagcaggagggaagctcttgtaccggacgcgtggttatcaaagttatagacctgtaaaaccgaaactacaaccaaatgagtagctggagcaatactgctgcagacttgaccaccatgcattgttagatcctgcttcaccctcttcagtgcaagatcagatattacattgtagtccgcat

SEQ ID NO: 24855 - DNA, 1819 bp, Zea mays
gcagcaacagctaattgattgatggatagattctcttttgagcaggtgacacaagagaaacacagaataagatactatactggagttgttgacgttgatcgctacggtggactgattccaagctgctcaaaatatcctgagccattgccctagattgtaggcaaatagatttggtgttgggttcatttcagtaattaatgctaatccagggaagaaaattgttctagtaatgaaaaaaaatcacactaatcgctcgttccacttagcaatggcactactgtaattcaagctcaattcaatctctccaggctttaactgcacaagaacactgcaaactacaacagtccagagaaaatttaccatcaccgctagttgatcagaactatgctgccgccgtcgtcgccggtgttagctcttccaggcgtagatcagcagcgagaagccgtcgccgcgctgcatctcgacctcctcggggctggcccagtccatcaccgtggagccactggcccacgacgccgtggaggatgccacggacgccgacgacgacgagctctccttggccagcctccgccccctgcccttcctcctctcaccgttgctgcccgtctcgctccagtcccgttgcccccaccgcgcgaggtagcctccccaaacgcccgtgttcctccttgcggccttgctgggggagggattcttccccaaatccgcctcgctctcctcgccgccgctggcgagttcgaaccggaaaacgaacaccgcgtgggcgtgcgtcgaggcctccgtggggggcggctcgcgtggggggaagagccagttgtggagatcccaagagacctggacgccgtcgccgcccccgaggtcgacccgctcgctgccgcggaacttccagcgcaggcgccggacgtgcagcactcgctcgccgtcgacagagaccgacatgccgacatcagcccggtccttctccttccccttgccggcggtggccttgtccctgccacggccgcgagccacgagatccacggagatctcccgctccttgccctggacgttcacccaggtggtgtggctgcggcctcggccggcgcccgcgtcgcgtagcgagacgtgctcccgccgggagaggaggaccggacgcgggcctgatgggcgccgggcccgggtcctccggtaggccaaatcggtcaggtccccggccgcgaggaccatctcgccgcagacgacgacggcgacgaagaagcccgatgagggctcgggggacccggagaccgggaagcgcgcgcgagagagatcccacgccaggtcgacgaggcggtcgccagcgcggaaccgtctggacccgcggcggcgccagaatagccatgggctgacgcggaaggcgagaatctcttcgtccgcgtcatcgtcgaggtagcccgctccggacgccgaggaggaggagccgggcgggggcgtggccgacaggcggagcacggcgcggagggagaggccgagcgaggtccgggaccaggagagcgcgaccaagccgaggtgggtctcgtagatggaggtcgccaggctgggccccgccgcgcccgcgcccgcgcccgaggacggcgccgcggcgcagcggaagcaggcggcgatccggctgggcatcagtagcgcgagacgccactgcgagacgccactgcgtctacgctagtcgattggaatgcgtgcgcgctgtggcgcagacttgcagtgcgaatccaaggcgtcaaggggttgctggcttgctgcgttccgcaagtggtgcggctgggtttgctggcttcccgcccggcggttcgcctcggcaaac

SEQ ID NO: 24856 - DNA, 1956 bp, Zea mays
cggtggactgattccaagctgctcaaaatatcctgagccattgccctgattgataggcaaatagatttgctgtttggttcgtttcattcattaattgctaatacatggaaagaaattgttgttgtaatggaaaaaaaatcaacactaattgttcgttccactcagcagttgcgctactgtaattcaagctcagttcactctaactgcacaagaacactgcaaactacaacaatccagagaaaatttataatcaccgccaattgatcggaactatgccgccgtcgccggtgttagctcttccaggcgtagatcagcagcgtcaagccatcgccgcgctgcatctcggcctcctcggggctgccccagtccatcaccgtggagccactggcccacgacgccgtcgaggatgccacggacgccgacgacgacgagctctccttggccagcctccgccccctgcccttcctcctctcggcgttgctgcccgtctcgctccagtcccgttgtctccaccgcgcgaggtagcctccccaaacgacgtccgtgttcctccctgtggcattgtccgggcagggatccttacccaaatcctcgccgccgctggagacatcgaagcggaaaacgaacaccgcgtgggcgtgggcgtggcgtgcgtcgatgcctccgcgggacctggctcgcgcggacggaagagccagttgtggaggtcccaggagacctggacgccgttgccgcccccaaggtcgacacgctcgctgccgcggaacttccagcgcaggcgccggacgtggagcactcgctcgccgtcgacagagaccgacatgcctacgtcagcccggtccttcgccttctccctgccggcggcgaccctgtccgtgccaaggccgcgggccacgagatccacggagatctcccgttccttaccctggacggtcacgcagggggtgccgctgcggcctcggccggcgcccgcgtcgcgtagcgaaacgtgctccctccgggagaggaggactgggcggggcccggatgggcgccgggcccgggtcctccggtaggcagcatcggaaaggtccccgaccgcgaggaccatctcgccgtcgatgatgacggcgacgaagaagccggacgacggctcgggggacccggagcccgggaagcgcgcgcgcgagaggtcccacgccaagtcgacgatgcggtcgtcagcgcggaaccgcttggagccgcgccagcgccagaggagccatgggcggacgcggaaggcgagagtctcctcgtccgcgtcgtcgtcgaggtagcccgctcccgacgccgaagagaagccgggcgatggcgggggcgacaggcggagtacggcgcggagggagaggccgagcgaggtgcgggaccaggagagcgcgacgaggccgaggtgggtctcgtagacggaggtcgtcaggctgggccccgccgcgccggcgcccgacgaaggcgccgcggcgcagcggaagcaagcggcgatcgggctgggcatcgcaagcgagggcgccgcggtgctggcgtggcgcttcggacgctacgagacgagacgggagcgaaacacaagtgtatgcgctagtcgattggaatgatgcgtgcgatgtgctgcaggcagcagacttgcagtgcgaatccaaggcgtcgccgtccgggcgcggtgaagtgagatgaagcacagcccagcactgctgggttcgccggcttgccgctgcacggttcgcttcggcaaacatatgtaggtccaaggtgtgtcccccattttggatcttgtaccgatcgacgtcctcatacggatttgtcgatttccgtaggaattaaggaaaaaagaaatgagaattcatgttttaaattgggcagtatcctcagttccaaaaacaattaatgttttaagtgtggacacacgaatataaaaagaaatgaaaagatatgatagaaataaag

SEQ ID NO: 24857 - DNA, 6402 bp, Zea mays
  misc_feature (3845)..(3845): n is a, c, g, or t
  misc_feature (3915)..(3915): n is a, c, g, or t
atgcaagtcaaagtaaatgacaagatgcacaatttcaatatctgtccaagtttcaaatcgctttgtttgcctggagaaaagtagtaataatatcaatcttaatatcagcaaatacaatatacgtacgagattaaaatcctctgcatgaatatatggctgcgacaatgttttcgaggggcttatagcatatggacatagccccagaaggaacatgtatgggaagcactcactccccttcatacatttgtagcttacagatcaatacttacaacacccatttgtgcgaccgaagattgtcatgcacatgaggcctcccttgtcttcgatctccccccgcttctgtctcttccagtccattgttcacactatttatatctcctctattgttcacacttcataattaaattagtttaggtctcgccctgtgtgacttgcttccaatagaggacgctagtaaccattctgatctttttgccaaatagtagtagtttgttgccaaaatcaccatcccgaacgtctcacacaattcaaattgaagatggaacaactgtttcttgggccttggttctcttaggcctccacatggtccgggccttcaccatggtcggacctgattcaaggctcagcacatgctcacagtgcaaggttgtttctccagactcactgttgcaatccgtgtgcacagaggtgtgtgattgcagcacactatcccggccacactcccttttgtaatccagcacaatgctcgccagctcatgattctcaagaatagagatgggtgcactctcaagaatccacgcaatgtatttaacattattgacatgctgatttatatcaagatcagcccaacgaggagtcaggcctgtcctcacattgttagtatgctacagatgtctcatttttctcgattttattcgacccagttgggtttagaatcagttgaccaaatagcagagctacccccccccccccccttctccaacacacacacacattaatatagggtagaagagctgccaattaatgaagcagtaagaaaaaccaaatgataactgtctccgaactcgtagccgacaatacatacatgaaggaccagccaacaacacatggcatatcatcaatcaagcaaatataagaattatctctaccgcatcttatttctctgtagtttagagcaaagaaaaactaaattgacttgtacacaggctgctcttgcacgaaagcaacacgcgtcagcgacattgttaggtacctaggtgaccaaccaaatatactaaaatctcaggagatgcattgcgtatccaacttgtgctcgttgtcatgaataacttaaaagaaaagataccttctaaacaaatattatatatcatgagatgagcgccattgtatttgctaatcgaaggaatataagtgggctctaagccactaataattaccaatgacagaataggcaaccccccaacccaaccaggcacccacattccgatggtcagtatcgtctgcaggcagatggggactgggcagcagatatacaggatagagaagtaattggtttctgtttgcacatgattgtcagttgcacaaaagagaccaggatggaatacccaacataacattaggcggcctcaaattgggataaaatacaatttgaacgaaaatgattcgagtcagagtactcaagtgtggaataaaacagttcaaataaagcacaagtactaaattagctggtcatgaaagtggttacctatttcagtctctaaacaagaaatactgaagtaaggagtagaataatgatttgcatatcatcagtaagaaaattacctcaagaatccacgcaatgtatttaacattattgacatgctgatttatatcaagatcagcccaacgaggctgcacaaaacagaccccaaaaaatatataaaacagcaaaggaaaaaataactatatgaacatactagcaatttaatctaaatattaattcagttacttacagtcaggcctgtcctcacatatttagctacagacgtgctttgtccctctggcagttttggaagcttgcggttgtcttcgtcaacaatagcagaatgctcaaaaaagtatggctctatttcagtccgcacttcatctggaattcttgcaagcttcctagtgagtttgttcatcataacccatttactgcacaaagacataaattagaaaaaaatgtgacagggtgttccgtataacttacatgtacttcaagcagagaaaatatgaatgcagtgtaaatcgtaatatggcagttagcagaaataaactgataataaaactgattaatgatatagatatatcagtgtggcagagatttcaaccttgttgccttcagtatcgtgaggcctgttataggatcgcgtatatgccaatccctacgcattccatttttaccattagcactaacccatgtatctacttcaacagtatcacccctgcagccgtgcagaggagcgacttaggacacataacaatagaacccagatgatgagggatcactttcagttcatagaagataaagtttctagtatctgttagttgccataggaaaatgtatcaaggcttcaagaggtttaatgagtgtatctgcatcaataatagaggtttgcaaactgcccacagcgacatacaactatataggctccttgtgctaaaaaactacatatgatcctccaagttattgccaaacagcgcaaaaaaaacaaggagatttcctttcacatttattgctgaacaacttgaaaaccccattcaactaatcactcaatacccagcactgaggaaacaagccataatcattattaattccatgtctccacaagtaaccacatgggtgttacttatttcaagctcaaatcacgataagaaaactgaacaagatcatgcgatgatggaaatcataccagcatggataacgctcgatgatggcctgcatttggctaaccacccagaacaagtttcgtttactcatctctggtgtggagccaaatccatcacctagcagcccagcggtcttcacatgattgagtgccgtttcctggatcaaatccaaactttttcatcgtccaatcctcagctacaaaatctcacacctcaaaatgatcgagtcccgtttcctgcaaatggttcatcagcgtctctatagatgccgtcctatctgccccaatctcataggacctaatggagaagttctgcctgaacatgagcccatcatgtatgatccggccaaacccaaacgtgtcagtgagcatgtcaggcctcctaggcttccagtcaagcatcgtccactgcttctctgcggccaagaagatggtggtgatggccgcaaggagcatgctccagtcgggaagctggttgtagaaagtcttcggcaccgaagaaggtacggtttcgtgctccccatccgccaccgcggacttgcccccaccgttcatcttggggaccgcagcgtgggcgcgcgtcttgctcgccctcacggcactagacgaggctcccggcttcgccgcaacgccgcggacgtccaggctctctgggcgctccccaaggccgttcttaggagcggccggcgccggtgaccctggaaagaaggacgaggccgcgatggaggcggccataggaaagtgctccgcgccaaatcaaatcgaatggtagcacctgtctgaatccgggccccccctcgggctccgcacgacagctgcgctagcatcaacataaagcacaaaatcaaacaagaaaactgcccgtttactcaatttaagcaacccaaaaaaagcaagatttgccgcacactacaggcgcatcacgggtagaaatgnccagagcttgcgaggaagtgcagggacaaaacgacggtcaaaccaacccgctgtcaaatacagcaaacancccaaatgaaaagagaagaaaaactcacccaagaaaataagcggcagcaacccaaatctagcggcgtaaacgagaaggaagaggggcgcaaggtttcctgaactcgagatccagccggggcaaggaccctgaactcccgcgattcaccccagctgtcacggcccggacgctagcaggccgaacagcgaagcgcccagaaatagctacagcttatccggtggaatagccacatggcggccgcgcccagacaatccgaccaggaatagactcaaccccactacgaacttatgacaaaaggcacacggaatgcgggcgggcgggccgggaagggacgcgcaagggaacgaaccttgcgcgggcggcgacggcgagggcacagggggcttgggtgttggtgcgtgcttcttccgtcgggtgcgcttcaccacgcggccattggcagcgcgccgatgggggagagcgagggaggaagaggcttctggcggataggtggtggtgtttggcggcttcgcgggcgctgcggtgggggcggccgggcggggcggggcggggccggtcgaactctgtttcttttctccgctggcgctggcactgacacccgcaccgggcgttgtccaccgcgaccttttaacccgtttggagagcgtggggtcggtgagtgcgtggcagccgggtatggagagcgggcctgggctggctggccatgcatacgatgcttcctgttgctgagctgagcagatcctggagacaaaaataacataagaaaattccttatcctattatttatagaagagtagtgcttcctttgtttgcttttagaaatttcaacctgagtagggaagaatgattttttttttattttcaggactgaaaggaacgcacagtttttttcccggtgtcagataagcaactttctcaaataatagtactgtcgcgtattatttgtttttctatctttatatatggtccgtaaacagaatcatccgtaaggaccgtatgtgactactacactattcaaatacggcaatgcacgaatcatgtgcacttaaaacgtggactctgcaaaagtgtcttggcacacaagtgaatgaatgaatcaacaggagtcctctcttcgccgtgcatgtgcggacgagacgaaagtggttgcccctgcccagcggacagcggttgcccgggactccactccatcgtgttctgacggtgatctagacgagaattgaagtggttctcagttggacatccgtttcccccatccaagcagtcgttcgtgtcggcatcggcgagttattatattagggttccttttccttgcggcagagctctgaaccctggtctgaaatcaaaaacaaaagaaaactggaacgttgtcagaatattgagaactacactacgctagctacacgccagaaatttcagtgaaagcaggtggggccactcacaactgagtttctgcagttgcgacctgaaaaaaaaagaagaatcaagcacgtacgccttgaaacgtgagcagaagtttctagccgggaagattacaggtattgctcagaagcaccctagattttcttcggtcagcttagttttcagcggttgatcaaaaaggttacaagcaagtacaccctccgttctttttattatttatcatgttttagtaaaaaattaattagcggatgacaaatattcaagaacggatatagtactaagatggctcgttcgagtgttgctccacgattgtcaaatatgcaatcctctaaaaacagttgggtcccgagacgatggccgactgaaccttttttgcggtccgagaatataatctgttttttattaagagaaaggaaattacacgaatgcatctgtaaaggaattctgataatacggattataaaccataaagttagtatgtcaacaagagagtcggtcgcccagagaagcgacctcgctcacctagtcatgaaaagccagcaaaaacaattagaccattccaccaaacgaagctgaataaatcagttcaatatgttgtccaattgacaccacaaataccaccatggtcgcatccaccccaatatccacccatgacatacccacctcaattctcatacccttatatatacacgcccacaccatatgtcccaaatcaaatatgggacatactgtcatacccttacaggttgccaccacatctcgcttggagggacgcaacaagcatatgtgtttaacaggttaaccccacaagtacaagaccggttaagtctccctcagtctggtcagcatgaacaactccaacaagatagctggaatactcgccaaaaaggtagatcaattcggcatgggggcatgaggagaaaactccaacatcaacgacaacaatctgtagaatctgcatcaagttcgaaggagaaaactccaacatcaactccaacacgatgtttctcgaagaagcgcctcttcttcttggttaggatctcaggggagtgaggacaaccacca

SEQ ID NO: 24858 - DNA, 2117 bp, Zea mays
atatttttttttttttttttttttttttttttttttttttgcctggagaatagtagtagtatcaattttaatatcagcaaatacaatatagtatgagattctgaatggatatggctgcgacaaatctgttttcatggggcttacaacatatggacatagccccagaaggaacatgtatgagaagcaatcactcccccatcatacatttgtagctacagatcaatacttacaacacccatttgtgcgacccaagattgtcgtaagaaagaactcgaaaggcggaaacagaaacaaaccatgcacaggaggcctcctttgtcttcgatctccccgctttggtctcctccattgtgaccccacttatatctcctctattggtcacacttcatagttaaattagtttaggtcacggtccgtgtgatttgcttccaatagaggatgctagtaaccattctgatcttctgccagatagtttgctgccaaagtcaccatctcgaacatctgacaaaatcagaatgaagatggaaccgctgtttcttgggccttggttcccttaggcctccacatggtccgggccttcactatggtcggacctgattcaaggctcagcacatgctcacagtgcaaggttgtttctccagactcaatgttgcaatcctcatggacagaggtgtgtgactgcagcacactatcgcggacacactcccttttgtaatccagcacaatgctggccagctcatgattctcaaaaatagtaatcggtgcactctcaagaatccacgcaatgtatttaacattattgacatgctggtttatatcaagatcagcccaacgaggagtcaggcctgtcctcacatatttagctgcagaagtgctttgaccctctggcagttttggaagcttgcggttgtcttcatcaacaatagcagaacgcccaacaaagtatggctctatttcagtccgcacttcatctggaattcttgcaagcttcctagtgagtttgttcatcataacccatttacttgtcgccttcagtattgtgtggcctgtcatagaatcacgtatatgccaatccctacgcattccatttttaccattagcactaacccatgtatttacttcaacagtatcaccccagcatggataacgctcgacgatagcctgcatctggctaaccacccagaataagttccgtttactcatctctggtgtggagccgaatccatcacctagcagcccagcggtcttcacatgattaagtgccgtttcctgcaaatggttcatcattgtctctatagatgccgtcctatcagccccaatctcataggacctaatggagaagttctgcttgaacatgaggccatcatgtatgatccggccaaacccaaaagtgtcagtgagcatgtcaggccgcctgggcttccaatcaagcatcgtccactgcttctcggcggccaagaagatggtcgtgatggcagcaaggagcatgctccagtcgggaagctggttgtagaaagtcctcggcaccgacgaaggtacagttacggtctcgtgttccacatccgccaccgcagacttgccaccgttcaccttggggacggcagcgtgggcgcgcgtcttgcccgccctcacggcattagacgaggctcccggcttcgccgcaacgccgcggacgtccaggctctctgggcgctctccaaggccgttcttaggagcggccggcgccggcgaccctggaaagaagggcgaggccgcgatggaggcggccataggaaagtaccccgcgccaaatcaaatcgaatggcaccagtctgaatcctgggatctcaaccttccgcggacggcggcggcgagggcaagggcaagggcaagggcaaagggggcttggctgttggtgcctgcttcttccgtcgggtgcgcttcaccacacggccattggcggcgcgccgatgagggagggagggagggagggagggggggctcccggcccgggcggatgtggtgggggactggcggtgtttggcggcttcgggcagctgcggccggggcggggccggggccggtcgtctctgctggcaccggtcgttggctcgttgcccaccgcgaccttttaaaac

SEQ ID NO: 24859 - DNA, 916 bp, Zea mays
  misc_feature (8)..(8): n is a, c, g, or t
  misc_feature (64)..(64): n is a, c, g, or t
  misc_feature (892)..(892): n is a, c, g, or t
  misc_feature (896)..(896): n is a, c, g, or t
  misc_feature (899)..(899): n is a, c, g, or t
  misc_feature (902)..(902): n is a, c, g, or t
tagcagcncagcggtcttcacatgattaagtgccgtttcctgcaaatggttcatcattgtctcntatagatgccgtcctatcagccccaatctcataggacctaatggagaagttctgcttgaacatgaggccatcatgtatgatccggccaaacccaaaagtgtcagtgagcatgtcaggccgcctgggcttccaatcaagcatcgtccactgcttctcggcggccaagaagatggtcgtgatggcagcaaggagcatgctccagtcgggaagctggttgtagaaagtcctcggcaccgacgaaggtacagttacggtctcgtgttccacatccgccaccgcagacttgccaccgttcaccttggggacggcagcgtgggcgcgcgtcttgcccgccctcacggcattagacgaggctcccggcttcgccgcaacgccgcggacgtccaggctctctgggcgctctccaaggccgttcttaggagcggccggcgccggcgaccctggaaagaagggcgaggccgcgatggaggcggccataggaaagtaccccgcgccaaatcaaatcgaatggcaccagtctgaatcctgggatctcaaccttccgcggacggcggcggcgagggcaagggcaagggcaagggcaaagggggcttggctgttggtgcctgcttcttccgtcgggtgcgcttcaccacacggccattggcggcgcgccgatgagggagggagggagggagggagagggttctggcggatgtggtgggggactggcggtgtttggcggcttcgggcagctgcggccggggcggggccggggccggtcgtctctgctggcaccggtcgttggctcgttgcccaccgcgaccttttaaaacatcccggccggtnatgntcnagntaatggtctcgtgc

SEQ ID NO: 24860 - DNA, 1111 bp, Zea mays
agtgagtttgttcatcataacccatttacttgttgcttcaagtatcgtgaggcctgttataggatcgcgtatatgccattccctacgcattccatttttaccattagcactaacccatgtatctacttcaacagtatcaccccagcatggataacgctcgatgatggcctgcatttggctaaccacccagaaccaagtttcgtttactcatctctggtgtggagccaaatccatcacctagcagcccagcggtcttcacatgattgagtgccgtttcctgcaaatggttcatcagcgtctctatagatgccgtcctatctgccccaatctcataggacctaatggagaagttctgcctgaacatgagcccatcatgtatgatccggccaaacccaaacgtgtcagtgagcatgtcaggcctcctaggcttccagtcaagcatcgtccactgcttctctgcggccaagaagatggtggtgatggccgcaaggagcatgctccagtcgggaagctggttgtagaaagtcttcggcaccgaagaaggtacggtttcgtgctccccatccgccaccgcggacttgcccccaccgttcatcttggggaccgcagcgtgggcgcgcgtcttgctcgccctcacggcactagacgaggctcccggcttcgccgcaacgccgcggacgtccaggctctctgggcgctccccaaggccgttcttaggagcggccggcgccggtgaccctggaaagaaggacgaggccgcgatggaggcggccataggaaagtgctccgcgccaaatcaaatcgaatggtagcacctgtctgaatccgggatctcaatcttgcgcgggcggcgacggcgagggcacagggggcttgggtgttggtgcgtgcttcttccgtcgggtgcgcttcaccacgcggccattggcagcgcgccgatgggggagagcgagggaggaagaggcttctggcggataggggtggtggtgtttggcggcttcgcgggcgctgcggtggggggcggcgcggggccgggccccggccggccccgggcgaactctgtttcttttctccgctggcgctggcactgacaccccccagcccggccggc

SEQ ID NO: 24861 - DNA, 636 bp, Zea mays
ggccgctttttttttggccgcttgatccaagagtagtcttaatccaattattagcatctctcaaacagtgtaaaattaagaaccaaactgcagttctctatagtttatacatatatcatgtactaattacgagatccatggtcacacaatgaaaaaaaatgaacacgtaattacgtaactatacacaccaaaacacgagagcgagagagagaaagaagaagaatctgagcaggcaaacaattcggctgggcacaacacagagaatttccgacggtcaaacacggtgtgtacgcctgaatgttcacggcgttcagaagaggtagccgaagacaagcgcggtgaaggacgcagcggcaacggccggcgcggccatggacgcggcgggacgtcggagcgggcgccggtccctcggccgctgaggccgtgccgaccagggacgcggcgacggccgccgccacgatgaggatcctgagcttcagggtggccgccatttgctcctcggtcttagtggaacgacgagatgtattgcttgcgagtgcagcgagagcaagctgtggaagccgtgagtgtgtgtgtgaagctcgtgttcgcggattaccccgccggcctccgagggccccaatcgcccctaggagt

SEQ ID NO: 24862 - DNA, 1943 bp, Zea mays
gcacatttcggccatgcatatatatatagcacacagtgacgcctcaatgacgaagacttaaaagagttgcattgcttacagatccgcgcgcagtactcctagccttaacaattaaatatctgcagctatagcgcccctctccatggcacccaaattgtttgatctcgctctagctagctagacaagatctcatcacgtacacacaaacacagaaacgcaagtcatatactctcagcgtctctgtagctatataatatatgcccatgcatgcattgtcggtgtgtgcaccatataccatacgcatatatagcatcaagaggagccagccttcttgagcattctcctgcttccaccaggatggctgctcctgatgctatgcatgcaggtgcagcccatacatgcatatggcgcacacagacacacacaagtgttcctcacagcatcgatcgtacgtcctggccagcatcatctacgcaccgaaccccatgccgaaagccggcgcagctgccgcccagtagtctgcggggccagcgaccacgtccacacccacgtccagcgtgcagctcaccgggacgaggcacagacccctgcttctcagatccttcttcttctcttcatcacagctttcttcatcctgctcaccatcaggctgcagtccggcccgtttctttattgcgctgctgtcatgcaggagctggccagggtcttctggaaatatgctgtgcctgctttctctctgcgcactagcctcgtggagctgctgattctgcttggagccgcccccacctccattgctgccgcccacgtacggggagctcagagcctcaatttgactatggaggaatctgatgtacccaatggcttcaaggagtacagacgctgtgtcagtctttccaaacggggagacaagctggtggagagcagttattcgatcccctagcttctccttcctcaccttcacagtagattgagccggggagggttcttgggtcctagccttcttgaaagctgatccagatactgtactgatgcactcacgtggtgaactgctactgttgttggagaactccagcatgttgcttccgggagaggtcgtcgtcgctgtggttctggaagaagacctaggagaggacgctttctgctgctgctggagtacgctgctgcttccccatggcaactggatctcgacatcacttgtgctgctcccatggctagccgctgcggcaccgtagacgacgtagctgctgccgccgcctccggattccgaacaaatcgtagttggaaacgccatctgctggctttccttgtgtatgagctggctccaagaatccggctggccatggctacttgtgatgctggtgtcgtgctgccacggcgacgtgctggtggtggtaggcagcgggtagtggttcgagagcagcagagaggagaaggattggagaggcggcgacgacgacgaagaagaagagggcgcggcggcggcggtgctgctgctggtggttgtggacggcatgaaaagagaagcgtggtgctgctgctcaaaggggggcctcagcaaattattcatgctccaccatccatttttcgattaggatgttctaggtaatggcctgcctcccccatctcgcgcactagagccgccgatgatttgtggacgactcccctatccatattctcctccctctgatccctccctccctctctctctctcactgtctcacacacaaagcaaggacgtgcagggcacttattgcttgccctcctctatctctctctctctctccctagcttttgtgcactcgtcgatcgatcgccaccatctcttcgatcgcgagccctttacttgctgaggtcaacctctagacagaggtgagagaaagcatatgggcctttggagcaggggaggaatctcaagtgagtggcacggcaagaagaagctcccg

SEQ ID NO: 24863 - DNA, 1641 bp, Zea mays
gggaccctcgaggccggccggggacccggtacgatccgtatgtagatcgtccagccgacggctctgatgtgactgggccctccgcgcccggccgggaacccgggtgccttcacgcttgacaggcacccatcccacgccacgggctcctcctcccctccgcttctcctctaggtccctctcctacagaacccttccaatccaaagcgaatcctccgggccgccgcggcggcgtctccccgggcgcccctagcacagctcgcgttccggtggaacagagaagagaggcgagaggatggagatccagtcgtctggccgctccatcgaggggctgatggagaaggtgctgtccgtgaacatcctctcctcggactacttcaaggagctcttcaagtacaagacctaccacgaggtcgtcgacgagatctacaaccaggtggaccacgtcgagccctggatgaccggcaactgccgcgggccctcctccgccttctgcctcctctacaagttattcaccatgaagctcaccgtcaagcagatgcacggcctgctcaagcaccaggactccccctacatcagagctattggattcctctacctacgatacgttgcagaaccgaagacactttggacttggtatgaaccctatatcaaggatgacgaggagtttgcacctggatcaaatcgtaaagtgactacaatgggcgtttatgtgcgtgatctcctccttggtcagtactatttcgacagtctccttccacgagtgcctctcccaatcctccgacaggtcactagccaccttgagaagctaaagcttccaacaaagcagtcaggaatgactggggattccaacaggcttgaatcaaatgataccgccagaaggcctccttccgtaaaggcttctttgtctgtctcctttggtcagcgcgctccacaccgtgcatccacaagggattcttccccggtccgaagaacgttaccttccaaacaggacaaggaaggtgaccgtgcgaaatcgccaccgatgaagcaccggagtcggagctctgagcgtgatcatgatttggagagggagcgctcggatcgtgaacgtggcagtggcaggtactacaaggatagggagcctgatcggcatgctcgtgagcacagagaccgcgatcatcgtcggtctgattattcgaacagggatggcgaaacacgaggccgtgaaaggagggacagggattctgaccggagtagacatgcaagcgtccgcaggagcaggagcaggagtccagtccgtggcagaagtgatggcgacaaacatcgctccagcccgtttggtagggctccagaattgtcgaacctggcgaagctgaaggatctgtacggcgatgcgacaaacgtgaagaatgatgctggcgacgatagggcgcacagggattctggaacggaagaggtgatccgactgggaggggcaaggtggaggtgagtctcatgttaagggacagtgggacaccacggtgatgcatttaggtccatgaatgaatccaaacagcatcagtggaggaaatgatgggctgtatgtcttaacttgaacctacgatttcaatgctttattctgaaggttttcctctcattatgctaaaaaaaaaaaaaaaaccc

SEQ ID NO: 24864 - DNA, 1824 bp, Zea mays
cagccgacggctctgatgtgactgagcagtgagcacccggccggggactgagcagtgagcacacgcgcttgacaggcacccatcccacgccacgggctcctcctcccctccgcttctcctctaggtccctctcctacagaaccctcccaatccaaagcgattcctccggaccgccgcggcggcgtctccccgggcgcccctagcacagctcgcgttccggtggaacagagaagagaggcgagaggatggagatccagtcgtctggccgctccatcgaggggctgatggagaaggtgctgtccgtgaatatcctctcttcggactacttcaaggagctcttcaagtacaagacctaccacgaggtcgtcgacgagatctacaaccaggtggaccacgtcgagccctggatgaccggcaactgccgcggcccctcctccgccttctgcctcctctacaagttattcaccatgaagctcaccgtcaagcagatgcacggcctgctcaagcaccaggactccccctacatcagagctattggattcctctacctacgatacgttgcagaaccgaagacactttggacttggtatgaaccctatatcaaggatgacgaggagtttgcacctggatcaaatcgtaaagtgactacaatgggcgtttatgtgcgtgatctcctccttggtcaggtatatctcttgaagttatttcacaattcttccatataaaaaaacagtatcctgagctgctatcacagtgtctccttagttatccaactacatccgagggcagagaccgttaaccatattattttctgaacttaaatgcaattagtcttccttgaatcactcgcctgttgatttggcatactgaggggatgtttcaattgtggagttgcttttaagaggagacatcatctcttccgccagtaacatcactgtataagtactatttcgacagtctccttccacgagtgcctctcccaatcctccgacaggtcactagccaccttgagaagctaaagcttccaacaaagcagtcaggaatgactggggattccaacaggcttgaatcaaatgataccgccagaaggcctccttccgtaaaggcttctttgtctgtctcctttggtcagcgcgctccacaccgtgcatccacaagggattcttccccggtccgaagaacgttaccttccaaacaggacaaggaaggtgaccgtgcgaaatcgccaccgatgaagcaccggagtcggagctctgagcgtgatcatgatttggagagggagcgctcggatcgtgaacgtggcagtggcaggtactacaaggatagggagcctgatcggcatgctcgtgagcacagagaccgcgatcatcgtcggtctgattattcgaacagggatggcgaaacacgaggccgtgaaaggagggacagggattctgaccggagtagacatgcaagcgtccgcaggagcaggagcaggagtccagtccgtggcagaagtgatggcgacaaacatcgctccagcccgtttggtagggctccagaattgtcgaacctggcgaagctgaaggatctgtacggcgatgcgacaaacgtgaagaatgatgctggcgacgatagggcgcacagggattctggaacggaagaggtgatccgactgggaggggcaaggtggaggtgagtctcatgttaagggacagtgggacaccacggtgatgcatttaggtccatgaatgaatccaaacagcatcagtggaggaaatgatgggctgtatgtcttaacttgaacctacgatttcaatgctttattctgaaggttttcctctc

SEQ ID NO: 24865 - DNA, 1606 bp, Zea mays
agctttctaagtccagtctcccgggcagaagaggcacgagaggaaggtgggaaaggaaaccacagccgcttctggcgggcgctcaccgtgccccttccgcctcgcctcgcaatggaggtttccattgggtacctcgaggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggagggagggagggagagagagagagagaatgttcctgtttatgtagagatggagtccaaaatttgtgtgcctgatgagttcttccccatatgatattaactgaaatagtatatcaattgagtgtattccattttaagtttcaaaaaaaaaaaaaaaa

SEQ ID NO: 24866 - DNA, 1815 bp, Zea mays
aggccggccgggccgggctcttctcccgctttctaagtccagtctccccggtagaagaggcacgagaggaaggtgggggaaggaaaccacagccgcttctggcgggcgctcaccctgccccttccacctcgcctcgcctcgcaatggaggtttccaggtggaccccggcggccggcctcctgctcctgttgctcctcccgctcgcggccaccccgtcacgcgccgccacgatggcgagatcgccgtcgtcgtccactgccgtgttccagctccagggagacgtataccccaccggccactactatgtcacgatgaacattgggaacccagcgaagccctacttcctggacgtggacactggcagcgatctcacctggctgcagtgcgacgcaccctgtcggagttgcaacaaggtgccacatcccttgtatcgaccaacggcaaaccgccttgtaccgtgtgcaaacgcactctgcactgcacttcacagcggacagggctctaataacaagtgcccttcaccaaaacaatgcgactatcagataaagtacaccgacagtgcatcttctcagggtgtgctgatcaacgacagcttctcactgcccatgagatcctccaacattcgtcctggcctcacatttggctgtggatatgaccagcaagtggggaaaaatggcgctgtgcaggcagcgattgacggcatgcttgggctcgggaggggatcagttagccttgtttcacagctcaagcagcaagggatcaccaaaaatgtcgtcggccattgcctaagcacgaatggaggggggttcctcttctttggggatgatgttgtgccttcatcacgtgtaacttgggtgccgatggctcagaggacatctgggaactactactcacctggctcaggaacactgtacttcgatagacgttcactaggcgtgaagccaatggaggtggtatttgacagtggtagcacctatacttattttactgctcaaccataccaagctgttgtttctgcgctcaaaggtggtctcagcaaatcacttaaacaggtgtcagatcccactctgcctctgtgctggaaagggcagaaagcattcaaatctgtgtttgacgtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggagagagagagagagaatgttcctgtttatgtagagatggagtccaaaatttgtgtgcctgatgagttcttccccatatgatattaactgaaatagtatatcaattgaatgtattacattttaagttttaaaaaaaaaaaaaaaaaaacaaaaaaaaaaaaaaaaaaaagcaaaccccccgcgaagacgcttcccgagcttctccttcgttcctccttttccccgcggttttcctctgccccgcaccgggaccgccagggttttgccgccgacctctcgctcgttttcgggcttccggaggcaaccgtccggaccggccggtcgaaatggtggt

SEQ ID NO: 24867 - DNA, 1465 bp, Zea mays
cgccgggaaaccgtcccccgccgcccgcgttcctcactctttttttatcccctcctctgccattccctccctctcccctcaacccagcgcccccctcccgccgccactagggtttctcctccccgcccacccccaaaccatccccgaagcttccagtgcgtcgcgccgcaaccatgagcgacggtaaggactccctcgacctctccgccctcggcgccgccatccccaactcggccgagctcagcgcggaagacaaggctaaccttgtggcgtcgatcaagaacacgctcgagggattggcgtcgcggcataccgacgtgctcgagaacctcgagcccaaggtcaggaagcgcgttgagaagctcagggagatccagggcgaacacgatgaacttgaggcgaagtttttcgaagagagagctgctctagaagctaagtatcagaagttgtatgaaccactttactcaaagcgttatgaaattgtcaatggtgtggtcgagattgagggtatcacaaaagaaagtgcagctgaaaccccagaggagcaaaaaagtggagatgagacctctgctgagcaaaaagaagaaaaaggtgtaccagctttctggcttaatgcaatgaagaatcatgaaattttagctgaggagatccaggagagggatgaggaagctctcaagtacctcaaggacatcaagtggtacaggatcagcgagccgaagggttttaagcttgaatttcactttggtacgaatatgttcttcaagaattcggtgcttacaaaaacatatcacatgatcgatgaggatgaaccaattctggagaaagccattggtactgaaattgaatggtaccctgggaagtgcttgacacaaaaagtgctaaaaaagaagccacggaaggggtcaaagaacacgaaacctatcacaaaaactgaagattgtgagagcttcttcaacttcttcagtccacctcaagtccctgatgacgacgaggaaattgatgaggacacagctgaacagttgcagaaccaaatggagcaagattatgatattggatctaccatcagagacaagattatcccacatgctgtctcgtggttcactggagaggctgctcaagatgaggactttgaagttatggatggcgaggacgacgacgatgaagacgacgatgatgaagacgacgaggatgaagatgacgatgattatgatacaaagaagaccaagggaactgctggaggggaagggcagcagggtgaacgacctgcagagtgcaagcaacagtgaggtgtgatgtcattaagttggttttgtggggccgttgggtgggggttcttgttggttttatggaactggcggggggatttttctgggacatgttacatgtgggtctgtattgggtttcagaatgttatatatgctcttcatatgcttggagtgaagatggctcatggttgccactctgg

SEQ ID NO: 24868 - DNA, 2421 bp, Zea mays
  misc_feature (1402)..(1402): n is a, c, g, or t
  misc_feature (2032)..(2032): n is a, c, g, or t
accagacctctcctccgcctttcccgtgtcgtgtcccccgcagcaatcaccgcgagggtttcttccaatcccgttcgttccgttccagttccagcatggcggagcagccgcaggaaggcggcgcgagccccaagcacgagtccctgatggagaagctcgccgacaagctccacgtcggcggcggcaagggcgactcctcgtcctcggactccgacagagacgagccgccccacccctcggcgccgcccaccgacgaggtcaagcagccctcattctccgactccgccgccacggcggccgccgaggccaaggccaaggtgttccgcctcttcggccgcgagcagcccatccacaaggcgcttggtggaggcaagcctgctgatgtgttcctgtggaggaacaggaacatctccgccggagtacttggtggagccacagcaatctggatcctatttgaattgcttggctaccatcttcttacttttgtttgccatggtctcatattctctctgggtgttctctttctctggtctaatgcttcatcgtttatccacaagtctcccccaaagatcccagaggtggtcattcctgaagatttagttgtcaacattgcggtatccactcgttatgagatcaacagggcctttgctaatctccgccaaattgctcttggccgggacattaagaagttcctaatggttattgctgggctttggttgctttctgtccttggaagttgctgcaacttattgaccttagtctacattgtgtttgtggtgctgcacacagtacctgtcctgtatgagaagtatgaggatcagattgacacctatggcgagaaggggtgggttgagattaagaagcagtacgccgtgttcgatgagaaggttctgagcaaagtaccaaggggtcccgcgaaagacaagaagcactagaagaagtgattcgaggtttggctctcagtagggaatactagcaatcggtttgagtctcatcaggagacagcgcttgtgggtatgaagcgccaatttgccacctatgcatcgtgttgtgtatggctgctttttgtttgatatttgatgggagtagccgaattgctagctttacccttcatcagcgatgcatacacagcatacggttttcggtagcgctgtttgattttgatctgtgttgtaagatgtcatgccaatactgtacctgagacactgtttttgataacgatgcagtttggaatttgatggtttttgtgctcaaatggtgagcttaggtaacagcatgcttcttgagagtggcaacacgaaaacggcagaaacatggttcttgggttaaaatttatttcaatatctaggatccgagcgatctattttgtttaggatcagagtgatcagaaaaggaacatatntaatgtaaaccatgttttttgcaaatctcgtgcaaacttactaaaataagtctaaaaaattctgaaaaaacatgaatgtacatctgagattacctcatatatatatatatatatatatatatatatataattttatggttaaattcatttttactttagccgttataaaaaaaaataaatttttaacaaacagtaatagttcagatatactaaaatttatcttttttgtaattgctagagtaagatgaatttgaccatgaaattttgtatataaatcatgaaattttgtatataaatgaggtaagctcagatgtatattcatatttttttagaattttttaaaacttttttagtaggttttttagaattttttaaaacttttttagtaggttttttagaattttttaaaacttttttagtaggtttgcacgagttttcattcgatatgttccggatcagaaaacggtcgtagacatgagaatagaacagaacagttgtagacagaatatccattgccacgctcacagattttgtttggagtcttggagaagatatatataagctgctttaaaaacctttcgttgccacaacctaccagtttgtacatatacagaaggatgatgcgaccangaaaagatgaagagaagagcgatctacaccgcagatccattattagtgtaatacaacaacaaccagcacaggcaaactggaattttggtggagatgaaaactgtccttccttgtcctacaccagatactggcttttacggcctgatttcttgtccttgtccccctaacacgcacccttttctcatgttcttcttatacacgattacatgttcggtctatttcctcatggctgctttgtgctctactctacttctcaaattatgttcatacatttttgcgcctgattttcatattgctcagaggaagtatgtcaactgctgcttctttctggagccgccttcaccgtacaactcgttccattgcctcagctcgctcattatggcgcctca

SEQ ID NO: 24869 - DNA, 1304 bp, Zea mays
tcgagtcagctccgcgggcccccccccaagatctcccccatttctcctccacgccgccccctccgcatttcccgtgctcctctcgttccggcatggcggagcagacgcagccacaaggggaaggcggcgctagccccaagcacgagtccctgatggagaagctcgccgacaagctccacgtcggcggcggcaaggccgactcctcctcctcctcggactccgacagtgacgagcggccccgcccctcggcaccgcccgccgacgagctcaagcagccctccttctccgacgccgccgccacggcggccgccgaggccaaagccaaggtgttccgccttttcggccgcgagcagcccatccacaaggccctcggtggcggcaagcctgctgatgtgttcttgtggaggaacaagaacatctctgctggaatacttggtggtgccacagcaatctggatcttatttgaattgcttggctaccatctccttacttttgtttgccatggtctcatattcgccctgggtgttctctttctctggtccaatgcttcatcgtttatccacaaggctccaccaaagatcccagaggtgatcattcctgaagatttagttgtcaacattgcgctatccactcgttacgagatcaacagagcctttgccaatctccgccagattgctcttggccgggacctaaagaagttcctaatggttattgctgggttttggttgctttctgttcttggaagctgctgcaacttcttgaccttagtttacattgtctttgtggtgctgcacacagtacctgtcctgtatgagaagtacgaggatcagattgactcgtatggcgagaaggggtgggttgaaattaagaagcagtatgccgtgttcgatgagaaggttctgagcaaagtacccaggggtcctgcgaaagacaagaagcactagatgcaagtgattcgaggtccctgttagtagggaatgctagcaaaaccggttcgagtttctccggaggggggcagcacttgtgggtgtgagcaccagtttgccacctgtgcattacgttgcgtatggctgcttagttgtttggtcttgatgggagtaagccgaattgctagctttgcgcttcatcagtgatgcagacgcagcatacgaatttctgtagtgctgtttgagtttgatctgtgttgtatgatgtgtgcagactgtgcttgcgacacttttttggtacttatatatcgatgcattttggaatttgatgattaaaaaaaaaaaaaaaaaaaaactgtaacccggaaaaaaaaaaag

SEQ ID NO: 24870 - DNA, 3614 bp, Zea mays
ggtgtttaaatagtgtttactagatgactgctaaacgatcaaaacataccacacattaaacacaagaccatgtttgtgttgtttgtggatggtaacagcaagcgtagagcaaatggactattagattataataatttgacacgatgtatagcaccacaaagaaaattccataaaacgcatgttacggaaaatatctacgcgttaaagcaacagataataatggtttaaaattgtaaagaatttttatcatgataccgtcgtcttttaaaatgtccatcactcaatctcttgcaacaaaaatgacgtcacacggtcagacaaacaagttaatgagcacaccatcactactcactagtctattatccttgcatgcagcacccacatggcaacatgggtgtacagtgaagtccagcacaagaagtaaaacacttgaaacacacacacaaaaaaaacacatcatacacactagtgcactttatgaggggaaaaaaagccctgtgttgtatagtttgccgaatgcagattacaatttgaaagtttggggcaagcaggtcgtttggcagtaagaatccagcatgtggattgttagttgttacaatttatgagttgtctgctgaaatataaaataaaattggacccaaagaaaatagaaaagaaaagaaaaaactgtgggacagtacaaggggccgcctagcaactagcatatatatacccacacatgttctcgatttcccgcaaggcacaagtaactttttgttgcatcccaccctcatttgacgctgatgataaaaaggccctcgcggtcgcaccacatacaggcaaccagcctcttgatcacttgatcctcctgcacaccagagtaccagacaccactgcgcatcagtgcaaagaggtagctaccctatctgccatggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggaggaaggctgtgctggtaataaggcggcgccggccaagaagcgaccgcggggcagcgaggggaagcacccgacgttccgcggcgtgcggatgcgggcgtggggcaagtgggtgtcggagatccgcgagccgcgcaagaagtcgcgcatatggctcggcacgttccccaccgccgagatggccgcgcgcgcccacgacgtcgcggcgctcgccatcaagggccgcgccgcgcacctcaacttcccggacctcgccggcgcgctcccgcgcgccgcgtccgcggcgcccaaggacgtccaggcagccgccgcattggccgctgcgttcacgtcgccgtcatcggagcccggcgccggcgcgcacgaggagcccgctgccaaggacggcgccgcgcccgaggaggcagccgccgacgcacaggcaccagtaccagtagcactaccaccgccggcggcctctcggccagggacgccgtcgagcggcgtggaggacgagcggcagctgttcgacctgccggacctgctcctcgacatccgggacgggttcgggcgcttcccgccgatgtgggccccgctcactgacgtggaggaggtggtcaatgcggagctgcgcctcgaggagccgctgctttgggagtagcggtcagagatgctcgttgcctgcattgcaaacgaggtctaaacaatagtagcagtggtatcccatttcttcttcgttttgcttctcgccctctcctttttttctctctttcttgcttactttggggggaaaacagctagttctttttttcttcttcttcttcttcttttattaaattgagttttaataagtataaacatatataaacgagagagagatataagctgtgtacttaaaagtgtaagacgagtacctatcagttcattattacgtatctactagtggtaccagtagtgatcatgttgtcccggccgtgtgtgaattccagcggtagttgttgaccttgctagatttttatagttgcttgtgttgtgtgctgtaccaaaattccccagggaaaaagggcaggaagcaaacgaatgtaacgggaacacaagcagcatctaatctctattactgctgacaacgaaacctcacggtcacacagaagagaagcatagcagttgtctattacagctgcagtgataaaaatcagaggtggctagtccaggtccctacgtaccccaattttttttactaccgtcaagtgtagttaacctattgttcagcttcagcagcaacgctggactggtggcgtctgattggcgtgtcccgccttgttctgccccaccatgatgatcaagtggtgacaaaagtgttgcaatcctcatgtggttagctgcagagcatctcgcgttccatctacagttctctgcagctttggaaggctccttttgcttccccggagatgctgatgcggcgatgcccacgcccaatgctacaggtacagggagcgagcgcggcttgtattttagtcgcggacaccatttgcagcgcggaaagctgatggtcgcccttaccgcatccgcaaccatggctgcctgcctgcctgaaggcttctcttctgtcttctgctctgcccttccgtgggaacagggcgccgctgcccctcccggtcccgggcacccggcaaggcaaagcgccggccaagccgtgcgtgcatgacaagctggccgtgccacggtggagatagccacgccacgtcggcagcggtgccgctgtctggctgagctggtgatcagctgcaccgcactgggctaggctcctgtcctcgtcctcggtgtccagctcccagtgttgagttttgacttgggtgtatacggccggccctggacgtgcgtgcggacgtggtggcgtagagccgtagacgaatacagtacgtacggttttgcagtagtactcggtaccccctgccttcgtagcgcgtacgacgtacgcggaccgtgcgcacgtcaggccaggccgccgcgcggtcgttttcgagatgtggatcgttcgcggtcgagctggacacagttgtcaccctacacccctatagcttgtgtgcgtgccattaattgggcaagcattgaacgactggacgagcgaggatgaagttcagtaggatcttcgattcatgtatctatagtactgctcccttccgtccaaaacaactactactaatcggtatatatggtggtattcataccatatcgactaaacaatttcaactgagtttgcaaaaaaaaagagtattaatatttatatctccaaataattttattataaaaaataacttcaacaacctgtttaatgatgctactcactacgatccaaactataaatggctttgactctttttttttgatacatcatttttgctagtatcttaatataatgtatgcttaggtatatagcagaatcgccgtatctaaaaagtcgaagtgatttttaatctaaatcagacggagtaattatatactataaatattaacatttt

SEQ ID NO: 24871 - DNA, 1772 bp, Zea mays
tgaggtggttggctaaagttgaagacctatgtgagaaatgcctgggtgaactgtaataatacgtttgtcctgcacgagtttgttaactgcgtccctggttctcctcaaaaaaaaaaaaaaaacatgggatcgccggccccgggcccgggcctcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtctctgatctactcattttcttttcttccccttttggtgacataggtaggtctagttaagatctgtcgtgcctgttctttgattttagctaagaaccaggcgatttagtcttcttcttccttacaaaaaaaatccccagaaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccacggggcccagtacccggcgacccacctgagcccggcgcagatgcagttcatccaggcccagctccacctgcagcggaacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcggcgctggcctacgaccaggcggcgtaccgcctccgcggggacgcggcgcggctcaacttccccgacaacgcggagtccagggcgccgctcgaccccgccgtggacgccaagctgcaggccatctgcgccaccatcgccgccgcgtcgtcgtcatccaagaattccaaggccaagagcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtatctctggccgccgcagatgaggttttaggcaatctgcaggccgccggcccatgtgtattaagtaggttttgctcagttgttggccctggacttcgccggcgtttttgtgaccggcgtccccgagtgcactgcattggtgtactggtctgtctgtaaaaaaaatggatctgtgtacttctatagtgtgtattcaaccattgttcttagttgtgatgttactcgtgctgaaaaaaagcgggggcggctttcgtcaaaaaaaaaaaaaaaaaaaaaaaaaaaaaaaaaaaaaaaaa

SEQ ID NO: 24872 - DNA, 3639 bp, Zea mays
  misc_feature (1300)..(1300): n is a, c, g, or t
ataaataaaaagtgttgagatctttttggttgatagattacatatgtattattgtgagccgtaacaacgcacggataaccaactagtatctatacgtgattcgtaccattaccattggcgtcatataagatgtgacaaacaaagcacggatccatccataaaaaaagagacaaaaaggttctttgttagtactgcagtactgataaataaaacaaatcagcggtgcacgccactaccacagtagtacaccactgctatctgcgccgcagcccgcaggccgcacacttgcgtgcgggttcgctataacacgcgcccggcaggtctcctgtcctgtcctaccgccgcactctggaacccattcttacagcgaacagccaaacgatcccactggctctgcgccacgcgtccgcagactgacacgttccggtcgcgtcccggacacgtgtcctgcgaacgcacacgtggtgccacgggagtggctccctgacctgtcactgagcccgccgataccacccgacgcagccgcggattctccgtgtggacccgggcccgcatggaagcggcacagacgaagcttcatgggttggagccctcgggcgaaaagtatgattaggagagtggttagtgagcaggttgataaggttgaaaaagatcatcgctgcctataaaagagccggccgtggtgtccccactgggctactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtctctgatctactcattttcttttcttccccttttggtgacataggtaggtctagttaagatctgtcgtgccagttctttgattttagctaagaaccaggcgatttagtcttcttccttcctaacaaaaaaattccccagaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccagtacccggcgacccacctgaggcccggncgcagatgcagttcatccaggcccagctccacctgcagcggaacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcggcgctggcctacgaccaggcggcgtaccgcctccgcggggacgcggcgcggctcaacttccccgacaacgcggagtccagggcgccgctcgaccccgccgtggacgccaagctgcaggccatctgcgccaccatcgccgccgcgtcgtcgtcatccaagaattccaaggccaagagcaaggcgacgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtgtctctggccgccgcagatgaggttttaggcaatctgcaggccgccggcccatgtgtattaagtaggttttgctcagttgttggccctggacttcgccggcgtttttgtgaccggcgtccccgagtgcactgcattggtgtactggtctgtctgtaaaaaaaatggatctgtacttctatagtgtgtattcaaccattgttcttagttgtgatgttactcgtgctgcaaaattgcctttgcggatttcgtccattgtgttctctttgatgcatacatggcctttttgggagtttgtgtactgtatacatacacttgccagcgtctatagctaccggcagatatggcagaaagttgcggataaacagtccggttgtttttcaaacgatctcaaagacgatcaagttctcgtgcaaataaagcgtgtttcgtgttctgtattctggccctgtttggcacagctggtgcttgttgaaaaagcagcttatctgagaagctggtgaaaagcagcttctgtttgttggctgcttttagtgtattctgagaagcagcggaactgataagctgctgcagaagctgcctgtttggtagaacctctgcttaaatttgtgaagaagctgaaaataagctgtgccaaacaggaccagaactgttgggagtgggtcgagaaagatcggagtggatttataaatatacttctatataaatttatataggatgtgatttatttccctcctatacaaatttatcctatacaaatttatatacgatgagatttaatccttctaaatttatccctaaccgaataagttataacgatctatatcgataatttcacatcggttatagctatagactaccacaactactttatctaatcttctcataattatataatgaatgtttaaatacacaacatttatttacttctctatttaagtacacaacatttagttacttcttaaaataagttaaaattatgcacaaatacatattcgaaccatagttattagcatctaaattcacacttacctaatcaacagaacatacaaatttttgtgatttatactgtatactcatataaatagaaaccataacaatgtacgagcactttgctaccatcaccttctagcaattctactactacgaaacaaaaaagacctttcaaattctttatgaaaaagaaactaagtgtgctattctaaatcaaaccaaagtcaaactttctagtgcttataaactcttatggctttatccctttcatagaaaggagataaaatgagaaatctttgatatccaatctttttagaatatcataaagtttaagtggcagaatttttttctaggactgttttatcaattcatttttattccattttaacctctgctaaattcgaactttcgtcgaaatcgtctctattcatatgtatgaaatatatatatgaaatacgtatgtggagttccctagagttttatgtgatttagtaaatagaatatggattccataattgctagattgatccgtagggattgatgaagagtgagctgataatagaaattttcttctataaataggaaacttaagattcaaatgctccgaaaggaaagagagaatgtccac

SEQ ID NO: 24873 - DNA, 1827 bp, Zea mays
  misc_feature (1799)..(1799): n is a, c, g, or t
tggtttctagttaaaaatgcatttggcagagaaatatatatagttgttgtaactcagctgtttgaattgttcttattattttaaagagatctctgctctatatagtttgggagcttatgccagggattaaatcatatatgccacttaatctattgaaacaatcctgtgtcatcaacaaggtggtctggagatacgtgatacattgtatatatggcatgatgcaaacattcagtgtcacataagaatattgaagaaggtttaaaatgcctctatttcattgagtcagaagtatcatgtgctactccacattagagagtagcatgaaataaatagacagaagttcatagagaagggatgttctcgttttcccttgggatgaggcgagggtttgcatgctactgttctgttgattatgccttgttctctggttctgttcaatgtaggacttataactactgtcactttcaaccgtctacttatattttgcttccatcttattcagagctttccacaaatacccatttcattttctttgttggcaattagttttgacttgaccatgttattcttctctacttccaggggatgtgcgtgcgtgttctcgtgccaagccggggcgaaggtaccgagcatgggtggacagactttttatcacacagactggttcagatagttgggtggggaggtttgacttgtgggaatcagaaggtgatgtgcgtgtgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcctatttggcgcgtaagataaatgttttgtctcatggctttcatgagaagatgaaattgactcatcttggtatatatttacaaatcttgaataatgcagcgttatctaaaaaaaaaaatgtcaacggcaatccagggaaattgggtttttacttcattactcattaatgctttatttggttagaagatgattgatggagaaattagtttatttccctttcatttcactccaatcctttctaaccaaataaaccacaggtatgttaatggagaacccttaaatttatgggggatctatatgcctaatatgcaaatataatttaaagccatccccaatctaatgtattttgtccaactagcaaaccttgtgccatataagtgcatatatagtacttcctgttacgtttgttgtgtgtgttctactatttgttcatatagtcttagtcaatgcatgtgttacatttaacacataacctgtgggtatccaatacctacatataggcataagtatagacatgaaatcacgcctatacatggttaggtgatacctattgagtatatgaacgtgttctcattcctaggtgtatgtcatattctcatgactaccgctatgataggcagcccgtagaattataaagatgttgcaataataaattttattcaatgtagtttatttctctatacttcgtttgggtttattcgtttctcaatatatggcacctatcgtttgtgtgtgctcgttaacatcacctgcaatcataattcataaaccttgtgtcatataagtgcatatatagtacttcatgttacatttgttgtgcgtnttctattatttgttcatatagtcttagt

SEQ ID NO: 24874 - DNA, 1776 bp, Zea mays
cattgggtacctcgaggccggccgggagtgtgatgttagacgacgggtggcaccgcgcgacgcctccgcaccaccgtccatattcccccatcaaactgcgaaccgaaaaaggagaagacggacaacgaattgggatcgaaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttgaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgcgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcctatttggcgcgtaagataaatgttttgtctcatggctttcatgagaagatgaaattgactcatcttggtatatatttacaaatcttgaataatgcagcgttatctatatccagggatgtcaacggcaatccagggaaaaaaaaaaaaaaaaaagcggcc

SEQ ID NO: 24875 - DNA, 1903 bp, Zea mays
atccacgtcgccggccgggactccactgcgccggctccctccacctcgctcatgtccgctcaccggggcgggctcagcatcctttcgaagaagtaacacttctccgtgaggcctgagcccctcgccgcggtgagccaagccggcgcacgtcgccccggggctcacgctcaccaccgagccccaaccaattaataatatatatatatagctaggatcgatcgtcagtaaaatggcaggctccgccgtcctgaggagccccctgtccgtcctcctctacatcctcgccgccgtgcccgccaccgccgcggcgacgccgaccgacgccgccatcgacgaggcgtacgcgcatctcgtcaacctcaccgctaaccaggagtactgggcggagcgcgcggaggcggcgcacgcgtacaaccgcgcggcgtaccagaccgaccccgtggccgtcgtgcagcgcttcaacgacggcgtgcacagggcgacggcgacgcggtcgcggtccctggcgcacagggcgcggggcccctgcacggcgaccaaccccatcgaccagtgctggcggtgccgccgcgactgggcccgcgaccgcaagcgcctggccaggtgcgccatgggcttcggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatcctccacaacctgcacgtccacgacgccgcggcgcacggcggcggcgcgatccgggactcgcagcaccactggggcgtgcgcggggagagcgacggcgacggcgtctccgtgatggggtccagcgatatctggatcgaccacctgtccatgagcagctgcgcggacgggctggtggacgcggtggacggctccaccgccatcaccgtctccaacggccacttcacgaggcacgaccacgttatgctgttcggggccagcgacgccgcgtccaaggacagggagatgcaggtcaccgtcgccttcaaccacttcggcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggctgcagctttcatcattggcgatcgatcgtaacaatgcaaggttgtgttgtatataactcttgtgtttggaatgccgcccgtaattaatggtcaactctaacactgcttgcctttgcctgccggccagcaaaaaaaaaaaaaaaaaaaaaaaaaaaatcaaactccatgcatccattgatgcgttccgatcatgttatggtgacaaacaagggagaaagtaccgagcatgggtggacagactttttatcacacagactggttcagatagttgggtggggaggtttgacttgtgg

SEQ ID NO: 24876 - DNA, 1656 bp, Zea mays
accaccgtccatattcccccatcaaactgcgaaccgaaaaaggagaagacggacaacgaattaggatcggaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttgaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgtgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcttatttggctttcatgagaagatgaaattgactcatcttggtatatatttacaaatcttgaataatgcagcgttatctatatccagggatgtcaaaaaaaaaaaaaaaa

SEQ ID NO: 24877 - DNA, 3481 bp, Zea mays
aattcggcacgaacatttctgggttttgggtcgtctccacgggctgggtttggggtcggtcggcggcggcggcggagctaggagtggaggcctgagatatactccaagcgggagtctgggcgctctctgcggtcggagaggcgcgggtgagatctacgagggccgctgcgtcgttctcgcagggccggcggaagacatgggtttcctctcggcgaagctgctgccgtcgtgcgagagcgtgtgcgtgtgctgccccgcgctgcgcccgagctcgcgccgccccgtcaagcgctacaagaagctgctcgccgagatattccccaagacgcccgatggtgctccgaatgagaggaaaatagtgaagttgtgcgagtatgctgcgaagaacccattgcgcataccaaagattgccaagtttctagagcagaggagtcacaaggagctgcgctctgcccatgtgaacttcgtcagaatcatcactgaagcttacagcaagctactcttcatttgtaaggagcagatggcatattttgccatcagcctagtgaatgtccttaccgagcttctagaaagcaagcaggagaatgttcacatccttggctgtcaaactttagcaaactttattaacagtcaggtagacaacacatatgcacgcaatattgaaagcttggtgcacaaagtatgtgcactttcacgtcgacaaggagaggatcacaggcttcttagggccgcaagcttgcagtgtctgtcagcaatgatctggttcatgaaggagcattcatacatatttgctgattttgatgagatagtgcattcagtgctggaaaattataggacagaggaatctaatggtggtggtgatgacagacatgcattgcagcataattgggttgatgaaatagcaaggtctgagggtagacctggtgtaggtggtggtaatgatgtgaatattaacactacaactattaggttgcggccagcaagaaattcgtcagctcttacaagggatgaacgtgactccccagaagtatggtcacatatttgtgtccaaaagcttgcagaactggccagagagagtacaaccatgcgtcgcattctagatccgatgctttcatactttgatatgaagaaacagtgggccccacgacatggcttggctttgcttgttttgtctgatatggcttatctggaaaagagttcaggcaatgaacagctgattctaaccaccatcatccggcacttggatcacaaaaatgttttacacgatcctcagacaaaatcagatattattcagacagcaacgtccttggcacgacaacttcgatctcgaggatttgctgttgaacttgtagtggcaggtgacttgtgcaagcacttaaggaaaacacttgaggccgtggaatcaggcaatgttgaagatcagaatttgaacgaaccccttcagattgtcttggaggactgtcttatggaagttgttagaggaattaatgacgtacggccactctatgatatgatggcaatcacattggagaatttgccttctatgccaactgttgccagagcaacccttggaagcttgctgatcatttcacacataatctcgttgacatcagtatcttccaacaatctgatggtatttccagaagcacttctccagcagatactgaagtccatgttacatactgatattgatactcgtgtgggagcacaccacatgttttctgctattattgtccgagggccaagccatctgcggagtgaatcagagtacctatatgaaacaaaaaagcagtctcggaatacatctgtatttgcttcagctactgctctactggagaagttaaggagagaaaaggagagtttgagttcagataagcctcgaaatatcatgcatgatgatgtgaaggaaatgaacatgcatgaagaggataaacgaaaaaacccagcttatttctctaagctggtttcctctttcattgaaagatgtgcaacacgaagttctgtagaggagaccaatattgccatgctaactgaagatcaaaccaaccaattgctgtcttcattctggattcaggcaaatcaaacagataataccccttttaattatgaggctattggacattcatacagcctaacagttctttcttcccgccttaagaattcaagcaatggcaatatcattcagtttttccaattgccattatctcttcgaagtgttgctttaaccccgagtgaagttctgccggcttattgccaacggtctatttttacattagcaatgagtatgctggcctttgctggaaaagtttgtcacgtcgctgaactgtcggacttgctaaggtgtttttcatcttccaaaattgacccttacctaagaataggtgaagacttgcaactctatgtaaggttgcaatcggatctaggcagctatggttctgaaagtgatcaagagattgccaaatccatgctttctgactgcaggacaaaagtagggattaacgatcatcgagtgcttgatgttattgcctctgcactttctaatttcattgagatgggcaaggatgtaatagtgaaggagctgactgagttgttcacgcctgaagagatgcctctgtttgggtcgaattcagcacttgactgggccaacttcaatgcacaagcattttctgatgaatccctttcttttgatgaggaatgttcaagaacctcttcagtagattgtggcttgcacgagtcaccaatcaccaacactgctagctctatctcaaagattactctaccacagtctgttccacatgttttaggtgtcggtcaattgttggaatcagcactacatgtggctggccaggttgcaggtgcatctgtttcaacctcacctcttccatatggtacaatgactagtcaatgtgaagcccttggattgggcaccaggaagaagctatcgagctggcttgtcaatggacacgaatcaaccccggacaatcctatgccaagccttcccactgcccatcattccatcattcccaaggtaaaccctgccacgttccgcacatcatctgaatcatgttctgcagtaaagctcccacctgccagccccttcgataacttcctgaaggctgcctatcgcacccagcccgagctgtgatcgatttacctaagaacaaccctcttcacgagtgctaggctgcagtaccaaagcatagggtactagattatctaaaggaacttatctatgacgttgttttagttgtagtagcgtaactatgtgtatctatctactagatgtctgtaacgtttgcatatgtatcatcttacgactgtgcctctgtagttgtaagccgcgagttctgtgtcgcatgttcagactgagttgtatgagaatactgagtatgcttggcactcctgtatacagtatgcttgccaaaacgtttcttccgaggtcatcaaaaaaaaaaaaaaaaaaaaaaaagggcggccgccg

SEQ ID NO: 24878 - DNA, 3375 bp, Zea mays
ctgcaggagaggaacacatctgtgctgaactcgtgtttgcttggttaccagatcagaatgtccctgctctggaatacatttgtgagttcgcggttccacgtttgccagttcgttccaacatttgcactcgaacgttcttccttttcgcgaggaatacattattgcaagaaaattccttatctgacgctaaaagactcgctctttctaatttagcatctgaacttcaaatcttcattctttgaacacccgttgaaatttttgttctcaaattgacactaccgtggctttatacatgtaatggtctcaagttccattgtgaaaaatgtttttttgtccctccaagtgttccaggtttttaattatggcagatttttttcatgatggatttttttctgagcacttgaacctagattatttttctgaaagttttttttccatccagattcaccgcactgttcacccaggggaaaaaaatcgccaacaataaaagctgggacacttggggggagggggggagagggcagaaacaatgttaggctatctcatcttctatttttaactctagtatataaacatcacttttcgcagtcaaagacaatattttacaatgtcatatgcacaatctgtcggagacagtgcccaaacttcgatttggaaacaaaaatttcaagaggcatccggtaaggaatattccaagtttgggtactgtttttttttataaaaaacattttttttttgtcatggagaatttttttcatacattaaacgttatgactacattcgtatatcggtatatgcttggattaacaactgctcagaaaagaattgcacaaggtactgaactacaagttcgccaatcatatattatcatgcatagatgtaagatggtttgttccaagttccaactcagttgttagtaagataagtgcaaaaggcccacacatgtttcagaagcacaacaaatgtttaccgtctagcagtagatgctaccaggagcccagcaagcatctttaaaaccaaaggctaagtaaggggagatatgaaatgaacctttggtggcgcgcttttttttttacttatatggatcccttattcatattcatcaaacccactctggttatcaatgtataatatacatattttatacaatctcaaactatagggccagaagccatattgcccttctcagaatgctaatagcacgcccaaagaatcaaggaaggctccaccttttcttgccgctatgtagcacaacctctaaatctctaaccctttgctttgggccttcttttccaacttgaagaaggtctatcaatacacattcacagacacacacatgtacatgaagtactatgagatggcaccttaccatcgatggtactccagatgtgataacttgagggccaagaacccattcgctatcctttcaaaacactgatggcatacccaatacctatcctcccaactgcgtccacaatatacagcagccaaagaacacaagaaatgctcttttcctctcccactacctctaatcaagcaatccttaagttctcgtatacactcaacttaaacaagctatcaagaacagcaattggggcagcgtaccaagccgttttcgttgcactccaggcagcggcgggctcgcccctcttcctccacgaacaccttgcgggagccgtcgcaggccggacagggcgcgaaccggaacccgccgcaggcgccgcagacgaaggcggggtcctgcccgggggcgccttcgaggacgcggcggagctcgccggactcgtgcagccggcggacctcgtcggcgccgccgacgagcgcgcccccgaccaggagctgcgggagcgagaacccgcggccccgtgccgcgaggatcccctgcagctcgcgccggagcgccgcgtccatggagacgtcgcgctcgtccacggcgacgcggaggccccgcagcgcggcgcgcaccgcgcagcagtccgcgaacgtgcggcgcacgccgcggagcgacgtcgtgtacaggaccaccgactgcgggcgctgcgggttgggcgccggcgccggcagcacctggcgcccctggtacgggtggtggtggtaggtcagcgagcgggacaggtgccggggcttcttgttcttggggcaggcacccggtgcgccgccgccgatgtcgtccatctccccggccgcctcctccgcccgggagtcggccggcgaaggctgttgtttagggctcggagctccgacgagagttgtggcgattggggaatgagaggaaggcgggttttgtacttgggtccagtcgtctggtggtttgtgagttaggctgttgcctcgcccggcccgaactggcgatggcgatgaagctttgtaccaacggtgttaatattttttatcgatttagatgacagtctttataaaaataaatagtacctgccataattattttatgggactgagggactacctgataatggttcattaaataaggtcgctataatgtccgaataagaaaaggattggctttgttcaattaaatgaatgacatcactatctatgctcgtcactactacgagtatttgacttcacctccagaaatgttcgtccaatgcttgtttatgaattatgatcagctaatgctatcggttttgttccttttgcactcttttttttttatccaaattcaatcaagaaatcaagcaatttgtgttcaacaagaagtgagtcctcaaaattaaaataagaccttatttaaaaagtttagggccacaaaaacatttgcagctccaacaattgagccatattaatattattaaaaaataaatcatgtttttaggaaataaaaaaataagaatagtgtacaaatgaggataggactccggtatatggggcagtggggcactatatttaggacccaaaagactgagcaggcgagcactataatggtttgatgaatttttgtaaaatagagtctatgttagagcatatttttagtagtagagtcctatattttaaaatagaactctatttagggctcatattggagatgctcttagctgttatattcaaactaaatttaactaaatttatagcaaacattaataatatttatatatctgaataaatatattataaaatatatattcaatggataatttgacttaatgatacttattacaaaccataaatattagtactcttttgtatatatttaatcgaagttgtactccctccatttcaaattagtatttactttagcacttagtttttatttggtttttatgtctatattcaaatagatgatgatgaatctagacacatatgcaaaacacatacattagttattgtatgaatccactaaatgtctaaaacgaattt

SEQ ID NO: 24879 - DNA, 1877 bp, Zea mays
  misc_feature (11)..(11): n is a, c, g, or t
  misc_feature (1414)..(1415): n is a, c, g, or t
  misc_feature (1417)..(1417): n is a, c, g, or t
agaacggtccngccttcagcgcacctcgctaggcgagtcgcctccggggtgcctggacgactaggagatagttacgcgaccaactggttcacaacattgcgcaaaacaaagcagagcatagcatcacagttcacagcagcgcgcggaggcaaggcgcacaacagcgtgcggtggcgcggcgtgcagagcagccgcgcgagcgaagctagtagcgccgcacggaatcgcagagaaggaagtggggagggttaccggcgtcgacgagcgagcaggctctaggtgcgatttactcgtgcagaagctccgacaactatttctgaattacctggactggtttgtgacgatatctctggagggcaagaaaacattccgattcctgccactaacttggttgatgatccacctgttcctccatctggtttcacatacttgaagtctctaaaaattccaaaggacatcaagatcccatctagtattattggctgtgattgtgaaggagattgtgctagcaacaaaaattgttcatgtgctcagcgcaatggttctgatctgccttatgtatcatataagaacattggcaggttggtggagcccaaagcagttgtatttggatgcggggctaactgcagctgcaaccatgattgtgtaaacagaacatctcaacagggtttgcagtatcacttagaggtatttaagacagcttcaaaaggttggggagtcaggacttgggacactatcctccctggggctcccatctgtgagtacacgggggtgttgaggaggactgaagatctggatggttcacagaacaactattgttttgacattgattgtcttcaaaccatgaaaggtttggatggaagggagaaaagagctggatctgaaatgcacctgcctaatctttatccagagaatgactcagatgcaccacctgcacctgagtactgcatagacggcagttccattggcaattttgcaagatttataaatcatagttgccaacctaaccttttcgtccagtgcgtcatgagctcacacaacgatgttaaactagcaaaagtgatgctttttgctgctgacacaatacttcctcttcaggagctatcctatgacttcggttatcccctggacagtggggtcgggccggggggtaaaattgtgaagctgccatgccactgtggtgctccagattgccggaagcgcctctactagacctgcagtgtgtttccattttgattttgcaggaaacaacctatattgtaggaaagcattcatgttatttatgtagttggcatgctctgatatatagcgaaagaggagcaacttaatctccttttagagcattcttattttgtgataattggaggacatgctggtcatggtagcatattttgcaggaaatcaattaactgannanaaaaaaaaaaaaaaaaaaaaaaaaaaaaaaaaaaaaaaaaaaaaaaaaaaaaaaaaggagaaaaaaaaaaaaaaaaaggaattcctgcaccccggggaatccacaatttcaaaaggggccccccccgcgggggagccccagcttttgttcccttggggaggctgccaatttactgatttagggaatgagggggtttttgaggggctccaggggtttctgtttcaatcagttgcccctcctgttcagttactgaggggggggggggaaagggaaaaagaaccgccggacataagggttatttctgttctcattgccgaaaaacatggaaattgaagttcatttacaccgtttctcaacccggtacgcaccaaaaaatcattgatatggccataaagggcgttgaatgccggcaaacagcccgaattatgggggttggcctcaacacgattttacgtcactt

SEQ ID NO: 24880 - DNA, 1159 bp, Zea mays
  misc_feature (261)..(261): n is a, c, g, or t
ttggtctactttagactattttatcttcttcttaatatatttaaggcgcagttcccttgcgctttcgataaaaaaagactaaaatttcgctcagactctttaacaatcagatccttataaaactgaaacatagcctgctgtttagcctcttgagaagtaacgaggttctcgtcgaccatcagtttatgaataaagttcttctttttccatgaattcagttttatatattttccatatttccattttactgtatggatgtgnaaagtgatggtcttattcaatccttctcagggctcgatgtcggagatcagttttattctcgcgctgaaatggtagtgttgggcatccacagccattggctcaatggcattgactatatggggatgaaataccaaggaaaggtaaggctaatcacaatggccatttcatagcactctttccaacactgccacatcatcaagagtgtcctaaaactaagaatgaaacaatgtctctcaatgcaatattttacttcactatttcatagactaacataccaattaaatgatgcaactaaacaaccaatgaaaatcagtaaaatatgtgaagatgaaacaaatcactcttaaaggaggtttcacacgattttcaagaccttggaaacgggttgacatggtttcatccccatgaaaccaatttcatcccatgaaacttatttatcttaaatactttttttttctcgaaccacgcaggagaactgcgcgtcatttcattaaggtagaagaaaaatacatggtctagaaagaccgccctaggtgcctaacgaaggcaccactcacaccattacataagcgccacagaagaaaacaagacacgaccagagcggccttatgccttaggccaagaacgtcgacgacctaaacactagctccttgagtttggaggcccctgccaaacaccacaggtctccctccaaactaacataactaagaacatcttgaatcctaagcctatgcttctcaaaaacacaagcattacggtgcttccataactcccaggccaccaagattattaaggaattcagccccttgcgagcctcctttggggctgctgtgattgcttgcctccaccatccagcgtcgacgagcgagcggctcttttacctcggccgggaccacgc

SEQ ID NO: 24881 - DNA, 1849 bp, Zea mays
ccggccggacactcgctttctctgcacgcctcacacactcacgtgagggccctggttgaccctctcttcctccctccctccccctcctcctccccctcttgcctcaccttgcctcacgcttctccctcagcaccatccgcctgcccaccgtgcccctgctcgcccttcccgtcgcggtgctcgtccgccctgccgcgccctgcccgccgcgtcgtgaggggatgtgtctagggttattgggagagcaccccttcctatggcgtccacgacaagcactagggcgtcgccatagacgcctcgcggatgccatacacccagttggcaaggcgtggactgtggcgttcggcctggagcaccgcttaagagacactgtacggacgccataacaattaacaagcatggctctagtgcaggtgcgatttactcgtgcagaagctccgacaactatttccgaattacccgggctggtttgtgatgacatctctggagggcaagaaaatattcctattcctgctactaacttggttgatgatccacctgttcctccatctggtttcaagtacttgaaatctctacaaattccaaaggacatcaagattccgtctagtattattggctgtgattgtgaaggaggttgtgctagcaacaaaaaatgtttgtgtgctcagcgcaatggttctgatctgccttatgtatcatataagaacattggcaggttggtggagccgaaagcagttgtatttgaatgtggggctaactgcagctgcaaccatgattgtgtaaacagaacatctcaacaaggtttgcagtaccgcttagaggtatttaagacagcttcaaaaggatggggagtcaggacttgggacactatcctccctggggctcccatctgtgagtacacaggggtgttgaggaggaccgaagatttggatggttcacagaacaactattgttttgacattgactgtcttcaaaccatgaagggtttggatggaagggagaaaagggctggatccgaaatgcacctgcctaatcttcatcctgagaatgattcagatgcacaacctgcacctgagtactgcatagacgctcactctattggcaactttgcaagatttataaatcacagctgccaacctaaccttttcgtccagtgcgtcttgagctcacacaatgatgttaaactggcgaaagtgatgcttttcgctgctgacaccatacttcctcttcaggagctatcctatgactacggttatcgattggacagtgttgttgggcctgatggaaaaattgtgaagctggcctgccactgtggtgctcctgattgccggaagcgcctctactaacctgcagtgtgtttatttctatttggatttttgaggaaacagcttatattgtaggaaaaacagtcatggtacctatgtagttgacatgctcttgatcatatatagcaaaagaggagcaatttatggggtgttcggtttaagaatgagttagtatatcatcttctcatttactatttttgcttggtttatgtaataaaatgagtcgatctatcaccaccttattcctcatagttagttagttagcactaacattagaaatgaagtcatcttatcaaatttaaggaatgagcttatgatgtaccaccttaatttggatgaagtgattcatcaaacaaacaccctattgatataatatagcattcttgttttgtgataattagagatttagagcgcccggtggtcatggtagcatattttgccgacaatcttcgattaactgatatatctggacatctggtcctgcaacacttatcctctggataaatatatatacgttacatgtt

SEQ ID NO: 24882 - DNA, 1744 bp, Zea mays
tgggtacctcgaccccggcccgacaaaccacagtcaacggctccagagcagagcatccacacgtatcagatcacgaaacagctcggttcctggcttgggcgcaggtcgtcgatgctgtaccctgtcaagttgcgggaaaaactgagctctccgaggtcagaagggagcgagcccggtcagtcccagtgggtctcttcccttgcctggatcgccacgtatttatggcacaagccacgcggtcttcttcttctcctcccgcggccattgcaggtcttgcagcaacgtctctctcctctgggcggtgggcgctcgatgttcttggctccttcacttggacttcgccccgtcggcgtccactgatcaattgatcatctgcaggtagataagctaccagcatctattttgcgtatctgaactccaaaaaggagagctcgaaactacagcaatgggttgctaccctgtgttctgtaggaagaagaactccagaagccaggttgtgcagcttgaccaagacatcccaatcgcgggcaacgtgaaaatctactcgtccaaggagctgaggaaagccacgggaaatttctgcccgggaagcaagcttggacagggttctttcggccgtgtatacctgggaaaactgaacaatggcgagaaagttgccatcaaggtgctctcctcagagtccaggcaagggacaaaggagttcttgaatgaactgagtgtcatatccaacataactcaccacaaccttgtcaaactgcatggctgctgcatcgacggaggccagaagatgctggtctacaactacgtggagaacaacagccttgcacaaacccttttcggtaattcccgcagcggcatcagatttgactggagaacaagggtggagatctgcgttggcgttgccgatgggctcacgtacctccacgaagaagtccgtccaccgatcgtccaccgcgacatcaaagcgagcaacatccttctcgacagaaatctgagacccaagatagcagactttgggctggcgaagttcttccctggcaacatgacacacatcagcaccagagttgcagggacgctaggatatcttgcgccagagtacgccatccgagggcagctgaccaagaaggccgacgtctacagctttggtgtactgctgctggagatcgtcagtggcagatgccacactgatcccacattacctcttgacgagcagttcctcctagaaaaggtctggacactctcggagtccgatgatcttgagagcatcatcgacggtaccatggagcgcgatttcgacaccgaggaagcacgtcggttgctgaaaataggtcttctgtgcacccaggatagccccaagatcaggccctccatgtcaatggttgccaagatgctgaagggtgagtgtgatgtgagtgaaaagatcatgcggcccagcctgatcacagacgtcatggacctgaaagtcaggacagtagagccgatccagttcagtttatccccatcgatgtcacctgcgctgagcagctcactggtgtccacacttgcattagctggtagcacagttgtagagagccgctgaaggaactagttaaaggaccaggttcctacaaaaaatggtttgttagaagcagcatgaattgtttttttgtttgtgttttagtacattgtaaggttgtcagtttgtatatataacatcctagtttgattatcgagattagagattttggcaaaaaaaaaaaaaaaa

SEQ ID NO: 24883 - DNA, 1538 bp, Zea mays
aattaaccagtcattatcgatttgttcccttctagaagacctaatttcagacgtgtggtccgtggcattaaccgctccggagtgcatcaccgtcacggcagaagagacagggagcaccgcacgaaggccgcggcccacagcctggacccacgcgccagtgacctaatcccacccagaaataagcaaccgtttacgcaccgcgtttaacgacgcggaccacgtgtccacgcggtggtcttatccatccgtccgtgtccgtctcctcccccatccgctccggctccctccctgctataaataccgagaccagaccctaggaacatcctaatcgaagcaatcagcaataatctcgccgtctcatcgcaaaacccagcgccccaaagcgaccccaccgaagcgtcccagcccgaccggaatggcgatggcaccgtgcgcacccgcctccgtctcctccttccccgcccgcccagtgcgggccccttccgctgtccggccgcgcgccgccgcgatccgcgccgctgcggcggcggcggagggtggcaggtggtgggcgccactactggggtggtcggggaaggccgactaccttgaggccccggccccggtgccggcggtgctgcaggacgacgacgcggccgcggcgcgcaggcagttcgtgggggggctgacggaggagaaggcccgccagctgcgggcgcggatggcgcagacggagtccttccacgacgccatgtaccactccgccatcgcctcacgcctcgcccgctccgcctaaaccggccggccggccggccgctggccgccgccgtagatctagagctccgcccgcttttgtgtatactggtttcgccttcattttcggggatgtctttgtttccactaccccattgtcgtcgtcgtcgtcgtcgtggagcaggaggggcagggatctgctggttttatgaggcgccctacccctccctcccattgtccaccgcggcggccgctccgggatgtgcccgatctgcgcagatccgcgaagcgttgctgcaacctactactatgtactagtactgttactcttcaaagttccgttcaaagtgggtctctctcaaattaatgctccaatgtcagatgtggtagcgtgacagatactatttggttttcccgagtcaatcatcacatcgacatatctataataattcaactagtaatcgcagacaccgacctcccatcattaatttaagccaacacgctaaccaaaactcgatcgatccagtgcaccatcgacgccgcagatctgtccagcaaaaatggagcaagtggccggcccgtgcagaaacagcagattattttagccaacatgacgtgcttattaaagccgagggaacatggaatctttcactatgagtattcgctaacaactgaaaaaatatcattatcagaggggggcaactttttctttttgcaatattcttttttttttctataaaccgcaggagcagcatccttcaaagcttaacatgtttcaagcagcagacagttgttcaatccgtacc

SEQ ID NO: 24884 - DNA, 1484 bp, Zea mays
aacaaattcccctcgccaccccaccggtcgcaaacccaagcttaaaccacaacgcaaacaaccaccaaagcaatcgaaaagcaaccctgcaagtgcaggcaaagagagggcgcgaccaaacagatccaatccaatggcgatggcaccgtccgcagcatgcgtcgtctcgttccccgcccgcccggcggcgtccacggccgggccccgcgccgccgcgggcgccggggcggtccacgctttcgcggggtcggcggagggcgccaagtggtgggcgccgctgctggggtggtcggggaaggccgactacctggaggccccggccccggcgccggcgggggcgcaggacgaggcgccgcggaggcagttcgtgggggtgatgacggaggagaaggcccgggagctgcgggcgcggatggcgcagacggagtccttccacgacgccatgtaccactccgccatcgcgtcgcgcctcgcacgctcctcctagggttggtgcgcgcgcggccagctcgccggtgggttgcgccgccgccgtagcccggtctctgtctggccgtctctgtgtacatatggtagatttgtcagtagctggctagctgctcccgctgttggtgaaggaggggggaacgaaagagcaaggagatctggatttttttttttagcgtgtgctccttgcttgttccatctccctccgccgcgttggttgctcttgctccccggcaggatcactcttcttttttccggttgtgattcgacatttccggtgtgaactggcattatgctccgcaccaagaacctgtaacccattgttgtagtctcaatttgctttccacaaaaaaaaaaaaaaaatacactgagctctccaaccgtgctgtactgctcgctctaggctgctaagcaggggacggcgggatatgcctttcccactgccacagccacagcccacagggatgaaaattgaacgtcgacgcaaacaagattgacttcagaaaagcccaaatccagatatacagacaggtagaaacggccctaacataaagttagggacataggtagaaacggccctaacataaagttagggctagtttggaaatttaaatcaacctcaacgcaaaccaagattggcttcagaaaagcctaaatccagatatacagacatatgtagaaacggctgtaacataaagttaggactagtttgtaaatttaaatcttctccgtgtttcttccctccgggatttctatggattgagtggcaaaataaattattttcctctcgatctctaggaatctaaaattaagtttttaaactagctctaagctaattttcctctcgatcctaagaatttagaggggattcccgagcgagctaggatgtagtcgctcagattttggaatgtcgaatggtttaatatttgaacctaattttcaattttagagccattatgtcatacattgtcagatatctaagaatggggtacctagag

SEQ ID NO: 24885 - DNA, 878 bp, Zea mays
attgggacctcgaggcggcgggatccccatcacaagggtcctgcccattgctacaattcccctcgcccccccgccggtcgcaaacccaagcttaaaccacaacgcaatcaaccaccaaagcaatcgaaaagcaaccctgcaagtgcaggcaaagaggggcgcgaccaaacagatccaatccaatggcgatggcaccgtccgcagcatgcgtcgtctcgttccccgcccgcccggcggcgtccacggccgggccccgcgccgccgcgggcaccggggcggtccacgctgtcgcggggtcggcggagggagccaagtggtgggcgccgctgctggggtggtcggggaaggccgactacctggaggccccggcgccggcgcaggatgaggcgccgcggaggcagttcgtgggggtgatgacggaggagaaggcccgggagctgcgggcgcggatggcgcagacggagtccttccacgacgccatgtaccactccgccatcgcgtcgcgcctcgcacgctcctcctagggttggtgcgcgcgcggccagctcgccggtgggttgcgccgccgccgtagcccgttctctgtctggccgtctctgtgtacatatggtagatttgtcagtagctgctcaagctgttggtgaaggaggggggaacgaaagagcaaggagatctggattttttttagcgtgtgctcctttgcttgttccatctccctccgccgcgttggttgctccccggcaggatcagtcttctgttttctggttgtgattcgacatttccggtgtgaactggcattatgctccgcaccaagaacctgtaacccattgttgtagtctcagtttgctttcctcaaaaaaaaaaaaaaaaaagtccac

SEQ ID NO: 24886 - DNA, 1558 bp, Zea mays
aagtcgaatcagaacgtgagaagatcctgggaattttctcggccacaagctccccgccgtggggccatccgccaccgcactcacaggctcttcttcctcccgtgaacctgatcgcgagagggccggccgagtggtgtgctgacagtggcacgacccgggtacaaaccgacacgggaccttcacgggtcgcaccacccctgcctactgcctggcgtccgcatgcatgcgtggtttgctagcagacgcccggggtctcttgatattgcagatggctacactgtgttagccgcagcggcaacactgctactcccacccgtcccctccccgctatatataccgggtgcggccccccgggcgggcgggatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaaatgttcttgtcgtcgtcgtctgtgcatgcatgtaccatgtcgtcgtgcatgtctattatgtgtgtgtcgtcgtgtcgatcggtacgtatagatgcctgttgttagcatgtgtgtcattacctagtcgtgtgtagtgtatgtatgtgcttgccgggcaaaagttgcatctagctaaacagtagtattacttttgttaaaaaaaaaaaaaaaaaaaaaaaaaggcgcccggtcgccaaacactactggatctctgcacgtacaacgcggcgttattattatagggacctggcgccgtctatcgatctggcattcactgattcacatgctatgtttcatgtttcattgcgtgccggccggcactcgtttggggtgtttgtccctaaaagctgcttcagactactgaatacccaaattttcaatccgtttctacgacaaccgctttaataaaaatcgtttaaaatcaatgtaaatatagaatccgtgacttcctatattctaaagttaatttatagacctctttatcttcttccatacgtaattaatatacagaaattttattcacagttaaatttcaaaaataagttcgttagagaaaacctgaaccgaacgaactcttcgttg

SEQ ID NO: 24887 - DNA, 1012 bp, Zea mays
ctcgccggccgccgcgggaacatagcgaacaaacatcgagtacagtcggctaggtaatctggtggtacgacgactgacgacgacatggcggccaccagcagcaagtcgtcgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaaatgttcttgtcgtcgtcgtctgtgcatgcatgtaccatgtcgtcgtgcatgtctattatgtgtgtgtcgtcgtgtcgatcggtacgtatagatgcctgttgttagcatgtgtgtcattacctagtcgtgtgtagtgtatgtatgtgcttgccgggcaaaagttgcatctagctaaacagtagtattacttttgtttgtcttcgatctcaggtgaatttgtatctgcaggaagccaaacactactggatctctgcacgtacaacgaagcgttattattatagggacctggcgccgtctatcgatctggcattcactgattcacatgctatgtttcatgtttcattgcgtgccggccggcactcgtttggggtgtttgtccctaaaagctgcttcagactactgaatacccaattttc

SEQ ID NO: 24888 - DNA, 687 bp, Zea mays
tggcggccaccagcagcaagtcgtcgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagctgccggccaagtgcggcctcgccacgccgcccgactgctagcagtgtgccagccaagcaggaaggcccccggcattgctagctgtacgtgtctgtgtgtgcatctgcagcagggtgcaggggcccgtacgtacgtgtctctttctctctctcatcttgtcactgcgcctagagtgagtgcagtgtgtgttcggtactaattaaaatgttcttgtcgtcgtctgtgcatgcatgcaccatgttcgtgtgtcgtgacgtacgtacgcgcatgtgtgtcactacctggtcgtgtgtagtgtatgtatgtgcttgccgggcaaaagttgcatcaagctaaacagtagtattacttttgttgtaaaaaaaaaaaaaaaaaaaaccccgagagtct

SEQ ID NO: 24889 - DNA, 843 bp, Zea mays
cattggtacctcgaggccggccggatagcgaacaaacatcgagtacagccggctaggtaatctggtacgacgacccacgacgacatggcggcggccaccaccaccagcagcagcaagaagtcgtcgtcgccgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagctgccggccaagtgcggcctcgccacgccgcccgactgctagccaagccaagcaggaaggcccccggcattgctagctgtacgtgtgtgtgtgtgcatctgcagcagggtgcaggggcccgtacgtacgtgtcactctctctctcatcttgtcacctatgtagagtgtgtgtgttcgtactaattaaaatgttcttgtcgtcgtctgtgcatgcatgcaccatgtcgtcgtgcatgtctatatattctgtgtgtgtcgtcgtgtcgatcggtacgtatagatgcccgttgttggtttggactggtcgtgacgtactatacgtacgcgcatgtgtgtcactcctggtcgtgtgcagtgtatgtatgtgcttgccgggcaaaagttgcatctagctaaacagtagtactattacttttgttgtcttcaagcggccaaaaaaaa

SEQ ID NO: 24890 - DNA, 1018 bp, Zea mays
  misc_feature (826)..(826): n is a, c, g, or t
  misc_feature (991)..(991): n is a, c, g, or t
cctcccggccggccgggatcgaaggcaccagccaacgctcgtttcttcatcccaacgtcttcctcgcagcgccgccgctccatcttccgctctctcacttattactcgcgttcggcacgcgggcgacggcggcggcgctcaggctctcagcgacggcgcacaggctcgggctctccgcgacggcgtcaacggcttcccctcccgcctctcgccagccgcctcgctccctcgtctccggtcctccgcacaccgtccgttgatcctgcctcttctggttagatagatggaggtgccaatgaactctacgcaatctggtcctcacttccctgtgcagcatcggtccctctcattagacatcaagggaaataaaacagatattgttatcagtaaatatgaagatacctttctggtgattgtgacacaaatcggctgcatgggaaccatactagctgccaagaaagacgaaagtgttttctcggacccaacctacaatgtgtctgttctttttgggaggagaaatgagccactcctacaagcttgcgcacatcaacttattgagcacataagtggcagtggctcagctcggtcattggttatttctctgggtctgaaagatcattctcaggtaacactgaaggatatcattgtagctgtgatcgagaatcgcctttggtgacgattgaataactgagctgggcatgggattgacatattcagcccatcgataaagatattgcttagcattgcgcaagaggagccatcgtttatagcatgcactaaattctggtagttttgtagttagaccttctatctacttgggattaancaaaggatggctttaagctgctggcaaaatttgagtgtccgctctcacgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaangaaaaaaaaaaaaaaaaaaaaaaaaaa

SEQ ID NO: 24891 - DNA, 994 bp, Zea mays
ggggtcgcagccgccgccacccagtcgcccaccgacccgcccccaaccttggagctgctgtgccccggccgtccgtctcttgccagagctccgccaccgcccgccgatcagagctccgcctccgagacgacgcgccgagctctttcccggcagctgctcgcccgcgccgatcttttcttcggcagccgcgcgcccgcgccgagcccctccccgtccccggcgggcgctcgccagcgccgagctcctccccgcggatccgcctctgctcagtctgagctccggccagccgcgagctccgtcgaggcgtcgacgccgaggcccagctccgcccgtgagtgcctgtgccggattcagcaaacagaaatttgctctgctggttagatagatggaggtgccaatgaacactacgcaatctggtcctcacttccctgtgcagcatcggtccctctcgttagccgtcacgggagataaaacagatattgtcacccatgcatatgaagatacctttctggtgattgtgacacaaatcggctgcatgggaaccatactagctgccaagaaagatgaaagtgttttctccgacccaacctacaatgtgtctgttcttttttgggaagagagatgagccactcctactagcttgcgcacgtcaacttattgggcacataagtggcagtggctcagcccggtcattggtgatttctctgggtctgaaagatcattctcagtggcagtggctcagcccggtcattggtgatttctctgggtctgaaagatcattctcagggaacgctgaaggatattactgtagctgtgatcgagaatcgcctttggtgatgattgaatagctgagctgggcatgggaacgctgaaagatactgtttagcattgcgcaaaaggaggcatcgtttataccatgcactaaattctggtagttttgtagttggaccttctatctacttggattaacaaaatgtggttttaagctgttgtc

SEQ ID NO: 24892 - DNA, 1062 bp, Zea mays
gctctctcacttattactcgcgttcggcacgcgggcgacggcggcggcgctcaggctctcagcgacggcgcacaggctcgggctctccgcgacggcgtcaacggcttcccctcccgcctctcgccagccgcctcgctccctcgtctccggtcctccgcacaccgtccgttgatcctgcgtgcgtgcctctctctctccttccgcctccggtggatcgtcaatggcgctcggacggcaatgggagccagcagccgctgctccaccaaggcggtcggctgctttgggagcgcttatgcccgaaatcgaagcgttaccggcctcttagcgcttcagcgcgctgaagcgtgcgcttagtgccgccatttggaaccctggttacaaccatgctcttctggttagatagatggaggtgccaatgaactctacgcaatctggtcctcacttccctgtgcagcatcggtccctctcattagacatcaagggaaataaaacagatattgttatcagtaaatatgaagatacctttctgctgattgtggcacaaatcggctgcatgggaaccatactagctgccaagaaagacgaaagtgttttctcggacccaacctacaatgtgtctgttctttttgggaagagaaatgagccactcctacaagcttgcgcacgtcaacttattgagcacataagtggcagtggctcagctcggtcattggttatttctctgggtctgaaagatcattctcagggaacactgaaggatatcattgtagctgtgatcgagaatcgcctttggtgatgattgaataactgagctgggcatgggattgacatattcagcccatcgataaagatattgcttagcattgcgcaagaggagccatcgtttataccatgcactaaattctggtagttttgtagttagaccttctatctacttggattaacaaaaggtggctttaagctgctgtcaaaatttgagtgtcctctctcacgctaaacaaaaggcactgtatgctggtaaaacacttctgaggtgaattatgcttttcgaggctatttgac

SEQ ID NO: 24893 - DNA, 3105 bp, Zea mays
  misc_feature (410)..(410): n is a, c, g, or t
  misc_feature (499)..(499): n is a, c, g, or t
ctgggaagccatcaggtcctggtgccttattatgttccatctggaagattgccttcttgacttcatccatcataaatggtgaagtaagaatttcattttccaggtccgttacctgtgggatatcgtctctgaccgattcaaccatggaaaaatggttgggttctgatgcaccaaagaggcccttgtaatagctagtgataaatcttttaagattttcatcaccctcaatagtgcagttctcttgttctaaccggaatatcctcgtttttctatgtttcccatttgctaccagctggaagtacttagtattacaatcaccctgtaacaacttagttgttttggctctttggtaccatctaatttcttcctctcttagcatgtgagctagacgctgctttagacactgcttnaagtcgagttcttgagcagtaagcatctgcgtttcggcctttttgtctaaatcatcagccttcttaataatttgctctttttctttttnatatgcaccactggtatttttcgcccaaccccttaggaattggcgtagtctttgaattttgaactgccatttttgtagaggggtccaacctctattctcatttttccaaacccgtgtcaccatatccgagaaaccttctctcagaaaccagccgagctcaaatttaaaaggaggctgattgtttgagtgggttccacttcccgtgttcatgagcagtggggtgtggtcagaaatttctctcgtcaaagcttgaaccgttgtcaaaggatactttgactcccactcggtagtaaccaagatacggtcaagagtctcaaaggtgggtacgcttctagagttagcccaagtgaatttccgatttgataatcccaattcccggagatccaagctatcaatgactgcattaaaatggaaaggccatctatcattgtagttatccttatttttttcatgttggttcctaatgatattaaaatcaccaccaacaataagcggcaggttttctttggcacaagtttgcaccagttcagccagaaaagattccttgaattcatcttgtgcagccccataggccgccaccagaacccaactaaagccatcatccttgtttcgtagatggaacttcacatagaagtcacccacatcaatactaccgatgtcaaaaacttccagatttacaccaagtaggatgcctccggacctaccgtgaggtttcgaccagtgccataagaagtcccgaccagcacaaatattattcaatgtactttgtgtgaaatcattttttcctgtttcgagtaacgcaatgaagtctagcttctcttctttactagtatcggaaaggaacctgaatttagccaagtcaccaagacctctgctattccaaaaaattcctttcattttgtacaccttttatgtttcttaaccaactttatttttatgctacctttgcttcttgaggagccttttgatttatttttcttaaagacagtgtggaaatcacaacttaggtgatcactgtcctcatccataacctcctccacaaagtcaccacataagtgtccgagagtgagattgtcagattcatacttgtccacctcatcattatcacaatgtacaaactctgaaccagaaaaaaaacgtgctactatctaattggggttcagaattgtggagctcaagtctatttaaaagagaaactgaatctgaaacttgtttttgattagaacctagggatacccctagattgctaaccatagtagagataacatcattaggaagagagaaagggccagaggatatggagttacctggaccgtcaagattcctccatgcagccctcagcttggccttctccaaaatgtggtggtcagccccgcccgcaagccttgggcttgaacgtgtaggctgcgacaccacctccttgatccccgcagcggccaccagcatatctgatgagagggcgccaagtccaggctgctgcagccccctcctggagcaaggcggcgcagagacagccccacggcgcgcataaaccgcaaggcattcccgcggccgactaggatgcgattcctgcaccagatcagcagccaccattgtggcctcagtatcagccatcaacaaggcctcagaaggagatccaccaccgcacacaccatcatcagatacccctccaaccacagaaaacgcagcaggcaatttgtccaccagcacaccatctagtgagccaccattcacaaccttcatgggacaatcagtgggagattcagccaccatgtcaatagaaatgccatcagctgctccttccaagtattcgccatcttcctccgcgagaactttgtcaacacaaaagtcaagcgacatatccacgaccatatccataatttcatttgccattttcctgattttttcctccgtatctactccatgctcaagtgccaaaacaggggctgcagaggtgccaccaggggcagccccacccattcccatagaagtgtcacttccattttggcagcgagagaggtccttcttagagcgcttcccctctctgtccaagctactgctatcattgggatcatcttcatccatgtcctcattgtcgccatcatttccatccccaaaattctggttcacttcatcaccgttttcatcaaagcccactgattcgacctcgaatcttaattcaaagtagtggtcgccgataacagcatccaactttgtcggcaacaacttgggatccaacacagcaaccaacacccggccaaaattgttcttgcgagtagtttccatatcaaccgtttgtgtagacccaagcatagacccaatggcccagagattcaaaaattctctcaattttttccttattccagtgacccgaatccaaaccttaggtaacagaaaaccttcctcctcctcatgccattcctcaaattgcatccttgtccccatgggcacatctttatcacggacatccgcacccccaaatgcaatggccctctgtagctcattcttagatggaaacgcgacaatgaaagagttctgctcatgaacaacaggttcccaattccacttgcttgaaacaatacgctgcaattgcgccaccaactgat

SEQ ID NO: 24894 - DNA, 832 bp, Zea mays
ctggggcctcagccgggccgggatccctcgcgctctcattcagatccaatctttgctgctgccactcggcgatccgatcgttctcgagcaaggtcggtggccatggctcgctgccgccatcacctcctcctccttcccgtcttacttgccttggctgctgctgctgcgcggcaggcgcagagtcatggggaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagttcttcttcctaatccatttgatagaccgcgtgctgttttcctcgtgcaaattgctgggttcgatgttcctagcttcgtatctgaaggcagcaacattttcaagaccaggattgaaggtgcaaacatcgctgatacagggcttacagataaggatgacttaattgtcattcattcggatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttattagaatgccacttcacagggttgaaggctctgg

SEQ ID NO: 24895 - DNA, 1704 bp, Zea mays
  misc_feature (1681)..(1698): n is a, c, g, or t
aacatacttggctgggccttccccagcggcgagggcgtggcccgttgtacaagtataacaacaattggcccagcgtagcatgcccgtggtggtggcgtcatcgtgtctcctcgatcccctctcgttcctccctcgtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagttcttcttcctaatccatttgatagaccgcgtgctgttttcctcgtgcaaattgatgggttcaatgttcctagcttcgtatctgaaggcagcaacattttcaagaccaggattgaaggtgcaaacatcgctgatacagggcttacagataaggatgacttaattgtcattcattcagatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttattagaatgtcacttcacagggttgaaggctctggagaatgaatatggttctggtgaaattgttaagcagggaacagaaatagttcagagagctgtcaccaaatcattccagtccctacatgaagcatacaaagggaaaattgttgggctggtaatatccacaaatgaggctccatcatccttaggatccataattgacgcaccatcttcactgcacatttcaagacggctagaagaagcaagcaagactacagacatagcctctgtcgtacttgttcgaaagagcttggcatggattacagggatcatcctgcttgtttcaactctcataggggtttgcttgcttatgaacatgccacttaccagggacaccctcctgtactcgaatgtcaagatcgattagtttgaaggggtgttcgcggcagctactcttggggttcaactttggccttgtgtatttatgggatggatttcagatggtagagacgtatgcttgtgctgttcacaaaaccagtgtacaatgtgatactaggtgctacgtgcctttctttttttaatctgtgcttccatcttgcctgtatgggctgttttgttgttgggttcccggtaaataatccagagcagtggcacaaacgattagttgttgcagaatgctactgccttttctgaataaatctgtcattgtaatcgaatttcaacttgaataacaatgtgtatgctatgtttgtggcgctaaaaaaaaaaaaaaaaaaaaaaaaagcggccaaaaaaaannnnnnnnnnnnnnnnnnaaaaaa

SEQ ID NO: 24896 - DNA, 1482 bp, Zea mays
gttcctccctcgtcgcctcacatcaattcaagatccaatctttgctgctgccactcggcgatccgatcgttctcgagcaaggtcggtggccatggctcgctgccgccatcacctcctcctcctttccgtcttacttgccttggctgctgctgctgcggcgcagagtcatggggaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagttcttcttcctggaatccatttgctagaccgcgtgcatgcccccccctactctggcagaatgtctcagccattgtttttcgattttcagttgaacaaagttcttcttcctaatccatttgatagaccgcgtgctgttttcctcgtgcaaattgctgggttcgatggtatgccagttgttatggaatgctttgtatcattatttgctaatttctgtgcattctgaactagcaactaaatttcccatcctgcttgtgtgttggcctcagttcctagcttcgtatctgaaggcagcaacattttcaagaccaggattgaaggtgcaaacatcgctgatacagggcttacaggtttaactgtctatcttgcagcttattatttggatctgtacatctctctctctacttctgaacctggatgccccacttcttgggttcttatcttgttgttgatatattctttttatccattatttactttacagataaggatgacttaattgtcattcattcggatgaatctctagatctctctcgatcagattatcttgataatgaactttccagcttggtaagcaagacaaatgcagtacgatgtataacctttctatttacaaattgtaagccgatattttttttcaggcaaactggttggagggatcttatcagaagtctaccggcaaactagtcattcccttggagaatggaaacagtcttactttgcaacttgataaggttagcactccatctattgcacacaaaaatgcctcctacctacctcgctgaacccacataactgaatatttttcctcaggcataattcacacaggtgcacagcttagcaaccccgtagatgtttgtcccccctctggattgcatttttttgtcacagccactccataatttattatcacgaaataaaatgtagcagtatgtatacgtgtaactaaatatctcactgcattttatccgtgcttgtgtattttttatgtctcaagtcccggctccattgcaatgcattcatttgcaggaagcagacaaggaattcatgtccagcttggcttcccttcttaagactattgaaagggcgatccaggttcatgaagatttctcaggtgtcgtgaaccctgcaggtcga

SEQ ID NO: 24897 - DNA, 1561 bp, Zea mays
ggtggtgtcatcgtgtcttcccgatcctctcagtggccccccgagccggcgggtcgttcctcatcaattcaagatccaatctttgctgctgccactcggcgatccgatcgttctcgagcaaggtcggtggccatggcacgctgccgccatcacctcctcctcctccccttcttacttgccttggccgctgctgctccgcggcaggcgcagagtcatggggaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccagctatttcttcttcgaagttgaacaaagttcttcttcctaatccatttgatagaccgcgtgctgttttcctcgtgcaaattgctgggttcgatgttcctagcttcgtatctgaaggcagcaacattttcaagaccaggattgaaggtgcaaacatcgctgatacagggcttacagataaggatgacttaattgtcattcattcggatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttattagagtgccacttcacagggttgaaggctctggagaatgaatatgggtctggtgaaattgtttaacctgggaacagaaatagttcagagagctgtcaccaaatcattccagtccctacatgaagcatacaaaggggaaattgttgggctggtaatatccacaaatgaggctccatcatccttaggatccataattgacgcaccatcttcactgcacatttcaagacagctagaagaagcaggcaagactacagacatagcctctgtggtacttgttcgaaagagcttggcatggattacagggatcatcctgcttgtttcaactctcataggggtttgcttgcttatgaacatgccacttaccagggacaccctcctgtactcgaatgttaagatcgattagtttgaaggggtgttcgcggcagctactcttggggttcaactttggccttgtgtatttatgggatggatttcagatggtagagacgtatgcttgtgctgttcacaaaaccagtgtacaatgtgatactaggtgctacgtgcctttctttttttaataaaagaagcactcttgcctgtatgggctgttttgttgttgggttccggtaaataatccagagcagtggcacaaacgattagttgttgcagaatgctactgccttttctgaataaatctgtcattgtaatcgaatttcaacttgaataacaatgtgtatgctatgtttgtggcgct

SEQ ID NO: 24898 - DNA, 1551 bp, Zea mays
  misc_feature (1449)..(1449): n is a, c, g, or t
  misc_feature (1463)..(1464): n is a, c, g, or t
  misc_feature (1474)..(1474): n is a, c, g, or t
gcctcgcgcccggccgggccgggatgcccgtggtggtggcgtcatcgtgtctccccgatcccctctcgttcctccctgactccctcgtcgcctcatcaattcaagatccaatctttgctgctgccactcggcgatccgatcgttctcgatcaaggtcggtggccatggctcgctgccgccatcacctcctcctccttcccgtcttacttgccttggctgctgctgctgcgcggcaggcgcagagtcatggggaagcctccgccgtcttcatcgatgcctcgtcgcaccgctaccttcgggaccagcaagccgaccaccaggacgcttcaatgtcgttaaatgaagtttctgcggttgtttctgtcttgcttggttttgcaccgtcaacatccctaccagctatttcttcttcgaagttgaacaaagttcttcttcctaatccatttgatagaccgcgtgctgttttcctcgtgcaaattgctgggttcgatgttcctagcttcgtatctgaaggcagcaacattttcaagaccaggattgaaggtgcaaacatcgctgatacagggcttacagataaggatgacttaattgtcattcattcggatgaatctctagatctctctcgatcagattatcttgataatgaactttccagcttggcaaactgggttggagggatcttatcagaagtctaccggcaaactagtcattcccttggagaatggaaacagtcttactttgcaacttgataaggaagcagacaaggaattcatgtccagcttggcttcccttcttaagactattgaaagggcgatccaggttcatgaagatttctcaggtgtcgtgaaccctgcagagttactagaatgccacttcacagggttgaaggctctggagaatgaatatggttctggtgaaactgttaagcagggaacagaaatagttcagagagctgtcaccaaatcattccagtccctacatgaagcatacaaaggaaaaattgttgggctggtaatatccacaaatgaggctccatcatccttaggatccataattgacgcaccatcttcactgcacatttcaagacggctagaagaagcaagcaagactacagatatagcctccgtggtactcgttcggaagagcttggcatggattacagggatcatcctgcttgtttcaactctcataggggtttgcttgcttatgaacatgccacttaccagggacaccctcctgtactcgaatgtcaagatcgattagtttgaaggggtgttcgcggcagccactcttggggttcaactttggccttgtgtatttatgggatggatttcagatggtagagacgtatgcttgtgctgttcacaaaaccagtgtacaatgtgatactaggtgctacgtgcctttctttttttaatctgtgctgcactcttgcctggtatgggctgntttttggtgttggnngttccggtanataatccagaacagtggacaaaccgattagttggtgcatgctactgccttttctgaataaatctgtcattgtaatcg

SEQ ID NO: 24899 - DNA, 1225 bp, Zea mays
aaatgcctagtaaataaacacaccactgacccccgcgcgtacttctagtgccacccaccaacttccccttccccgtcgcatcgcatcgagagcggggctgtaccgtgcgagactctactgctcgatcgccatggccgccgcgctcaggtgcccggcctccgtcagggtctcgggccccgccgccgcggggctcgccaaggtgcgccaggcgtccagagtcgtcgcggtgagcggggcccggcagagccgcggcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgacctcgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttcggagactacggccacatctcggtgcagggcccgtacctgacctacgaggagtcgtacctggcggtcaccggcggctccggcgtcttcgagggcgtctacggccaggtcaagctcaaccagatcgtcttccccttcaagatcttctacaccttctacctccggggcatcccggacctgcccagggacctgctctgcacgcccgtcccgccgtcgcccaccgtcgagcccacccccgccgccagggccgccgagccgcacgcatccctcgacaactacaccaactgaactgatgattgatgaatccattatcatccatctctgctctgtctgtcgcggctgtcagaacttgacgagacaagctcccctgctactcatcagtactcctcactcgtagccgtagtttggctactcttatgtgtgtatggctggtttcttcaattcgtgagtgcgtggtagtaccaataagcaataagacgcagagggatcgatcaagctgtgtgcttcacttggctgcttctgattacaattgatcaatggtaacgtaaacggtaaagctctgtttagtgtttagatgtgtttaaacggagttaaatggttttagcatcattttagcaagattaaaaaaaaaaaaaaaaaaaaaaaaaaaaaaaaaaaaaagccagt

SEQ ID NO: 24900 - DNA, 1383 bp, Zea mays
aggttccctagccccggccacccacttaaacattgggtacctccagccgccggggcactcacgaattccccattcccttccctatcgcatcgcatcgagagccaggccagccagccacctctgcttggtctccatggccgccgcgctcaggtccccggcctcggccaaggtctcgagccccgccgccgcctccaaggtgcgccaggcgtccagagtcgcggtgggcgggttccggcagcatccgcggagccgtggcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtttacaacggcagcctggacaagcggctgggcatcaccgccggcatctgcgtgctcatccagcacgtccccgaccgcaacggcgaccggtacgaggccatctacagcttctacttcggcgactacgggcacatctcggtgcagggcgcgtacctgacctacgaggagtcgtacctggccgtcacgggcggctccggcgtcttcgagggcgcctacggccaggtcaagctccaccagatcgtcttccccttcaagatcttctacaccttctacctccggggcatcccggacctgcccagggacctgctctgcacgcccgtcccgccctcccccaccgtcgagcccacgcccgccgccagggccgccgagccgcacgcctgcgtcaacaactacaccaactgactgatcaactccagcccaggaaccatctctgcctgccatgcctgtccctcactcgatttgtatgtttgtatggcttaggtccttcgattcgtacgttcgtgcgtggtagcaccaataaacatgcgatcgattgagttgtgtgtgcttctccattcattcacttgctctttctgcagctcgtgatcgagttgtgtgtgctccattcccaaattatgtatgatcgattagtagcgttaggggttaaccagtagccgctgtgtacttgtgtcacccttggacaaacaatgagatatttctttgtcgtcgagtaatccttcctgacggtgatggtgatggacatgttgctgacacgacgggatttgggaatctttgagcgctgagctgtgatgcaactgcagcgaccgctgctggtgctcttaaagcgattgttgccttgttggagtcggctgtgtgtccagactccagagtctacacgttcactgtaataacagggaggcaaggcaagtgagaaacaggatctgttacacatgctc

SEQ ID NO: 24901 - DNA, 1231 bp, Zea mays
tgggtccctcgaggccctgcttctagagttttagtgccagcctgccaggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgccaggcgtccagagtcgtagcggtgagcggggcccggcagagccgcggcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgacctcgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttcggcgactacggccacatctcggtgcagggcccgtacctgacctacgaggagtcgtacctggcggtcaccggcggctccggcgtcttcgagggcgtatacggccaggtcaagctcaaccagatcgtcttccccttcaagatcttctacaccttctacctccggggaatcccggacctgccaagggacctgctctgcacgcccgtcccgccgtcgcccaccgtcgagcccacccccgccgccagggccgccgagccgcacgcctccctcgacaactacaccaactgatgattgatgaatccattatcatccatctctgctctgtctgtcgcggctgtcagaacttgacgagacaagctcccctgctactcatcagtactcctcactcgtagcccaagggtttttcatttttccatgggaaattagttcatttttccttgggaaattgaaaatcccatagaaaaatgtggttgccaaactagcctttatgtgtgtatggctagtttcttcaattcgtgagtgcgtggtagtaccaataagcaataagacgcagagggatcgatcaagctgacttggctgcttctggttacaattgatcaatggtaacgtaaacgataaagctctattcactgtttagacgtgttgagacggaattaaacggttttacattgtacc

SEQ ID NO: 24902 - DNA, 2219 bp, Zea mays
cgatgttttttcagtatgcttttttatgttccatgctgtaaaaaacgaattatcgactggactttagtaaaaatcaacagatcgcaggaacatctcggccggccggagtgtcggagatggtggtgatgacgacctgggagctgccgaccacgctctgtacctgtggagggtacgcagatctgaaacggcggcgaccagtacttaccaaccaccgtgccgccacccgggatggacggcgcagcgcatgttgtactcgtggcccggacgacgcgaaaagacggcgaggaccctaacccatgatgggctaccccaccccaccaaagcagccgttgcacgagaaaaggacgcacgcacctaccctaccccccggtcacccaaaatgcctagtaaataaacacaccactggccttcgtgcctagcctgccagtgccacccaccaacttccccttccccgtcgcatcgcatcgagagcggggctgtaccgtgcgagactctactgctcgatcgccatggccgccgcgctcaggtgcccggcatccgtcagggtctcgggccccgccgccgcggggctcgccaaggtgcgccaggcgtccagagtcgtagcggtgagcggggcccggcagagccgcggcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgacctcgtccccttcaccaacaaggttggtctcgtctcgtctcgttcccccctctgttcctagtcaagcaagcaagcctctagcctctgctcatccgtccctctctctctccaccaccccaacctgcaggtgtacaacggcagcctggacaagcggctgggcgtcaccgcgggcatctgcgtgctcatccagcacgtccccgaccgcaacggcgaccgctacgaggccatctacagcttctacttcggagactacggccacatctcggtgcagggcccgtacctgacctacgaggagtcgtacctggcggtcaccggcggctccggcgtcttcgagggcgtctacggccaggtcaagctcaaccagatcgtcttccccttcaagatcttctacaccttctacctccggggcatcccggacctgcccagggacctgctctgcacgcccgtcccgccgtcgcccaccgtcgagcccacccccgccgccagggccgccgagccgcacgcatccctcgacaactacaccaactgaactgatgattgatgaatccattatcatccatctctgctctgtctgtcgcggctgtcagaacttgacgagacaagctcccctgctactcatcagtactcctcactcgtagccgtagtttggctactcttatgtgtgtatggctggtttcttcaattcgtgagtgcgtggtagtaccaataagcaataagacgcagagggatcgatcaaaaaaaaaaaaaaaattggctgcttctgattacaattgatcaatggtaacgtaaacggtaaagctctgtttagtgtttagatgtgtttaaacggagttaaatggttttagcatcattttagcaagattaaatagctttccactaacttttttttaactaaacacaaagtttttgatgttctcttcatctaaaccatgtacctacaaaagatgggttaattgtaagtatataatatgtaaattttaacaagagtaaatgagtagatccgcaaatatatttggttcagccatacatttgtgataaacgaacaacaactccaacataacatattacatatctatataaccaaaatgaccaattcaagacaaacccatctttagtttagctaattatagaacaccaactaaaacatgctagaagaaaagataaaagatattcatatacagaaaccgtcaaaaaccaaggaaagaaagacaagatgtgaatatgaaaatatgaaatggcaggctcgaagcacatcatggtccataaggttaagccatcaagcatctagcaaatgaatacataaccaacaattgcagagagttcaagagctcactaaaattttaaccaacaagttgaaaactattgcgttctaaagctcactacatgatttttaacctacactgtgaaaaacttggtc

SEQ ID NO: 24903 - DNA, 1596 bp, Zea mays
  misc_feature (1596)..(1596): n is a, c, g, or t
tatatactatatatgtatatacatatgaatatatagacatatataattatatacgtatatatctatatctatatcccgttgccatccctttgtgcctgcacacacgcagcgtggacgaggcgactcagatctgaaaaggcaaccagcgatctgaagttgtgaacacacggcgttgtgatggacgacgcttggcacgacgcagcgcatgttgtactcgtgcccaattatggccggtgcgccccggacgacgtgaaaagacgatcaacatggacccccaaagcagcagcaggtgctccctagccccggccacccacttaaataagagaaacacaccaccaccgattcactcacgaattccccattcccttccctccatcgcatcgagagccaggccagccagccacctctgcttggtctccatggccgccgcgctcaggtccccggcctcggccaaggtctcgagccccgccgccgcctccaaggtgcgccaggcgtccagagtcgcggtgggcgggttccggcagcatccgcggagccgtggcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtccgtcgtcgttgtgttccttgctttgcttttgcttttgcttttgcttttgcttgatcggtgcctccgcttagccgctcttcctccccacccacccatgcacccaggtttacaacggcagcctggacaagcggctgggcatcaccgccggcatctgcgtgctcatccagcacgtccccgaccgcaacggcgaccggtacgaggccatctacagcttctacttcggcgactacggccacatctcggtgcagggcgcgtacctgacctacgaggagtcgtacctggccgtcacgggcggctccggcgtcttcgagggcgcctacggccaggtcaagctccaccagatcgtcttccccttcaagatcttctacaccttctacctccggggcatcccggacctgcccagggacctgctctgcacgcccgtcccgccctcccccaccgtcgagcccacgcccgccgccagggccgccgagccgcacgcctgcgtcaacaactacaccaactgactgatcaactccagcccaggaaccatctctgcctgccatgcctgtccctcactcgatttgtatgtttgtatggcttaggtccttcgattcgtacgttcgtgcgtggtagcaccaataaacatgcgatcgattgagttgtgtgtgcttctccattcattcacttgctctttctgcagctcgtgatcgagttgtgtgtgctccattcccaaattatgtatgatcgattagtagcgttaggggttaaccagtagccgctgtgtacttgtgtcacccttggacaaacaatgagatatttctttgtcgtcgagtaaaaaaaaaaaaaaaaaaaaaacacaaaaaaaaaaaaaaaaaan

SEQ ID NO: 24904 - DNA, 5559 bp, Zea mays
aatttttgttaagcatctagatatatttccatgagctagaaatattttattcaaattttgacatttagtatatcccaatgtgtgtccaataattttccacaaattttgtaagtgtagagactttttatggttcaaaatcgaatcttctatgacaaaaatcatgtcaaaacaactcgaacaaaggtaagaggtaaaaataatgacaaaaaaccatagtcaaaaccactgtaagctcctattttaaacctctaaaattaattattagtcactaaaagcttcttcaatagtgccttaaaacaatgctgtattttataattttttataaaaaaaatatagggcactctatggagtgacccaaatatattacactctaaactagtgccctacctttgttttctatatcattcttaatattgttttagcaataatgtaattcacttcaaaaaatacatgatttagagcttaacagttggagcataatttatttttagtgccctaaacactttaaatgatgtagtattttaatttttaggacactattttaagtcaccttatttaagatgctctaataagttgttagttggttttagttggattgaggcagctaacaactaaaagctattttgaagggtatagctaaatattagttggtctattggttgatcccgttttaaacttattagatattttagctgctaactattagttttagatgtttggaacattgcgtaaactaaggtgaggaagtaatgtgaatttttttgagagttcaaaaagtaagatgtctagttttaaaatttaggaggaagctacactaagaccgtctccaacatgtcctctaaattaaaggatcatgtactctaaattatagatgagattctcgtcctctacatgtccagtaacgtcctctaaatggtgttgcttgatcctctatatataaagtttctttgttctttcctctatccattttaatatattaaacaataggtttagcaaaactaaaatatgtataataaatttgagagtatgataaatacgtatgtataaaaaaattatgtctctaatatggatatttacgtatagagaatgagatataaaagacgttgctgaagaggaaggatatatagagaaaaagaaacttttagaaaaattataaaaaataaatataaaagataaatatagaggatgatgctcaaaacagtttaacgatttatatagttgacttgacggaggaataattaaccttttcctgtaataaatggatggaaaccctttcttccctccaccggccttttacacgtagaagtgggctgcgccgctctgcttggggcgacgagtggtttcttgggccgtctcagcatcaatgaatggcgcattcgtcttcagactcccggtacactatggtacattacgcatttgtagtaccgcggcaatattcatttctcctcgttaagacaaaaagtttagtttctgacaaaagcattaaattttcatgctaattatggaacattttagttttctgaatttcggtatagaatcgtccttaacacattttgcttttttttaaaaaaaaatatacaaaaaacccttgtgtaacatcgtattaagatgagaaaaaaaacgtaatgaaacgatattacatgttgccacagtagaacgcaagcctcacactgttgacactgttgatcacccctaaacgaacatatatattactcactaaacagataagcgaacatatcttatacacaagaccaccttcttgcacatttatatactagaaaattaatctggatccttcgtccaataatccttaactgacgtgttttctagaaaacatctttcacgttctcccctatgtttagctacatatgtaaaagaatctcgcatgttcagtcgaaagttattggatgaaaagttcacattgattttgtgcattaggatggattgaatgtggttttatgcgcaggatggatttccgacgaccaaacacgtaccaaatacccaatgctcagtctgtgtgcgataggactgacgtgaagaatctatggtactcgcgtctcagccatgcatataggcatgaaaggattgtcgtaaaaataaactaggtttgtcttaatataaactaagtcccgagtgtacaagatgtggtaagatatcatgcttatgccagccaaagaattaagaaggtaacttaaaataaactagcatatagcccatgctaacgctatgatcccgaagaggagagaaattgatggtgtcggcagcacgagtggggaggggaagggggcgatagggtcactggaggacggggagggagagagatgatacaaataatattatccattagatttgaatgtgttaggaagagaagttatctgacgatctaaaccgttggttttgatggtgtgttatgtctgggtgtaatttatttgatgcatttagtgaaagttatggatgtgagggtgatttgatcgtgtgagttttgaagtttaaactggaatataagtcattctattttttttctagagatatgatttttgttgtgtaaatatagcttttatctggatgcataataagaacaatataactataaacggcaaaatgtcttataatcaaaatggagggtttttttttgcatatgatagaaaactctcagtatttgttggagtgtaaagaagcatagtggtctggttttggtctttctctcgtttagtagtttcatgaaatttattcaagatgcaaacacatgtaaatgtaatagtgatacagtctaatctgtgcctaccatgtacgtaaaagaccgaaactaaaatctgtccattttgctgatgactagttgctgttggcaagtgccgggatgctctgctcgttcctgaagtagtcgtcggggtctatctgactcttggccacggcgagcctctgatagttgtccttgaagtacttgtgtccccacaccataccggcctggtagctgctgacgttgcccacaacgacgttctcaccaaggtccaggtccctgtagttgaagtaggcctccctcgggttggagctcacgtacggtgccatgaacgcgtacaagtccctgacccacttggtctgcacggctccgtctcctcccccagccatgggccagaagttcatgtactggatgttgtacagcacgccggcgcggtgcgggaacggcgtcgccgactccggcacggtgctgatctgcgcgccgtaggggtccagaatcatgagccccgcgttgggctgcgcgagcctgctgaatatgttggcccacacgtcccgggggatggcctgccggacgtagtcggacgtggccttgtagccgccgctgaacacggacgcggaggtggtccggttcaggaggtcctccaccgtggagccgctgccgaggtagatgtagggcacggattggatccacgtcatctccttgcaggagctgcggttgagccccagctccgggaagcggctgcccatgacgggcaggagcgcgtcgcacgtgccgaggaacagggactcgaagttggccgtctgctgctggacgaccaccctgatgaagaggtcgtccggcagggcaggcgcgacctgctgccacctggtgaccacgtccacggcgccctggcttgcgggcaccgggacgttgaacaccgccaccgttgccgggacaggcacgagcctgacctgccacgacagcacgacgccgaagctctcgccgccgccgccacggatcgcccagaagacgtcgctccccatggtgttcttgctgaggagcctccccctggcgtccaccagcacggcgtcgacgacgttgtcgatggccaggccgtacttgcgtagcagcatgccgaagccgccgccgctgaaatggcccccgacgccgacggtcgggcacaggccggcctcgaggtacacaatggggctgccccccccgacggcgtagtagagctccccgagcgtggcgccggagtccacccacgcggtcgaggtctggaggtccacgcgcacggcgcggaggttcgacaggtccagcaccgcgaacgcctcgggccgctcggaccggtacgacaggccctcgtagtcgtggccgccgctgcgcacgcgcaggcgcatcccgttctggcggccgcacagcacggcgtcctgcgcgtgggaggcgttcgtcggcgtgacgatgtacagcggcctcacgatgctcggcgtgaagaacttggggttcctgatggacgacttgagcagcgtcgtgaacgaaggcgagctctgcgtgaacaccagctggctggggatgctcgccgagaggcaccggaggaagccatcggacgacgaagcggcagcttgggccgaagccatggaggcggcgtagtagctgcagaacaaggcaaatatgagcaccggcggcgctaatacgctcttggccatggccatttttgtttttggcttagctagctgctagcttgttttgcaaacgcgttgcaaggttggttgttgcactgcatggcatggagcggcttgatctacatatatatgtagcctacgattggtgggtttctcacacgtgcaaaataaaactgttatgtgattagggtggccttgtcagcagcttgatatatggcacgctagtccagctggctgcgttgaaagttcatggtcaactgtgtagctagctattccatgcggcgacggttaaccggctgggcaaagacgagcacacggtccgatgggtcctcggtctaaagagatggcccagccctcataaatatacccgatgaacgattctacgtcgatcgtgagagcatttttatcacatgcatgactagatgagcacgatgaggtccattgtgatacggcttagtgtagaaacaaatgtaaaagcaaagacaattttgagggctgttagataccgactaccgtacatgctggaggtcggctgatgcctggatcgagctacttaattggacagcccacaaccttcagcaaaactgtgttctgttttgcaaactcagctcttccttcttcgctgcagggcggctggtgtcgacctttaactgtggcgtcgtcagtggcaaggcgaacctcgcaagggctcgatactttgtttgttctgcccacttcaaattaaacatagagggggaatcgcctaccaggatgttcgatcagagcgcgcgtcggtcgatcaaacactttgctatccatcaagagtggagctctaaaatcttgtcgccgccgtgtcatagcacgtttttcgttaggaagtagagaataccaacaatgatacaacatactcctcacagtaacagtaattaccaaaacggagtagacacgaaggacccagagttattacatactaccttgcgcgacacgacacaagcagaatcaccagagaaaactaactatgtatggttttcgaaggcttatatcatcggatgtaagttatgaaccgtcggaaataaaggtttaattcttatttcggaaggcaagacggtcttccgtcggtcggaaatatcgttagttgataataacctattttcgacggtcgttattggccgtcggcgataa

SEQ ID NO: 24905 - DNA, 2963 bp, Zea mays
  misc_feature (1867)..(1867): n is a, c, g, or t
tcttgatgatatggcatttagttactttttctataagaaaatctgaactactgtggtgtcttccattgtcatcagtcataagaatttatatcatttcatgaactggacattgtaataccatcacgaaagttagtgtcattccagagaatggtgggattctacagcaaaccgggaagttgttctgtctcattaggagagcaacagagggttgtgatggtcagtatttactagcaggccaccattattttgctatcttttattttattttatacaccgttagatatctgaaagtcactgtcttatttttgtcaggctcattgtttttccaccatcctagctcccaagtgtggtatcatcgacgagtgcctcaagtaggtattctatgacactgctctttattttctattttcctttctctttgctgatcaaccgttgtactcgattgcagtgcaggctgctagtgttgatgtagaagaacattcatcatctgtacaggcctgcaactaactaacatggcacgcccgtggtcacttcttcacaacataccctatactgttagtcaaaactgtaggctgctcggaacaaactggcggcggcggcgatagcggctgctgctggtgctgactgctgaacaatcatcatcccgtaacagaaacagaagagcaaattaagaatttaagtaatcaaagaatcgttatttcttcgtttgggaggctgtgtactgtacacgaacaagaagaattcagtttgggagctcgaggccgtagagcacgccggcgcacggctccaggctgccttccttggggaagtagatcctagccatctcccggaaggtgtcccaggtgagcacgctgtcggacgctgcctggtgtccttggcccgctgcgcggcgcacccggagcgcggcggcgacgcgctcgaggccgcccagcagcgcgacctcgccgtgggaggcgcatgcgaccctggccatgtgcttgacatcgtagacggcggcgccgaagtagacgcggacgtagcgcaggaagtccgggagcgcccttggcagcttccgtcccatgagcagcttgacgaggtaggcgaagtcataggcggagctgaaggtgacccacgcgacggccgggttgcagatgaggcccgacgaggcgagcagcgcggcgaaggcgcgcgcggggacgcccctggcgcggtgggcggcgaggtcgaggccgctggcggcgagcaggcggaccgagtccggcgcgtggcggtgcacgcgcgggtcgaagccgcggaggttgatctggaaggcgagcgcgggcggggagccaggggacggcgccagggccaggccgacctggatgaggtgcagcgcgtcgacgttggacttgagcagggcgtagcgctgcggcgcggtgagcgtggagtggtggacggccgggggagggtggtggatgacgcccgggaactccgtgtccatggacacgtaggggaaccgctcgatggcggcgcggatgagcttgaattcgcggtccacgttgtccgcccacacctgacggatctcaaggggatggtggtggtggcggtgcttctgctgctgcttcggcctccacccgccggcgccgcccacctggacctcgacctcgactgaaggcatgttagtggcaaggcttgttgcgcacttctacttgtgcaggttccgatccgatgactgccgccgagacgcgaagcctcgagggctcgcgaggaggctggagcgatggtgcccgcccggccccgtggctgccgaggttttatagggaatggatcggatggaggagggaggtgtgcagtgcagggccggcaggagggtgcgaggaacgggaggaccggaggaggaagccggcgngcgcgtggagatccgtgcggcgacagggatcgacggtgggtggacgctgcacaacttgcacgcgtttaattatggcgtggcgtggcgtgcggtgcggggagaaaaattgttaatgattgggcccgatccgaccagcaggcaccgcaccaccagctggactcactggcctgttcaaccgactgggtctgggtctcccgccgccgttgccgggaacgcggcggcgtcgtgtgctttttacacggtcttgctttcgccttccccgtggaaattgcgccgtcccccgtgcgcgtacgtaccactcgttgactagcccccgtctcctctggtgggcttgggcagtccacggagggcaacaccgctatccatacaccgtactcctacatgtgatgtgacgtggcaaactagttaggtcttgttcggttaatcccgttactcctgagattgaaaaaaaattaagaaggagattgacttatttgagatttaaatccacccaatcccaatcaatccatgtggattgagagctaaccgaacaagcacttagttggattagtaaatccattagatcgattttgaagacttaatgtagtttgctgaaatagttttgcagatggattgaagacttaattgtcagaaaagaaggtgggttgtttgagaatatagaagataatctgaaaatgtttgatattccacctagcttttgtgttctttttctacggacaaagaaaaacttcgatgatgacgatttcacattaaaggagaggtttgatagtggacagagcagggcacattacgtattcatgcccttgtgtaatgagggtcattgttcatgttatagaatggtagtgcaagggtccaatatgacattgcctaaggttttggtggagaatggatatagaaggtcctttgatggtcttatagtcgatgaacaacaatatagaaccaatgaagatgcaacaccagacaacctaggagccacttaaggtttctctaatgaaagttggtgaatcaattcattgttcaggaagcttctcaacaatagcttttgacattggttcatatgggcaatacaggtgggaggaaaagattgttgatgatg

SEQ ID NO: 24906 - DNA, 1231 bp, Zea mays
agagtagtaaagtaccccttttttataaagatttatctgaaatcttttggaaagaagtagagtttgatagcgctctagtagcgatatttgagactatccgaaagaattctgcactgcaagggccgccctttttttttttttttttaagaatttaagtaatcaaagaatcgttatttcttcgtttgggaggctgtgtactgtacacgaacaagaagaattcagtttgggagctcgaggccgtagagcacgccggcgcacggctccaggctgccttccttggggaagtagatcctagccatctcccggaaggtgtcccaggtgagcacgctgtcggacgctgcctggtgtccttggcccgctgcgcggcgcacccggagcgcggcggcgacgcgctcgaggccgcccagcagcgcgacctcgccgtgggaggcgcatgcgaccctggccatgtgcttgacgtcgtagacggcggcgccgaagtagacgcggacgtatcgcaggaagtccgggagcgcccttggcagcttccgtcccatgagcagcttgacgaggtaggcgaagtcataggcggagctgaaggtgacccacgcgacggccgggttgcagataaggcccgacgaggcgagcagcgcggcgaaggcgcgcgcggggacgcccctggcgcgagtgggcggcgaggtcgaggccgctggcggcgagcaggcggaccgagtccggcgcgtggcggtgcacgcgcgggtcgaagccgcggaggttgatctggaaggcgagcgcgggcggggagccaggggacggcgccagggccaggccgacctggatgaggtgcagcgcgtcgacgttggacttgagcagggcgtagcgctgcggcgcggtgagcgtggagtggtggacggccgggggagggtggtggatgacgcccgggaactccgtgtccatggacacgtaggggaaccgctcgatggcggcgcggatgagcttgaattcgcggtccacgttgtccgcccacacctgacggatctcaaggggatggtggtgctgctgcttcggcctccacccgccggcgccgcccacctggacctcgacctcgactgaaggcatgttagtggcaaggcttgttgcgtacttctacttgtgcaggttccgatccgatgactgccgccgaggcgcgaagcggcgaaggctctagaggaggctggaccggccggccccccgccggcctcgaggtacccaa

SEQ ID NO: 24907 - DNA, 1221 bp, Zea mays
agccgggccgggcctagtcgcagctcttccgtctcccgccgccgccgcagccgccgcctgcctcgagccgccgtcgccatggggagaagacctgcgaggtgctatcggcagatcaagaacaagccataccccaagtcaaggtactgccgtggtgtgcctgaccctaagatcaggatctatgatgtcggcatgaagaagaagggtgtcgatgagttctctcactgtgttcaccttgtctcatgggagaaggagaatgtgtccagtgaggctcttgaggctgcccgtattgcttgcaacaagtacatgactaagcatgcaggaaaggatgccttccacctcagggtcagggttcacccgttccatgtgctccgtatcaacaagatgctttcgtgtgccggggctgataggctccagactggtatgaggggtgctttcgggaagccgcagggagtctgtgcccgtgttgccattgggcaggtcctcctttctgtgcggtgcaagcccaacaatgccatccatgctactgaggcccttcgtcgtgccaagttcaagttccctggccgccaaaagatcattgagagcaggaagtggggcttcaccaagttcaaccgcaatgactacctcaagttcaagagtgagggcaggatcttgcctgatggagtcaacgctaagctgctcggatgccatggccgccttgcaaaccgtgcccctggacaagctttcctgtctgctgcataatctagcagaagaagtctatccgttctatcgaaacttattttaccgtgtggaacttagattccaagtgcctgtggtgctatgttattttgtctgaatgttgtgtcgaaccttgttatggaagatattatctattttgtgatgatggtactaatatgaatggcctgttgaatcattactacttgaattcgtttgtcaatgtattttgccccgggggctcgccagacgggccccagggcctcaagggccgccctcttgatccccccccgaagccaagtttttcgggccaagtggccaaaagggcccccgtgggtaatctctttggggccgcccccccgggcccccccccgggcggcccccacgaggggaaaaccccccccaaaaaaaaagtttttgtggggggggggggggggggaagaagagaccaataaagggggaacccgccaaaaggggggggcccccccccccctttttttattttttttt

SEQ ID NO: 24908 - DNA, 464 bp, Zea mays
  misc_feature (442)..(442): n is a, c, g, or t
ggataaggattttctaaccgaagcagagagcgcaaagataaaaaaaatggcgagcgtgagtgggtgtggttcggtgagcctcttaactaaccgcaatgcattcctgggaagcggactgcaacaccgtgccgttttcctgaaaccatggtcgccgccttcgctgctcaagtctgggtccttggtcgttgaagccaaaaccaaaaccagcagcgaagacagaatcgcccgccattctcgcatccgtaagaaggttaacggtacaacggagaggccaaggctgtgcgtgtttcgctcgaacaagcatctttatgtgcaagtgattgacgataccaagatgcacaccttagcttcagcttccaccaagcagaaacctatctctgaggagttcgactacacttctggaccaaccattgaggtggcgaagaaagtaggggaagtgatngcgaaatcatgcttggagaaag

SEQ ID NO: 24909 - DNA, 6662 bp, Zea mays
  misc_feature (1527)..(1527): n is a, c, g, or t
cgttcctctataggtcgtgtcaaccaatcttctctcctccccttatgtcctttgcccatgaccccgtagccaagtgtgacaggagcaggtctgcttctccacccatgacccgacaccaagctgattactagcattagatgaagctgtgattagttccaccttgttatatccgatgaagttattgaagattgtcggcgctcacgatgctactagctaggggaggtatgacgtcaaggagacggagtcttgatccgatccttcactagcgcatgcaactttagaaaaaaataaaataggccaacaaaactaggttcaaattgaactactcccccaaatattaagaattgttggtgaccaaactattaattacttacaatagctatttagcaacttgctaaacatgagttaagagagcttctttagagaactagtggggttgctcaatgaaacatgtgagggtagctagaccggtagaggtcagcggttctcaagccagcggcatatatattttttttggaaatataaacttatttctagagacagctcatctcttccaagtcatctctagaagacatgatcgaaaaaccgcctctacaaggcaagaacaacctaaagtagagagaaatgccgccaaaaaaatgaaatctgtagagataggccggatagtttttacatttctttatttttgtttgtttaaagaagcaaagggtgtagtacacttatctctgaggctgaaagaagtagaaatggaattgatgtcgtcatttcttgacagcaaaactattccctgaaagaagaataactttacatgaatgctagaaaaaaacaaaatgctcctagccagttgatatattaaatatcgcattcccttttcagaaagagagaaaacaacgcgcattggaatcttgacgccttcaattgtgcatatcatctatgtaatcttcatctatcttgattcttcttagacctgtttgtttcagattataatctctctagattatataatccagcagttaaacaaacacctagattataggtacatattatataatctaaagtccagattatgataatcccataatcttctcaaaggtagcttattttgagattatttttggcaaaacactcactgcccatggttatgtaaataaaaattacaatatatgtcatactttcctcaccttaaataaacaaacaagagtattgttgtctttatgaataatctacatttgtataatttatactaccaaacagctacatataaattataatctatctagatctggattatataatttagattataatccagattatataatctataagctaaaacaaacatgcctttagtagtagatttagcttttagtgtgagctatttcttaatttgtccttccaaaacatggtgcgaattgcgatgaacatgaaaatcttattatgtacgtatataatatatcttttgtagcgtcgttcatggtttatcgtataccaaaacttgttaataagctggatttcagaataccattnaaattttacattctcggagatgtaaagcctgctgatgaatttgttaactttctgacgacagaattttgggcctttttcacattatagttcttaaattagaactggctgttgtaatataagaggagcttgcgcatgcatcaggttcgagtaatgtcacaataatcttaaccaaaccgcttattaattaattagggctttctttcatttccaacaatatattatatatattcgagttgatgtaacattccaataaattaaaggctcgtttgaagggcatcaatcaacatgagggaataaattaaaggcctcgtccatatatatcatgaaattgttctagtttgtccggcaatataatcctgaccgtccatcacctgcccacctgtgcgcgcggcgtgggtcctcctatgggcgattgggttcctcgaggccggccgggaaaggaaaatccggcgcggcccaacactagtagcgtagctgagagcctgagacgatggccgactactaccacggcggcagggccatgtactccaacactgacgagtgctatgacgccggcaggcacggcggcagcgtgagggcgtactcgcgcaccgacgagtactacgacaacgtggacgaccgcatgaggaggcccgcgtacggcgccgacgactgcggctacggcggcaggcagaccgccgtgtacgccgacgagtactcccgcggcggccgctacgaaggctacggcgtcgagcaggagcacttcaagagggaggagaaggagcataagcacaaggagcgcctcggcgaggtgggcgccctcgcgggcggcgcctttgctctgtaatatatataatacagttaccatatatatatgtgcatgcacgatctatatatgtggtgatgtgttgttgatggaatataatatgctcgaaattagtacgaggggcaccgtgcgaagaaggacgaacgcgcagaggcacaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtgtaagtaaataagagcaaacgtcgtcacgtgtgtgttgctcgatcactactccatcgatctacttattatcgtctgcaaataacgactaagcgcatgcttctgcagcgtgtaacgatccatcactgttactatatctaatgatgcatgcatgcaattaagctaaaaataaaaaaaaaaaagcggcctcttaatgtcaaacgtaatctcacaaagctactctatacaactagctagctaggtagtatatatctctatctatcgtccggggaaaaaatatatgatatattctacagcttcaccatccggttcagttttttcaaggattgcccaaatttatataataaaactatatataaacttttaaacaaattcagaatataaaatcgctttaatgaaaaaatatgctttcatgatatatatatatatataccaaattccacatggttgcattgcatgctacgaagacatgcacctttttttggggaatttatttcgtcgagcgacttcctaaaccgttgatgatagctaatcgctatcagaaaactaaacgaatatactgtttcctaaaaaaattctataatcatctgtactaacatgcatgggcatctaactaagtcttccaagttgtgacgaaggcttatcctccaacttaagcattcctaggctcctagctagcaggtaaaacagacgtcatacgaactccgctttatttcaatgatccatgtactcatgaaaagctaattctataagctaaccagtgggtttgagtttatgtcaaaatttatctagtagagtcatcaaaaattgtcgaaaacgagtcaacatctagaatctgccagaaggtgctagctaggacatatcaccttcacccggtcgcctttcgtaccccttatatcgtcctagaacctattagggagtgcgtccaggggtttgcacgctcaagactttatttttagccgttaccacactcattagggttagggttttattgggtttttttctttcctcatgaaatatgtattttatagcatttctatcaccaagatcgattgttgtgaatcagagccctagttcttgaccttgttcgcccgtgtcgatcagtgatcgttcctctttatgggtcatgaatcgaaccttttatcagtttgacaaacttcatatatatatttgaaattttagactatgttattcattaataaccggtgcaaccaagacacaagggtggctgggtgggataggagggtctttttaaaaatatccaggggagatgggaaggttattttgggtggaaaaattaaaaaggtcatcccaccctatccttgtgtcttggttgttgcaaattaaaaatgtgtagaaagaaaaagaaaagacgtaacggtaggagccatcggtcggtgctcccgttcaacgacatgcacgcaccccaggaaggcttcgttcacagcaggagtaacatctctacaaagttgtacagtgtttgtttaggaaccacgcgccggcgatgcttctacgcctagctttagcaactgcaagttcaaagatagatgcaacgaaaaaaaaatatgattctttctcccaacatcggtctcggtttcctggaaaggacatttctaaatttctgtcacggcgaccatgtccgcctcctgtgttcgacgatggaatgtttgtcgaagcctcaaaacttgacatggcaaggcggcattggattcctccgttccaatgcctacctgctgcctcgtttcgttacgttactgcagccgtcccgccccgccccgtccttggcccttgccaaccccacccaccacacggaaacagagagagccttttgctttgctgtgttgccgtagcagtagccagtagccagtagcagtgcgtgtcctcctgttccttctccctcctccagccactgtagcgtcgtcatcacccctcattcaccattcacttcaccagacaggcccgatttttaataaataaacccagggcagtcgcaggccacattggtcattcgctcccactatccagactcacacagtccacactccccgcatctggcgacattgtgtgctcggcagtctcggactcggagtgagagcgagcaacaagaggaggaaatggagaagcgacacggcggcggaggttgcaccctgctccacctcctcggcaccgccgccgccatggcgttcctgctgccgcggtccgccggagctgccaacgacgccaaggtaatctccggcaccctctcctctccgcttctcggctgcctcttgtctcttggccaactgttctgctcgtgtcctacgctgcaaacaatttgaatttggcagtggcacgcccatgcccatccggtcgccggcgccgtcggccacggtgcccccgcgccccacgaacacgcggccggcctctcgccgctctcggcaccgccgcccaccgcgggagccgacgacgacttgctgccgccgccgagccgcgcgcccgtgcagaaggccgccccgcacttcggcttccctctgcagccgggcgacgcgtccgcggcggccccgtccggaagcgaggggtacccgtttatcggcagcaacccgacggtgccgctgcccaccggcatgaccgacacctccaccgtgctgccgctgccggacacggggaccggggacgccaccaccaaggcgcttttataattggtttgtgctttctttcctttcgctcgtcacgttattgctcatgctttcgcttcgctgcaggcggtggggttggcagcgtccgttcgtgctcccgtctcctccatgattgggcttggggttttcctcgccaccctgttcctgtgtgcaacatctaatcatataatacacttgtactagccttgagctcttggcatgaactaatctagagatctgctaccagttcctttcaactttcatcttccagtgaattcattgttctgccttggcgaacaaaaccagcaggccgcattatccctttcgactcccacaggccacagccacacacaacgttacaaatattaaaagaaaagaagaacgaacgatcgatcaggccggctcatcccatccattcttcagttacgagagcaaagtgaagggcatggcatgaaatacatacacgtctgtctggcatcactgcctacaaggatgcacagcttcctctacaggatggtacagcaagagttggttttcttcgcttgcttgtagaacatctgcatacaagttaagggatcgtcagcctcatgctgctgcctggactccacacactgctgctatcatttcctaggatagcaagttatccaggcaaacaatggaacagctataactgattctacaggtatggggatttcgttctgttttgcatcccaccttttttctttcctcgacacaaggaggtagaccaaaagatttggtcctatatatgctcaaacttgcaaggataagtttatcagtgacacactgacaccattttctttcttagacacaaggaggtatgtccaaattaggcatttatggcggaactgttaaccattttgccccagcccctcctgagtcgatctacgccgaaacatggtcccctttatcccatggggcatcggtcccaggtgcagagttttggctccagttacctggtccgtggtgttgatctggagcaggggcagacggatctcgtgtgttgtggcagctttggaagaacagcgacacatactgatgagaggggcaacacaccatgcccctctgctcaactcgttctgaataaacgggccccctcaagtgataatatcgacccaaacccagcgcaaatatggccccaaaaattgtagaaagaaaaatgggaacagtgcaaagcataacaaaaacacaagcgtgggtgatcaaaatcccaaactatggcatgttttggtggtattaatatttaaggctgcag

SEQ ID NO: 24910 - DNA, 966 bp, Zea mays
  misc_feature (11)..(11): n is a, c, g, or t
  misc_feature (16)..(17): n is a, c, g, or t
  misc_feature (24)..(24): n is a, c, g, or t
  misc_feature (28)..(30): n is a, c, g, or t
taatacgactncactnnatagggncgannnattgggtacctgccggccgggccgggaaagaaaatccggcgcggcccaacactagtagcgtagctgagagcctgagacgatggccgactactaccacggcggcagggccatgtactccaacactgacgagtgctatgacgccggcaggcacggcggcagcgtgagggcgtactcgcgcaccgacgagtactacgacaacgtggacgaccgcatgaggaggcccgcgtacggcgccgacgactgcggctacggcggcaggcagaccgccgtgtacgccgacgagtactcccgcggcggccgctacgaaggctacggcgtcgagcaggagcacttcaagagggaggagaaggagcataagcacaaggagcgcctcggcgaggtgggcgccctcgcgggcggcgcctttgctctgtacgaggggcaccgtgcgaagaaggacccggcgaacgcgcagaggcacaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtgtaagtaaataagagcaaacgtcgtcacgtgtgtgttgctcgatcactactccatcgatctacttattatcgtctgcaaataacgactaagcgcatgcttctgcagcgtgtaacgatccatcactgttactatatctaatgatatgcatgcatgcaattaagctatatatgtattcttctatgcggggttataatgtcaaaaattaaaaaaaaaaaaaaaaagcggcc

SEQ ID NO: 24911 - DNA, 750 bp, Zea mays
cattggtcattcgctcccactatccagactcacacagtccacactccccgcatctggcgacattgtgtgctcggcagtctcggactcggagtgagagcgagcaacaagaggaggaaatggagaagcgacacggcggcggaggttgcaccctgctccacctcctcggcaccgccgccgccatggcgttcctgctgccgcggtccgccggagctgccaacgacgccaagtggcacgcccatgcccatccggtcgccggcgccgtcggccacggtgcccccgcgccccacgaacacgcggccggcctctcgccgctctcggcaccgccgcccaccgcgggagccgacgacgacttgctgccgccgccgagccgcgcgcccgtgcagaaggccgccccgcacttcggcttccctctgcagccgggcgacgcgtccgcggcggccccgtccggaagcgaggggtacccgtttatcggcagcaacccgacggtgccgctgcccaccggcatgaccgacacctccaccgtgctgccgctgccggacacggggaccggggacgccaccaccaaggcggtggggttggcagcgtccgttcgtgctcccgtctcctccatgattgggcttggggttttcctcgccaccctgttcctgtgtgcaacatctaatcatataatacacttgtactagccttgagctcttggcatgaactaatctagagatctgctaccagttcctttcaaaaaaaaaaaaaaaa

SEQ ID NO: 24912 - DNA, 891 bp, Zea mays
gtccggtgcggcggccgggccggccgggaagtcaaatccggcccggcccaacactagtagcgtagctgagagcctgagacgatggccgactactaccacggcggcagggccatgtactccaacaccgacgagtgctacgacgccggcaggcacggcggcagcgtgagggcgtactcgcgcaccgacgagtactacgacaacgtggacgaccgcatgaggaggcccgcgtacggcgccgacgactgcggctacggcggcaggcagaccgccgtgtacgccgacgagtactcccgcggcggccgctacgaaggctacggcgtcgagcaggagcacttcaagagggaggagaaggagcataagcacaaggagcgcctcggcgaggtgggcgccctcgccggcggcgcctttgctctgtacgaggggcaccgtgcgaagaaggacccggcgaacgcgcagaggcacaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacggctactcctactactgcgactgaaacgactgatcaccccatcgataaccgagatgcatgcagaactcgatatatatacggcccctagcgccgtacacgtgcgtgcgtgtaagtaaataagagcaaacgtcgtcacgtgtgtgttgctcgatcactactccatcgatctacttattatcgtctgcaaataacgactaagcgcatgcttctgcagcgtgtaacgatccatcactgttactatatctaatgatgcatgcatgcaattaagctaaaaaaaaaaaaaaaaagccccta

SEQ ID NO: 24913 - DNA, 1256 bp, Zea mays
gcccatgaaattcgccgcgagcaaaatataaacccactcctgcccttcctccaactcctccgttccccgttccctcctctaccactggccccggcaccgcgggagcgccgaccgcctgctcgtctcgccgcagcccgtccctgagccggaaccctagcggccgccattgcccacgcgccgcgcgcccgatggacggcgggggctccgggccggcgcccaacgccgcgcacaccgcggaagaggtcttccgcgactacaaagcccgccgcgccggcatgatcaaggcactcaccaccgatgtggagaggttcttcaagctctgtgaccccgaaaaggagaacttgtgcctctatggctatcccgatgagacatgggaggttaccttgccagctgaggaagtgcccccagagatccctgaaccagcattaggaatcaactttgctagggatggcatgaatgagaaggactggctggcgctagttgcagtccacagtgattcctggttactatctgtcgcattctactttggtgcacggtttggatttgacagagaagctaggaggcggctctttagcctgataaacaacatgcccacgatatttgaggtggtgacgggagcagtcaagaagcagcaggcaaaggagaagacacctaacagtagcagcaagagcaacaagcctagttcaaaagtgcagtcaagagcagagtctcgatcgaaggctaaggtccccaaagacgaagaagagagcggtgacgatgacggggacgaggaggcggaggagcacgacaacaccctgtgtggaacctgcgggaccaacgacggcaaggaccagttctggatctgctgcgataactgcgagaagtggtaccacgggaagtgtgtcaagatcacgcccgctcgggccgagcatatcaagcagtacaagtgcccagactgcaccaacaagagggtcagggcgtgagcaaccgagactatccgatgcgaccttgctaggaaggaaaggaagaaacgacctccttggcgccaagatatggcgtgtagttccctagtctgtaagcctgcattttcatttatggttgttttatttgttgattagctgttcgacctagcattgtctaatgcgtggcatgtctcatgtgctgagtgttgacattggcatgggccccgccctctagtctgtaaacgttgtcactgaaggtacctctcggctgaccatttctccaaaaaaaaaaaaaaaggccggccgctcgcgttt

SEQ ID NO: 24914 - DNA, 1573 bp, Zea mays
tgggaccctcgaggccggccgggataagtttcaaacccactcctccccttcccctgttccctctaccaccaccaccggcaccgcgggacagtctgctctcgtcccgctgcagcccgtccccgacccggaaccctagcgactgccattgcccacgcgccgctcgcccgatgaacggcgggggctctgggctggcgcccaacgccgcgcacaccgcggacgaggtcttccgcgactacaaaggccgccgcgccggcatgatcaaggccctcaccactgatgtggagaggttcttcaaactctgtgaccctggtgagtgcgctcgatctctttggttcctcgccccaggatgtggagtgatagccgaggaggcttccgtggtttttctgcttgggcttcgttgcttcgaaaaggagaacttgtgcctttatggctatcccgatgagacgtgggaggtgaccttgccagctgaggaagttccccctgagatccctgaaccagcattaggaatcaactttgctagggatggcatgaatgagaaagactggctggcgctagttgcagtccacagtgattcctggttactgtctgttgcattctactttggtgcacgctttggatttgacagagaaactaggaggcgactctttagcctgataaacaacatgcccacgatatttgaggtagtgacaggagcagccaagaagcaggcgaaggagaagacacctaatagtagcagcaagagcaacaggcctagttcaaaagtgcagtcaagagcagagtctcgttcaaaggctaaggtcccccaagacgaagaagagagcggtgatgacgatgaggatgaggaggcagacgagcacaacaataccttgtgtggaacttgcggaactaacgacagcaaggaccagttctggatctgttgtgataactgcgagaagtggtaccatgggaagtgtgtcaagatcacgccagctcgagctgagcatatcaagcagtacaagtgcccagactgcaccaacaagcgggccagggcatgagcggcaaacatcggcatcgggcgacctttgataggaaggaagaaaccacctcctggcttcaagatccctagatatggcgtaggtccctagtttacgaagtctgcattttcatgtgttcattaatatatctgctgattagctgttcgacctagcagtgtctaaaacgtgccgtgtgtcttctgtgctgagtgttgacatggggcctcctccctccagcctgtaaacgctgtcactgaaggtacctctcaactgaccatccttcattgttggtgtcgtgcagtgagtagtggccgtactctttgttcccagttcctagcatttgaattgctcaaatgcgtaccttgctgagtaaggccgttggaaaatgacgaatagctgcatttccgtgggtctcaatgttccccaacagggcaccaccactgaaccattttttttccttgaggaatctccctgctaaccactaaggcccctttggaacataggaatttaataggaaccatttgagaatttcataagaatcagatcatttttacaggaaa

SEQ ID NO: 24915 - DNA, 1426 bp, Zea mays
ttgggtacctcgaggccggccgggaccgggtctcagaaggatggaagcatgatggagcacccacacccccgagaaaatcctcccccaaaacgcgacgaaattctccgcgagcaaaatataaagtttataaacccactcctccccttcccctgttccctctaccaccaccaccggcaccgcgggacagtctgctctcgtcccgccgcagcccgtccccgacccggaaccctagcgactgccattgcccacgcgccgctcgcccgatgaacggcgggggctctgggctggcgcccaacgccgcgcacaccgcggacgaggtcttccgcgactacaaaggccgccgcgccggcatgatcaaggccctcaccactgatgtggagaggttcttcaaactctgtgaccccgaaaaggagaacttgtgcctttatggctatcccgatgagacgtgggaggtgaccttgccagctgaggaagttccccctgagatccctgaaccagcattaggaatcaactttgctagggatggcatgaatgagaaagactggctggcgctagttgcagtccacagtgattcctggttactgtctgttgcattctactttggtgcacgctttggatttgacagagaaactaggaggcgactctttagcctgataaacaacatgcccacgatatttgaggtagtgacaggagcagccaagaagcaggcgaaggagaagacacctaatagtagcagcaagagcaacaggcctagttcaaaagtgtcaagagcagagtctcgttcaaaggctaaggtcccccaagacgaagaagagagcggtgatgacgatgaggatgaggaggcagacgagcacaacaataccttgtgtggaacttgcggaactaacgacagcaaggaccagttctggatctgttgtgataactgcgagaagtggtaccatgggaagtgtgtcaagatcacgccagctcgagctgagcatatcaagcagtacaagtgcccagactgcaccaacaagcgggccagggcatgagcggcaaacatcggcatcgggcgacctttgataggaaggaagaaaccacctcctggcttcaagatccctagatatggcgtaggtccctagtttacgaagtctgcattttcatgtgttcattaatatatctgctgattagctgttcgacctagcagtgtctaaaacgtgccgtgtgtcttctgtgctgagtgttgacatggggcctcctccctccagcctgtaaacgctgtcactgaaggtacctctcaactgaccatccttcattgttggtgtcgtgcagtgagtagtggccgtactctttgttcccagttcctagcatttgaattgctcaaatgcgtaccttgctgagtaaggccgttggaaaatgacgaatagctacaaaaagaaaaaaaaaa

SEQ ID NO: 24916 - DNA, 1282 bp, Zea mays
cggccgctcgagccggccgggccgccctcttctttgtctcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacactatcaagctcgacctggagaccaacaagattgttgacttcatcaagtttgacgtgggcaatgtggtcatggtgactggtgggcgcaacactgggcgtgttggtgtgatcaagaacagggagaagcataagggaaccttcgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagacctactccgtttttaagttttgttggatggctgttgatttgcgaactcggggttgttgcttaatgtactggggatgtttaccttattaagtgctatttcaaaaccccaaaaaaaaaaaaaaaaaaaggcccctaagggcccccaggggcccgcctacgggaaaacctcccccccaatccaggttttttggggggcgagggggcgaaaaaacgccataaatcgggaaccccccaaaaggggaacccccccctatttaaaacttttctcccgggaaaaaaccccccccccaaacacttggggaac

SEQ ID NO: 24917 - DNA, 662 bp, Zea mays
cgggccggccactagggtttatctcctctcgccgcagcctccaccgaagccaagagaggagcagggcgaaaggaggccgtcggagatgtcggagaagaagcgcgcccccggcccgcgcaaggacgaggtggtgacacgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagtggcatcaggagtgtcccgaggagagtccgtgtcaggattgcccgcaagaggaacgacgaggaggacgctaaggaggagctgtactctctggtcacagttgctgaagtcccccaggaaggtcttaaaggtttgggtaccaaggttgtggaggatgaggactaaaccccctgtctgtcgtatcgatcagttagaacttaatacatatctgctgagagcatattgggaagtcttgctttagcttattgttatctactgttcatgatgttccatgacttcttgatagaagatttgagacgttggatattttgttcaagtgcttgaagttttgacgtggtgctcctacgatcctcaagcgtccacggtacct

SEQ ID NO: 24918 - DNA, 718 bp, Zea mays
ggccgggccgggagacgcagccgcttcacttctcccaggtaaaggaaagattcgcccatggctccgtcgcagcccaagtcgggcctcttcgtgggcatcaacaagggccacgtcgtcaccaagcgcgagctgccgccgcgcccgtccgaccgcaaggggaaaggtaccaagagggtgcatttcgtcaggaacttgatccgggaggtcgctgggtttgctccgtatgagaagcgtatcactgagcttctcaaggttggcaaggacaagcgtgccctgaaggtggcgaagcgaaagttgggtacccacaagagggcgaagaagaagagagaggagatgtccagtgtcctcaggaagatgagatctgctggaactggaacagacaagaagaaatagagcatcccaggctcatgaagttgatggcaatcttctgttctggtgtccagtttttactgcatgtagaacctactagacctgaaactgttatccgccagctaaacattatgctatgttgaacctcctgtcttgtgagatttttgagctaacttgcaatgcatcgtttgccacccggtttctgagtttgcttctatgatctgtcagcttgattccaactgccattcttatgccagtggctttacaattggcgtatgtgtgcgtaatttctgtgatgtaggctccttgaatatgaattaatttatcaaacacgctgtgtttgtaggtg

SEQ ID NO: 24919 - DNA, 506 bp, Zea mays
aaactagcattttcattgaatccgccacttggtttttttttcagcggcgataaacaagacgaaggagagggatctatctacacaagtgaagcaacaatggtgaagttcttgaagcagaacaaggcagtgatcctcctccaaggccgatacgccgggaagaaggcggtgatcatccgttccttcgacgacggaaaccgcgagcgtccttacgggcactgcctcgtcgccgggctcaagaagtaccccagcaaggtcatccgcaaggactcggcgaagaagacggccaagaaatctagggttaagtgtttcatcaaggtcgtcaactaccagcatctgatgcctacgcgttacaccctcgacgtggatctcaaggaagtcgcgaccctcgaggctctggcttcaaaggacaagaaggtcgctgctctcaaggaggcgaaggctaagctcgaggaacgtttcaagaccgggaagaacagatggttctttaccaaactcaggttctgaag

SEQ ID NO: 24920 - DNA, 836 bp, Zea mays
  misc_feature (807)..(807): n is a, c, g, or t
aaaaccctagcaccagtcccgccgccgccgctgcccgccctgaccctcgccgctgctgcagcctccaccgcgcaaccatgggtatcgacctcgtcgccggcggccgcaacaagaggaccaagcgcacggcgcccaaatcggacgatgtgtacctcaagctgctcgtcaagctctaccgcttcctggtccggaggaccaagagccagttcaacgccgtgatcctgaagcgcctcttcatgagcaagaccaaccgccccccgctctcgatgcgccgcctcgtcaggttcatggaggggaaggaggacaagatcgctgtgatagtgggcaccatcaccgatgaccagagggtctacgagataccggcaatgaaggtggccgcgctcaggttcaccgagacggcgagggccaggattgtcaatgccggtggcgagtgccttacctttgaccagctcgcgctccgtgctccgcttggacagaacacgcttctcctgaggggtcccaagaacgccagggaggctgttaggcactttggcaaggctccaggagtgccacacagccacaccaagccatatgtccgctccaagggcaggaaattcgagaaggcaagaggaaggaggaacagcaggggcttcaaggtttaagccgtggagttttcggcacccttgtcacatttgctgttatcggtcaatcttcacttttttgggtaccagaatcatactgctttagatgtcagagtcttgtgtcgatgagtattcagaaccagttcattcttggttcagtattttgcaactccagaccatgcctgcnatccagttatgaatatcatttctagtatc

SEQ ID NO: 24921 - DNA, 434 bp, Zea mays
acaatctacggagatcgggttcgtccacacacttccgccgccgccgctgacgccgcgaaaaggagagcgaggccgactccgccgccgcgatgagggccaagtggaagaagaagaggatgaggaggctcaagaggaagcgccgaaagatgaggcagcgatccaagtaggcgccttggagcagcggaagcatcatcctacatccaggctgccaggcaccgagggaggacggcatggtctagtgattcctggcgtgtttgctgctatggctgtggaagctgtcttacctgtgttctgtccaatttagctgtttaatgctagtctggttttgttccaagactgagttttatgtaatgtgggattatatgtgtttgtgactgaattttatgcagctattaattttgcagtactcttgatatatgtaattctgccctgcg

SEQ ID NO: 24922 - DNA, 758 bp, Zea mays
gggcaaccctagccgccgccgccccctcccctcttcgtcctgcaagcagcgccgccgccttccaccggcccgagctccagccttcccttcaaccatggctgacgttgatgtcgaccccgaggtggcggccgccggccccaagaagaggacgttccgcaagttcagctaccgcggcgtggacctcgacgctctcctcgacatgtccagcgaggacctcgtcggcctcttccctgcccgcgcccgcagaaggttctcgaggggtctgaagaggaagccgatggcgctcgtcaagaagctgcgcaaggcgaaaagcgaagcccctgctggtgagaagcctgagcaagtgaggacccacctccgcaacatgattatcatgcctgagatgatcggaagcgtcgtgggcatctacaatggcaagtgcttcaaccaggtggagatcaagccggagatgattgggcactacctggcagagttctccctgtcgtacaagccggtgaagcacgggaggcctggtatcggtgccacccactcgtcgaggttcattcctctcaagtgagaatatggtcaggaaaattgtctgagatgtctggaatccagtgttcttatcctagtcaaatgtagcacctgatataccgtctgtcagtctagtggtggagcagctccctttgaaccttgaactaatccagttccagattttgaagttatcatgaggaggatcgaacatgtttctctcccttaagttgtcatctggggcccta

SEQ ID NO: 24923 - DNA, 784 bp, Zea mays
  misc_feature (757)..(757): n is a, c, g, or t
ggcccctcaatcgcgccgccgctcgagcccctctcgcccttcgcgccgctgctgctgcaggcaaccgccgccgccgtcgccggagctaaacccctcgcctgacgccatggggcgtatgcacagccgcgggaagggtatctcgtcgtcggcgctgccgtacaagaggactcccccgagctgggtcaagaccgccgtcgctgatgtcgacgagttgatcacgaaggctgcgaagaagggtcagatgccctcgcagatcggtgttctgctccgtgaccagcacggtatccccctcgtcaagagcgttaccggaagcaagatcctccgcatcctcaaggctcatggcctggcgccggaaatcccagaggatctgtactttttgattaagaaggctgtggccattaggaagcatcttgagaggaacaggaaggacaaggactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcaggatggtcttgttctacatattatcaatttcatgtaacgcttttgagtttggagcgatttagatgaacaagagaccaaattttctatgtttacttggagaatcccataaaccatttttggttttgcaattctgtctggttctgtttagcgtctatctancattcatcagttaaaattagacattgt

SEQ ID NO: 24924 - DNA, 693 bp, Zea mays
ccccctctattgccgccgccgccgctcccagctcgcgctccctcgcccagctgccgccgccgccgcctcgtcggagttcttcctacccctttcgccaacatgggtaagacacgtggtatgggagctgggcgcaagctcaagacccaccgcaggaaccagaggtgggctgacaaggcatacaagaagagccacttgggtaacgagtggaagaaacccttcgccgggtcatctcacgccaagggcattgttttggagaagatcggtattgaggccaagcagcctaactctgccatccgtaagtgtgctcgtgtgcagcttgtgaagaacggaaagaagattgctgccttcgttcccaatgatggttgcctgaacttcatcgaggagaatgacgaggtgctgattgctggattcggtcgtaaggggcatgccgtgggagatattcccggtgtccggttcaaggtcgtcaaggtgtctggtgtgtctctgcttgccctcttcaaagagaagaaggagaagcccaggtcttagattgccgttgcatggagtagacagtatgtcggcctttagatgttgaaggaggagggtggttcctttgtgtttacagcacttttaagttgataacttatgatcgtgttggtgaaaactatgcctttgtcacattttgctcctgttaagggaaagtgctactgttag

SEQ ID NO: 24925 - DNA, 836 bp, Zea mays
cggccgctcaggcggcggcccctatcatctccactccagccgccgccacacactccccacagccaatcctccccagcccaagctcgcagccatgcctcccaagctcgacccgtcccagatcgtggaggtgtatgtccgcgtcaccggcggggaggtcggcgctgcgtcgtccctggcccccaagatcggtccgctcggtctctccccaaagaagatcggagaagacatcgccaaggagacggccaaggactggaagggcctccgcgtcaccgtcaagctcaccgtccagaatcgccaggccaaggtgtccgtcgtcccctccgccgcagccctcgtcatcaaggcgctcaaggagcccgagagggaccgcaagaaggtcaagaacatcaagcacagcggcaacatcagcctcgacgacgtcatcgagatcgccaagatcatgaaggtccgctccatggccaaggagatggccggcaccgtcaaggagatcctcggcacctgcgtcagcgtcggctgcaccgtcgacggcaaggaccccaaggatctgcagacggagatcgacgacggcgaggtggagatccccgcttaagaaggcttggctttgggcaggttgttatgtgaggctgctgaagtagtttctcctatctagatgcttcctgatgcagttgagagaatggatgtgatatcttcacttgttctactcttgctgaagaagaaacttttgtcatgctttactggttccattgtgagactattttttactggtttaatgagtaccttgcggaatcaatcaatgttattatggcagctagatttccttatggttgagttttgtc

SEQ ID NO: 24926 - DNA, 1573 bp, Zea mays
tgggacccccgcggccgggccgaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctatttcagaaagcttttattggtctgactgctggtgcaattggtgcttgtgttggtagtcctgctgatctggcactcattagaatgcaagccgattcgaccctgccagttgcacaacgacgcaactataagaatgctttccatgcactctaccgtatcagtggtgatgagggagtccttgcgctttggaagggtgcaggtccaactgtggtgagagctatggcactcaatatgggtatgcttgcttcctatgaccagagtgtcgagctatttagggacaaatttggcgcaggagaaatttctactgttgttggagccagcgctgtttctggattctttgcctcagcatgcagtttgccctttgactatgtgaagacacagattcagaagatgcaacctgatgcgaatggcaagtacccatacacagggtctttggactgtgctgtgaagaccttcaagagcggtggcccattcaagttctacactggtttcccggtgtactgcgtcaggattgcaccccatgtcatgatgacctggatattcttgaatcagatccagaagtttgagaagaagatcggcatataggattcccatcggacggatacagggttgacagttctatgctattactgcttgactctgtaataacattccagctgctttcgcaccatggtagttggttttggtagagacaagtctgttacaattttttaccttagctttccaattattgtgttgcaataatcgaattaattgttgctgggggatttttttggggggttgggagggtggcatgcttttgttggctgggatgtagccataaggagagggggatactgcctagttatgtcattgaatggaattggaccatattttatacagatttttaccttcagttcttttaaacttattacatttgggactttttttttgtaatggaaacgatgggaattgatctactgtgagattatgttctcgcgcctgctcgagattgtacctgataaaaaaaaaaaaaaaaaaaaaaaactcgagggggggc

SEQ ID NO: 24927 - DNA, 1563 bp, Zea mays
cattgggtacctcgaggcccgccggcaacaaccatttcttcttcctttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgttttggtagtcctgctgatctggcactcattagaatgcaagccgactcgaccctgccagctgcacaacgacgcaactataagaatgctttccatgcactctaccgtatcagtgctgatgagggagtccttgcgctttggaagggtgcaggtccaactgtggtgagagctatggcactcaatatgggtatgcttgcttcctatgaccagagtgtcgagctatttagggacaaatttggcgcaggagaaatttctactgttgttggagccagcgctgtttctggattcttcgcctcagcatgcagtttgccctttgactatgtgaagacacagattcagaagatgcaacctgatgctaatggcaagtacccatacacagggtctttggactgtgctgtgaagaccttcaagagcggtggcccattcaagttctacactggtttcccggtgtactgcgtcaggattgcaccccatgtcatgatgacctggatattcttgaatcagatccagaagtttgagaagaagatcggcatataggattcccatcggacggatacagggttgaccgttctatgctattactgctggactctgtaataacattccagctgctttcgcaccatggtagttggttttggtagagacaagtctgttacaatttttttaccttagctttccaattattgtgtcgcaataatcgaattaattgttgctgggggattttttttggggggtgggtgggtggacatgcatttgttggctgggatgtagccatgaggagagggggatactacctagttatgccattgaatggaattggaccatattttatacagatttttaccttcagttcttttgaacttattgcatttgggacattgattttttttgtaatggaaacgatgggaattgatcaactgtgagattatgttctcggcctgctcgagattgtacctgataaaaaaaaaaaaaaaaaa

SEQ ID NO: 24928 - DNA, 1099 bp, Zea mays
ggccgctcgagccggcgggcgggctcttcgcccaaaccctacccctcgagcaaccgcgccgccgccgctccacccagcgttcgggttgctcgccgccggcgatctcgtgccgcgactccaccatgaagttgaacatcgcgaaccccaccacggggtgccagaagaaggtcgagatcgatgacgaccagaagctgcgcaacctttatgacaagagaatctcccaggaggtagttggtgatcttctgggtgaggaattcaagggttacatcttcaagatcatgggtggctgcgataagcagggtttcccgatgaagcaaggagtgctaacttctgggcgtgtccgccttctgcttcacaggggcacaccttgcttccgtggttttggcaggcgtaatggtgagcgcaggcggaaatccgtccgtggttgcattgtcagccaagacctatctgttatcaacttggtcattgtcaagaagggtgagaatgatctgccaggccttactgacactgagaagcccaggatgaggggacccaagagggcttccaagatcaagaagctcttcaaccttggcaaggacgatgatgtccgcagctatgtcaacacgtaccgcaggaccttccttaacagaagggcaagaaggtgagcaaggctcccaagatccagcgtcttgtgactcccttgaccctccagaggaagcgcgccagaatcgcagacaagaaagaagaggattgcccagaagaagtccgaggctgcggagtaccagaagctgcttgcacaaaggctgaaggagcagagggaccgccggagtgagagcatggccaagaggaggtcgaagctttctgctgccaccaaggctcctgctgcctctgctttagatggttacagtcctttgcactttgttggaaaaatctacccgctactttcagttttcttgggtttggtaattgtgcaatttttgcgtgaacatgggtactttatcattgtaagttttgttactggagtaacttttcttgggtttgtacctgatgcagttttacatgaacatgatgggtactctattgtcatgagttttgccaaaatttgtatggttattttttt

SEQ ID NO: 24929 - DNA, 1072 bp, Zea mays
  misc_feature (827)..(827): n is a, c, g, or t
cgggcgggacaatacaaaaactcttcgcccaaaccctacccctcgagcaaccgcgccgccgccgccgccgccgctccacccagcgcccgggttgctcgccgccggcgagctcgtgccgcgactccaccatgaagctgaacatcgcgaaccccaccacggggtgccagaagaaggtcgagatcgatgacgaccagaagctgcggaacctttatgacaagagaatctcccaggaggtagttggtgatcttctgggtgaggaattcaagggttacatcttcaagatcatgggtggctgtgataagcagggcttcccaatgaagcaaggagtgctaacttctgggcgtgtccgccttctgcttcacaggggcacaccttgcttccgtgggtttggcaggcgcaacggtgagcgcaggaggaagtccgtccgtggttgcattgtcagccaagacctgtctgttatcaacttggtgattgtcaagaagggtgagaatgatctgccaggcctgaccgacactgagaagcccaggatgaggggacccaagagggcttccaagatcaagaagctcttcaaccttggcaaggatgatgatgtccgcagctatgtcaacacataccgcaggaccttccttaacaagaagggcaagaaggtgagcaaggctcccaagatccagcgtctcgtgactcccttgaccctccagaggaagcgtgccagaattgcagacaagaagaagaggatcgcgaagaagaagtcagaggctgcagagtaccaaaagctgcttgcacagaggctcaaggagcagagagaccgccgcagcgagagcatgggnccaagaggaggtcgaagctgtctgctgccaccaaggctcctgctgcctctgcttaagatggttacagtccttcgcactttgttggaaaaatctaccgccaactttcagttttcttgggttggtaatggatgcagttttgcgtgaacatggggtcctttattgccagaagtttttttactggaagtaccttttttggggtttgtacttgatggcagtttacccctgaaaatggatgaggaactttt

SEQ ID NO: 24930 - DNA, 725 bp, Zea mays
cggccgggccgggccttccgcagccaccaccaccccaacccacaccggagcagacgaaggcggcgccgcggcgacctcatctccggccaagggaaatgactaccgttccggggtctctggtgtgggagctcgtgaagaaaaacaactgcttcttgatcaagcagttcggcaacagcaacgccaaggtgcagttcagcaaggagccaaacaacctctacaatgtccactcctacaagttctctggcttggcgaacagcaagaccgtggcggtccagccatcagcgggagaggacaaggctgtcgtcctgtccacgaccaagaccaagaagcagaacacccctgccaagctccagcacaagactctgatgcgcaaggagttccgcaagatggccaagtccgtcaagaaccaggtctgcgacaactactacaggcctgatctgaccaagccggcccttgcaaggctgagtgccgtgtaccgcagcctccaggtttccaagtctggaatcaagaagaagaacaggcagccaactaagctgtaaactcattgagattgcctttcagcgctcatgttaccatgtctgttccgacagctttgagtcataagtgagacccttggaggaaccatgttacaaacccgccctagtttgtaccctgacagtgttagaagaattgtttgtgtcgatctataattattgtttgatttgcactagggatcgctgcttgtc

SEQ ID NO: 24931 - DNA, 711 bp, Zea mays
  misc_feature (348)..(348): n is a, c, g, or t
  misc_feature (378)..(378): n is a, c, g, or t
  misc_feature (678)..(678): n is a, c, g, or t
ctcctgcagggttttatctcttctcgcgttgcccaccaccctagactcctcctcccctcacactccctcccatctccgccgccgccgccgcctgctcgcctcgcaagatggcggtgcctatcctgaagacggcgatcgtgaagaagcgggtgaagcacttcaagagggcgcacagcgaccgctacatcggcctcaagcaaagctggcgcaggccaaagggtatcgactcccgcgtcaggcggaagttcaagggatgcaccttgatgcccaacattggatatggttctaacaagaagaccaggcactacctgcccaacaagttcaagaagtttgtggtgcacaacgtcntctgagctggagctgcttatgatgcacaancaggacgtactgtgctgagatcgcgcacaacgtgtccacccagaagcgcaaggcgatagtggagcgtgccgcccagctcgacgtcgtggtcaccaacaagctcgccaggctccgcagccaggaggacgagtgaaatgtttcgaacagtagcgcttttggatcgttttgctccctgtagtagacttaatgccgaatctggagttttcttctctgttcgcctcgaggatccgacgctgttgaacatcttgctatcgatgctggtcatgttatcgtactataagcatggtcgactttgatgtngaagtgcggatcgcctttaattatcagctatgc

SEQ ID NO: 24932 - DNA, 754 bp, Zea mays
tatgctaagaagtttttgggtacctgggtcttgcaaaaaaaaaaaaaaaaaaactcctcagccgtcttcgcatcgcctcgcgcccgcaccccaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggcagacaaaaaaaaagatcaaggctgccgtgaaaaagatgtacgacatccaggccaagaaggttaacaccctgatcaggcctgatggcaagaagaaggcgtacgtgaagctgacaccagactatgatgctcttgacgtggccaacaagatcggcatcatataagtcagagggacggtcctgcagtaggcgcttgtgtcgtggtttcttatgttattggagttttgtagttgttacttagcaaaggggctcagtggctccattgcctaccatatcgccgcgcactttcatgaatttgatgcaatcgaagtgacttgtgttgatgccgt

SEQ ID NO: 24933 - DNA, 962 bp, Zea mays
cggccgctcgaggcggcgggcgggagtcacgacacctcccgtttcccgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaagcaggggtatgtggtctaccgtatccgtgtgagacgtggtggcaggaagcgcccagtgcccaagggtattgtttatggcaagcccaagcaccagggtattacccaactcaagttccagaggaacaagaggtctgttgctgaggaaagagctgggcgcaggcttggtggtcttcgtgtcctcaactcctactgggtgaatgaggactccacctacaagtactttgaggtcatccttgttgatgttgctcacagcgctgtccgcaacgatccaaggatcaactggctctgcaagcctgtgcacaagcaccgtgagctgcgtggtctcacctctgcaggaaagaaattccgtggtctgcgtggcaagggtcaccgccaccacaagaacaggccctcaaggagagccacctggaagaggaaccagaccgtctccctccgccgctaccgttaagcttacgtggtgttatgtcctgtggaacctgtcctatgctggagtcttttccaccgtcaaattttgctacctttctgtggctgaacgtccaggcatgcctgttggactatttgctatgggcctgtggtatgtggaatttgaatgatctaagtagtccttgatgtgtgctgattattgttttaatgctttgatgtttttgatgtccttttcttaagttatcggtgtgcatatattatggctccataagatgtcaaaatttgaagctt

SEQ ID NO: 24934 - DNA, 849 bp, Zea mays
cggccgggccggcacgctccccctccccgccgcctccgcactctgccgccgcagccgcagccgcagccgcagccatgggcgcgtacaagttcgtgtcggagctatggaggaggaagcagtcggacgtgatgaggttcgtgcagcgcgtgcgttgctgggagtacaggcagcagccggccatcgtgcgcatcaccaggcccacccgccccgacagggctcgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaggctgggtggtcttcgtgtgctcaactcctactgggtgaatgaggactctacctacaagtactttgaggtcatccttgttgatgttgctcacagtgctgtccgcaacgacccaaggatcaactggctctgcaagcccgtgcacaagcaccgtgagcttcgcggcctcacgtcggccggaaagaaattccgtggtctgcgtggcaagggccaccgccaccacaagaacaggccctcaaggagagccacctggaagcgcaaccagaccgtctccctccgccgctaccgttaagctgccctatgcacaccttgatagtattctgtttgagccatcaggttttgctaccttcgttcggagactccttgaagctcgtgctagaacctttatgtcgaggcatatctgttgaactatttgctatctgcctgtgttaccagaagaaagaatggtttag

SEQ ID NO: 24935 - DNA, 853 bp, Zea mays
gccgggccggcctcccaaccctagcgccggcgcctccacttctctgctccctcgtctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctaccgcaggctttgtgggaaagacgttgtctttgagtaccctgtgactgaaaccgcctgaagatccatgccttgaatgtctccattttcatatctttctgatccgaatgttttggtcgaggtctcagttagttgtgctatcaatgtattccagaaacatagttttgttaacgatctgggggttaggaagtttgatggagattggcaatgaacgtgaacaatgttaaagttttgagcatttaag

SEQ ID NO: 24936 - DNA, 796 bp, Zea mays
cgggccggaaaaccctagtcccccccacaccaaccacccttctcccgccgccgccccgcgaagcaaagcaggaggagcaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagaccgtcactcccattccctacgatgtggtcaatgatctcaagggtggttactagggtgtttgggttatctgcctgcacaaccagttcaaatctatggtgctcttatgagtaggatttgctctctgagcagtagtctgggttgggtctttattcatgtcaagaagatattcggtgtaggttgctatcatgagttttgcagaaatgctatactgtgctatttccttcagaatgatgatgtgctctgttgaactatatagttacattgcttgcctcc

SEQ ID NO: 24937 - DNA, 872 bp, Zea mays
ggcccggccggcctagcctccggatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttgggtgaaacaagtttgatccagatttgtgtgttttttacaccgaatgctcgaggtgctgctagtactttgttatctatctatctatctctattataataccctttggaattggaactgagtggtggctggaacttagattcccggtttgctcatccgcccctatctctatgaatgaaattggtttgggggc

SEQ ID NO: 24938 - DNA, 595 bp, Zea mays
agtttctccatcccctcgcagccgccgcctcctcggatcgtccctgccggagagacgccagagagcgccagcaaaccctaacctccgacgatggtgctccagaacgacatcgacctcctcaacccgccggcggagctcgagaagctcaagcacaagaagaagcgcctcgtccagtcccccaactccttcttcatggacgtcaagtgccagggctgcttcaacatcactactgtgttcagccactcccagactgtcgtggtgtgcccaggctgccaaacagtgctctgccagccaacgggtggcaaggccaggctaaccgagggttgctccttccgccgcaagggcgactaaacctccgaaggctatctgaaaaagccagccgttgttgaactttgagtttttccagggtgttagtctgaagattttgcaatgtctggcaaattgaacccatctttggtaatgtgatatctagcttgagtagtattatgatgaccactgtactatgttccgtttgggttgtgagatcagactagtagtacctgcctggcaatatggttgtctttgatgaattgttattccttctgatgttgcttac

SEQ ID NO: 24939 - DNA, 891 bp, Zea mays
cccaccccctaatcttgcccgtcccacaaaccgcctccgtcccctgcctgccaaccccaaattccgctctcgaatctttcccgagcatcgaccatgtcggcctactgcggaaagtacaaggatgagctcatccagaacgctgcctacattggcacccctggcaagggtatcctcgctgctgatgagtccacaggcaccatcggcaagcgcttcgccagcatcaatgttgagaacgttgaggacaaccgtcgtgccctccgtgagctcctcttctgcacccctggtgccctccagtacctcagcggtgtgatcctctttgaggagactctgtaccagagcaccaagggtggcaagccctttgtcgacatcctcaaggcgggcaatgtcctccccggcatcaaggtggacaagggtaccattgagctcgctggaaccaacggtgagaccaccacccagggctttgatgaccttggcaagcgctgcgccaagtactacgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtcgagcccgagatccttgttgatggacctcatgacattgaccgctgtgcttatgtcaccgaggtcgtccttgctgcctgctacaaggccctcaacgaccagcatgtcctcctcgagggcaccctcctgaagcccaacatggtcacccctggttccgactccaagaaggtggcccctgaggtgattgctgagtacactgtccgcaccctccagaggaccgtccctgctgccgtccccgccattgtcttcctctct

SEQ ID NO: 24940 - DNA, 860 bp, Zea mays
aacaaagccgccagcctccctcccctgcctgccagcccccaaatctcccctccctctgtcgctctcgaatcttccccgagcatcgaccatgtcggcctactgcggaaagtacaaggatgagctcatcaagaacgctgcctacattggcacccctggcaagggtatccttgctgccgacgagtccaccggcaccatcggcaagcgcttcgccagcatcaacgttgagaatgttgaggacaaccgtcgcgccctccgtgagctcctcttctgcacccctggagccctccagtacctcagcggcgtgatcctcttcgaggagaccctgtaccagagcaccaagggtggcaagcccttcgtcgacatcctcaaggagggcaacgtcctccctggcatcaaggtggacaagggtaccgtcgagctcgctggaaccaacggtgagaccactacccagggctttgatgaccttggcaagcgctgtgccaagtactatgaggctggtgcccgctttgccaagtggcgtgctgtcctcaagattggcctcaccgagccatcacagctttccatcgaccagaatgctcagggtctggctcgttatgccatcatctgccaggagaatgggctggtgcccattgttgagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgacgccaagaaggtagccccctgaggtgattgctgagtacccgtccgcaccctcagaggaccgtcctgctgcc

SEQ ID NO: 24941 - DNA, 1446 bp, Zea mays
aaaccctcgcgccgggccgggaacaaagccgcctccctccctccctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttcctggtgaggtgcaaggccaactccgaggccacccttggcacctacaagggcgacgccacccttggcgagggcgcctctgagagcctccacgtcaaggactacaagtactgatctatctgccttcggagctgtggcccgtttgggcgtcccgcttaccagtatcattgtttggttttctgagtcctgatatatccttggatatcgaacatcgtttttaataatatggaacttgtgttttcataataccgtagtagtttctttttggagttgaagtaccctggaaatcgggtgctgcgtatcgtatattggagcaggtttttgttccatggtcctgtaattttcctgctcatacaatgttcaaacctcatatgcg

SEQ ID NO: 24942 - DNA, 1040 bp, Zea mays
cgccgccgcgcggccgcgggccggaacaaagccttcagcctccctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggcaagcgctgcgccaagtactatgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtggagcctgagatccttgttgatggacctcatgacattgaccgctgtgcttacgtcaccgagatcgtccttgctgcctgctataaggccctcaacgaccagcatgtcctcctcgagggcactctcctgaagcccaacatggtcacccctggttctgactccaagaaggtggcccctgaggtgattgctgagtacaccgtccgcaccctcccagaggaccgtccctgctgccgtcccccgccattggcttccttctccggtgggacagaaacgaggaaggaagccgacccttgaacctgaaccgcccatgaaacaaccttccggacccaagaattccccggaaaccttgtcctttctcctttcgggtggggggcccttcc

SEQ ID NO: 24943 - DNA, 956 bp, Zea mays
gccgctccgagccggccgggcccgggaacaaagccgccagcctccgtcccctgcctgccaaccccaaatctcccctccctctgccgctctcgaaattccccgagcatcgaccatgtcggcctactgcggaaagtacaaggatgagctcatcaagaacgctgcctacattggcacccctggcaagggtatccttgctgccgacgagtccaccggcaccattggtaagcgctttgccagcatcaatgttgagaatgttgaggacaaccgtcgcgccctccgtgagctcctcttctgcacccctggagccctccagtacctcagcggtgtgatcctcttcgaggagaccttgtaccagagcaccaagggtggcaagcccttcgtcgacatcctcaaggagggcaacgtcctccctggcatcaaggtggacaagggtaccgtcgagctcgctggaaccaacggtgagaccaccacccagggctttgatgaccttggcaagcgctgcgccaagtactatgaggctggtgcccgctttgccaagtggcgtgccgtcctgaagattggccctaccgagccatcacagctttccatcaaccagaatgctcagggtctggctcgttatgccatcatctgccaggagaatggtctggtgcccattgtagagcctgagatccttgttgatggacctcatgacattgaccgctgtgcttatgtgaccgagatggtccttgctgcctgctacaaggctctcaacgaccagcatgtcctcccttgagggtaccctcctgaagcccaacatggttacccctggttccgatgccaagaaggtagcccctgaggtcattgctgagtacaccgtcgcaccctccagagacccgtccctgctgctgtccctgccattgtcttcctctccggtggacagagcgaggaggaggcgaccctgaacctgaacgccatga

SEQ ID NO: 24944 - DNA, 4724 bp, Zea mays
gggtaccctgcgcccggcgggacgcgaagcgaccagagggcgcccgtggcccgcgggccgcccccattccattccttccagttccagatcccataattgcacgcgacactacaccgcccccttccgcaagtcagagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagctttggtttctgctacatctgaatgctcaaatctgccgagaagatgctattacttacctaatccctctccataccaagtttggagtaggtcatttgcttcagacaacggagacaagtttgaggctgttgtgcccttcatgggtgaatctgtaactgatggaactcttgctaacttcttaaagaaacctggagacagagtcgaggctgatgaacctatagcgcagattgaaactgataaggtcactatagatgtcgcaagtcctgaggctggtgttattgaaaagctcattgctagtgaaggcgacacagttactccaggcactaaagttgcaatcatatccaagtctgctcaacctgctgaaacacatgttgctccatcagaggaagcaacttcaaaagaatcatctccaccaaaagttgaagataaaccaaaggtagaggaaaaagccccaaaagtagatcctcccaagatgcaagcaccaaagccaactgcaccatcaaaaacatccccttcagaaccacagctccctccaaaagaacgagagcggcgggtgccaatgccaaggctcaggaagcgtattgcaaaccgtcttaaggattctcagaacacctttgcaatgctgagtacatttaatgaagttgacatgaccaatttgatgaagcttcgttctgattataaagatgaatttgtcacaaagcatggtgtaaaattgggtcttatgtcttgctttgtcaaggctgctgtttctgcacttcaaaaccagccaattgtcaatgctgtcattgatggtgatgacatcatatacagagactacgtagacatcagtgttgctgttggcacttccaagggccttgtggttcctgttatccgagatgctgataccatgaactttgctgacattgagaaagggataaacaaccttgcaaagaaagcaactgagggggcgctctcaattgatgacatggcaggaggaacattcaccatctccaacggtggtgtctatggaagcctcctcagcacacctatcatcaaccctccacagtcgtctattctggggatgcattccattgtgcaacgccctgtggttgtgaatggtgacatccttgcgaggccaatgatgtaccttgcgctgacttacgaccacaggttgatcgatggcagagaggctgtcttcttcctgcggcgcatcaaggatgttgtcgaggaccccaggaggttgctgcttgacatataaattcatgcaccagcgctgcgctgccctgccggactgttttgtgcaattgtgcttatctggaaataatgccatggaaatttttgactgatgaaaaagaattacttcctcagaaagacgaaatctgagctgaggataccgaggtttttctctatataatcgtagaagagcaaactcaactcaacatgaggtcatgtttaattttcggatctgagatgttccattacgggatgcagttcccacaaacagtcattttatttaatatgcaagagcaatagagctgctgcatttttgtttgttggttcacaatttcgcctccagctggccagcctgcaactcgaggaatctggattgtataatgtgacgttggagcggtgctgcaatcgcacgctctgttgaatggtctcgactttaaactcgtccaacgtaaagtaggaggaaagggtataagtgtataacaaaggtaaaatggatgaatcgaatccggaggaaagggtctaggagtttggtatgggttacacttttttatttcccatatttttttggttttgggaatgaaatggattggagtaccgttatcttatttttataagctaacaatcagtaacagtaactagaaagaggtctattaccatagggattctataagcacaaaacattgcaaagatcttgttcaaatagaagatatgatcaaatttctaatagataaggtagaaatcctaacagataaaaatagattctaagatataaggtgaagagtctaacagataagtcatatcatagcggatgagaaatacacacgagtagataaccaacttggtatctatgatgtgactgccctactcctgactataaaaggaggtgtatgagacccctcagaggtagatcataggagatcatgtctcatcaagtaatatagcaccaccccatataggactaagatattatctcacatcgagagccagatagagtctgaacctagatagagtccaaacatatataaattttcatgtctcatgtgtctttaccttcaactttcaatctcgtgatctatcccataaatttaatgtctcgctagttggcacgccagctagaggacatcacagattaactttgagttgatggcaaccatgaagtctcgcattgggagacgagttcatccttggcaccttgcggttcgtcgtcgatacattagctagcttcgtcttcggcttggactcggatttgactcctaattggactagagtttgactcctacttggactaggattcgacccctactaggacttggatttgactctagtttcatctacgacttcgactctttcaactcctacttggactaagatttgactcctactatggactcaaattcgactccaacatcgttttctacttaaacttggagtcaactacaacttcgactcacattcgactcctactaggacctagatttgactctagtttcatctacgacgtggacttaggttctactccttagattaggatttgactcctacttgaactcggatttgactccaactttattttctacttggactccgataccatctcctacttggactcgtattcaagtacaacttcatcttctcctagacttggttccgactccaactttgaccccatcttcaactgactcatatttgaattcaactccatctatgacttggacttggatgcaactctagtctcaactacaacctggactcaaatttgaacctaattctacttttgttcgggttcagatttgtctgaactactagaggaccaaagtaactattaccccaaaggtgaaaagttcaaatacatattatagaggcattttcttgctttcaataatattgcaggatacaagacattactacttagtataaggataacttttacaattggcatttgatggatccgatttctcgaggattctatgttggcaatcaatcaaataaataaggagtggacatacaatcatgccaagacgatgacctattccactaggattttcctacaaatatcacgtggttgaaaacatcttggagaagaatggtatctatctccccatggactgagtcgtcctacgggttgggctctaagtttgtttaccctggtacttattgaatacaacttgaagatgacaatatcatgaacatataagttgcttttatgttttagtttccttttatattaaccttttcccctttcaacaccttgacaatcatgctacacccaagatgttggagggctactaatggctatgtgccaacacaaatcaatagataaagacttgatgatagaatcaagtcccatgccaactcctcaaagatatctaatttatggaacatcgaccaactgcactagttccatgttttaaagtttttctttatgattaagtctttctcaacacctcggtcgtcactacacccgagatgttgaggggctatcaatgattatacatcaatatttcatagaaagttataaaaaaggtgacgtgactatactgatttcttcttaaatttttctagaaggactagcaattgacttggaagcctaagactgtaaaaggtcataaatcacttgactgaaactctcttaggtgcctccctgtcaagacacattttggatccgtggctcaatgttgcaacatcacatgggctagtccgatttgtcataaatagttctagccatcccttacttctctcaccctagactcggatcgtcactctaagggtactaggtgttgcacacattgctctaactacttggacatagcactaggttagatttaagattcctccagaagggcaacaataccacctatacgactctgttgtcgcctaaaaattgaaaatccccacgcgagcatcaaagtactaagtctataaggctctaatcaacaatccctttagagaagtcggcaatatcacctacatggctctgctgtcatatacatataaaagtccctacacgagcaactaaagaccctatactggtaggtacatagaggtagagtccatgaggcacaattatatttcaaatgtctaggaccatgtctataggaatgaatcaactaaggtaattaactcatcgttcccacaaaaaggatatgttgtagtacaaaaaggtgctc

SEQ ID NO: 24945 - DNA, 1917 bp, Zea mays
gattagtgaaggaacgcagcaaaccgcggaccgcggccgcgccagagtagttggcccactggtgtgtggggtcaggaccaaaccggagaacgggaagcgaccagagggcggccgcggcacgcgggtcgtccccattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagacaagttcgaggctgttgtgcccttcatgggtgaatctgtaactgatggaactcttgctaacttcttaaagaagcctggagacagagtcgaggccgatgaacccatagcgcagattgaaactgataaggtcactatagatgtcgcaagtcctgaagctggtgttattgaaaagctcattgctagtgaaggcgacacagttactccaggcactaaagttgcaatcatatccaagtctgctcaacctgctgaaacacatgttgctccatctgaggaagcaacttcaaaagggtcttctccgccgaaagttgaagagaaatcaagggtagaggaaaaagccccgaaagtagaacctcccaagatgcaagcaccgaagccaactgcaccattaaaaacgtccccttcagaaccacaactccctccaaaagaacgggagcggcgggtgccgatgccaaggctcaggaagcgtattgcaaaccgtcttaaggattctcagaacacctttgcaatgctatctacatttaatgaagttgacatgaccaatttgatgaagcttcgttctgattataaagatgaatttgtcacaaagcatggtgtcaaattgggtcttatgtcttgctttgtcaaggctgctgtttctgcacttcaaaaccagccaattgttaatgctgtcattgatggcgatgacatcatatacagagactacgtagacgtcagtgttgctgttggcacttccaagggccttgtggtgcctgttatccgagatgctgataccatgaactttgctgacattgagaaagggataaacaaccttgcaaagaaggcaaatgagggggcgctctcgattgatgacatggcaggaggaacattcactatctccaatggtggtgtctatggaagcctcctcagcacacctatcatcaaccccccacagtcgtcaattctggggatgcattccattgtgcaacgccctgtggttgtgaatggtgacattctcgcaaggccaatgatgttccttgcgctgacatatgaccacaggctgatcgatggcagagaggctgtattcttcctccgtcgcatcaaggatgtcgttgaggaccccaggaggttgctgcttgacatataaagttacttaccagtgctttcccgccgactgttttgtgctttctggaaataataccatgcaaatttttgactgatgaaaaagaattgcttcctcggaaagacgaattctgagctgaggatacagtgaggtttttctctataatcgtagaagagagcagcaaactcaactcaatgtgaggtcatgtttcattttcgggtataagatgctccatttcgggatgcagttcccagtaattttatttgccatgcaagagcaatagaagctgctgcatttttgtttgttggttcaaaaaaaaaaaaaaaaaagcggcccctagggcc

SEQ ID NO: 24946 - DNA, 768 bp, Zea mays
  misc_feature (681)..(681): n is a, c, g, or t
  misc_feature (688)..(688): n is a, c, g, or t
  misc_feature (742)..(742): n is a, c, g, or t
ctctacgcgccgccacccaaaaccctaacctgcgccgccgcgctcacagcaaccaagcacaccgccgcagccaccatggcagccgttctcacccgcccgacgccgggcaccgtccagtgcttcggccggaagaagaccgccgtcgccgtggcctactgcaagcccgggcgcggcctcatcaaggtcaacggcgcgccgatcgagctcatccgccccgagatgctccgcctgaaggccttcgagccgatcctgctcgccggcaggtcccgcttcaaggacatcgacatgcgtatccgcgtccgcggcggagggaagacgagccagatctactccatccgccaggccatcgccaagtctctcgtcgcctactaccagaagtacgtcgacgaggcggccaagaaggaggtgaaggagatcttcggccgctacgaccggacgctcctcgtcgccgacccgcgccgttgcgaacccaaaaagtttggcggtcgcggtgcccgagcgcgtttccagaagtcgtaccgttgagctccggcgagatctcttgttgggtatgggcggcggtggcctactccttgcctgcctatctatctaccttttaccgctagtagtttgttttcttttggaccaatgaattggatatgatctcgaagaactgtgagttgtctgcagtatcctgcctangttgacngaagggggttttgctatcataatcttatgttaatgatgaaactgaatggtctgnttgagcttaactgtttgcgatttgac

SEQ ID NO: 24947 - DNA, 704 bp, Zea mays
cgggccgggctctctctccccccactctttgcccaagcccccctactgccggcggcggagacgacggaaacatggtgcagcgtctgacgtaccggaagaggcacagctatgccaccaagtccaaccagacgcgggtcgtcaagaccccaggtggtaagctcgtgtaccagtacaccaagaagagggcgagcggccccaagtgccctgtgaccgggaagaagatccaggggattccccacctcaggcctactgaatacaaaagatcaaggttgtctaggaaccgcaggactgtgaaccgtccctatggtggagtgctctctggaactgcagtgagggaaaggatcatccgcgctttcttggttgaggagcagaagatcgtgaagaaggtgttgaaaatacagaagaccaaggacaagacgacctcaaagtaatctgtttgaaacagaagtgcgaagtgcgatggtgttctgtaaacaaggaaaatatttttgttggtggttatgatcaatggtttagtcccttctagctaaatgttttagagtacttgaaatccttctgccgccgtgacatcagagattgtgaaacatttgatacccatttgcagtttcatttctgaatgcatgttgaatctacttatgtgaatttggtttcacatagcatttgtggttatctatctataacaatcattgggttactcccgctcc

SEQ ID NO: 24948 - DNA, 709 bp, Zea mays
cggccgggccgccccttgcgccgtcgccttcctgcttgccgctctcgctccgcagacgccgccgccgccgccgccacggccagagctcgactcgctccctaggaggtaaggatggtgagagtcagtgtgctgaacgatgctctcaagagcatgtacaacgctgagaagcgtgggaagaggcaggtcatgatcaggccttcttccaaggtcattatcaagttccttatcgtcatgcagaagcacggatacattggcgagtttgagtacgttgatgatcacaggtctggcaagatcgtggttgaattgaatggcaggctgaacaagtgtggtgtcatcagtcctcgctttgatgttggtgtcaaggagattgagggatggactgcaaggctccttccttctcgtcagtttggctacattgtgctgacaacttctgctgggatcatggaccatgaggaggcaaggcgtaagaatgttggtggcaaagtgctaggcttcttctactgaaaatggaaaatggaaaattggatgaaagtacctgagatgtgttagtaggatatttccaaggaacacctaagttgtcttttttttgtctgactagctgccgctgcttgttgagttattctggaatctgttatgcactttgggattgggtgcctttgtttgaaaactatgagctgtgcctgtcgttaattctgaaaattctatatgc

SEQ ID NO: 24949 - DNA, 1672 bp, Zea mays
ccccggaccctaccattctataacagtactatattcgtggattatgtatttttttgacgggtcttttgcgaaaggcgtatatagatttttatgctgatctagctaagccgcttattgaattcgcccagaacagttttcacatatcattcatcgttggttgctgtattttttatccaattaaaggcttgttcggttaattccgttacacatggattggatgggattggaaaaaattaagaaaaagtttgacttgcttgggatttaaacccacccaatctcactcaatccatatggattgagagataaccgaacaagctctaaacgcgcaagcacttctcttttaggagctatatatactacgtcgatagaatgtatatataggtcctcaaataaaccagccaattaaccaacagaaccatagctcattcacttacatatgtgctcaacaaatcataaagtgcaggtagttgctcccagaccgaatgaaaagaaaaggattacacacacttgacagttcacccaatcaatttttcacatgtatgcaggaatcataccattattgcctggtaggctcaagaagggttgaccaagatctccaggtcgagaatcgcgggggtgacggtcttccacagcacatagccgcgcgccatcctgaactgccccgtgccgccgaccactgagagctccctcaccgggacgctgacgtcgtcacggcccaccaccgtgagcgagctgccggcgtatgggcccgaagtaagaacgacattcatgttgacgaggagctcgaggttcgccaccgacgccaccatgtagtaaccctgcgcgcgtcccaccgtcgtggacgactctgacgtcccctcggttagcttgtcgtcgatcaccatggtgttgccgaagttgccccgcggcccgctaaccacttgcaccgccgttggggacgggccgcccgtcacgtcgtgcatgtaaaagtgcaggtgcgccgaagccgcctcgaccagtcgcatcgccgggccggcggcgaggaccacgagcaatgccagcaacaattctacggagagcttggagcgagccatgaggagagattgagagacgaacggggcggtcagtcagaatagtacatgcctatctagcagctggtaggtcgacggagatgcaatcaataagaaaacaaaatggtacagctgtgcctctctacctaccgaacgtggaagcaggcggcccggatcgatcctgaatgttttatcgattttaatatttaattttacgacatgcagcgacaagcatgcatgtttagttgtttacaacgtatacagctgggcaagggaataattcgtacgagaaaaattctaccatctcactaaagtccatacaagcctcttcaacaagcaaaggtcgcatcgatctgtttacactgattagaactggttgtcagagcatttcgaacagttttcaaatttatttgtcaaaatatgtagatttttcatatctataaaagtaattagaagtgattaaaaagtgtttctacaacagctttaagaaataactcataaaaaactaaaaaaatgcattcaaaagccgtgccctatgtctgtatcctttggtcgctggttcatgtctctatcctttggtcgctggttacgactacgggggcggcgccgtacagccaattata

SEQ ID NO: 24950 - DNA, 743 bp, Zea mays
ctccctaaaaccctagctccaccacccacctaaacccgcgaactcaccaaggcggcggcggcggcggcgacagcagcagcggcgatggggagcgacacggagacggagaagaagaagaccccggtggcgctggcgcccatcgccaagccgctcgccggcaagaagctctccaagaaaaccctcaagctcgttcgccgagcctcggaggccaagtgcctgaagcgcggggtcaaggaggtggtcaagagcatccgccgtgggagcaaagggttgtgtgtaattgccggaaacatctctcctatcgatgtgattacacatcttcccatactttgtgaggaagctaatgtcccatacatatatgtgacctcaaaagaggagcttgcgactgcggggacaaccaagaggcccacctgctgcgtgttggtgatgaccaagccagccaagggggagatcactgaagaggtgaaggagaaactggaatcagaatacaagcaggttgtaactgaagtcgctgaggttacatcttctatgttctgagaacatttccatagccgcgtggagaaccatgaacatctttctgtctattatgtagcatgattttgtcaccctatccttgctagtgatcgacgtgtttatcatggagctttaagcatctcgagtctggtactgcgctgttcggttggccattagataaacaaaatagtgcattgttaactaatatgggtgaggaaatcattatcgct

SEQ ID NO: 24951 - DNA, 745 bp, Zea mays
atcccctcgctctcgccgccgccgctgccttctctaccgcgccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagttcgttctggatcttctaaagaacgctgagagcaatgctgaggtgaaaggtcttgatgttgatgctctctacatttcacacatccaagtgaaccaggcccagaagcagcggcgccggacctaccgtgcccatggacgcatcaacccctacatgtccaacccatgccacattgagctgatcttgtcggagaaggaagagccggtgaagaaggaggctgagtcccagattgccaggaaggcctagagaaggaagctctacataacctatctgcctattcgttagagcagtttgtagcatctggtctggctgagtcgaaatttttggcctattatctgtcgtctaaatactgctagctcatactttgtgaaacctttgatgatcgtctcatgtactggattcaatctggttgtgttttgggaagaa

SEQ ID NO: 24952 - DNA, 4166 bp, Zea mays
ttttcttattttcattttcattttctatttcttttatctcctttcctcttgaacaattaattaactagataatcttaggtgctaaaaatataatctatgtgaggtgcttctaatcaatcaaagtgtatgcatatgatgagaagacctatggggtggagtttagggagagataaataggggggttaggggattagggttccaaacctcgggttgaaattttgggacgttacaatagaaccaccatgttttgatttattgatatattcatgtaaagtttgtgatgcggcaaaaagaaactcgtcatcgtcattagaagaggatgaatccatttcatgttccaaacttgtaataaagagcgtcgattcatcgtgttaaaaaatcaatacccacatggtcgtattaggttaaaaggggtgaataaccaaagtatccattgtataatgatatgatgactggtggctggataaaagggtgtgtggttgcgacataggaattgatcagcaatacacgagacgtgccaattgaataaaaaaaggcaataccaccatgatgaaggccatgtttggattacaaggactaattattagccactaaagtttagttcatttgtctccaaacaggccgactaatagagggactaagctttagctttcccttggactagcaattagtccattagtccacaaatatgagctaatcaagaccaaacacataaacaatctattagtccatagtatctaaactcctcgtgactaatagctaatgggataaacattagccggactaaactttagtctaactaaactttagctctaactctaacgaatccaaacagggccgaaaacggattaacatgggtctaagcctgatctaaacctagtttaaaatatttgtatccagacgtaatgttaaaatctactcctaataaattatgggatgataaaaaaacggatttttgggagtcattttttttgttggctcttggagattatatctaaaaataatggttgaagatccaattttgataaagtttcgtgcggcggcaattggggggcagcaacaaggagtgctgactgctggagtgctgctgcgtagaaactagaaccaacataagcaacattggtaggtgtgtccatcatggtaagcatgtactccactccaactaccagtattgatacttgcggctgaatagcatgcatcgccaatcgtcatgtgttccacgcggccatgccatgacatggtgccaatatgccgctgtcgccaaattcaattatataatataataatggccggccggcaccacgtcgcatccaattcaaatcatgcccggctgcacagccaactacggcgaaaattggttttaaagactaaaactattttcgtttttatattttctttaaaagtaaaataaaaaaacgataactccgaaaactaaaacgatatcgtgacaatagtcatgccactgactccggaaacaaatttacatgtgcaggcggcaggcctgatgatgcatacaggctgcaccgctgcagccacggccaggggatgacgagtgctagcttggcaattggcatatgcaacctacctaagcaatgtgctgccatatacgatataccttgtcgaattcatcccaaaactagtactgtacgtactacaagacacgcgattggccagtttgaggcaacaagggggaatccgtacgcctttttcatttcatataagtaagagcatcttgtggtctataaatatgttctataatttaaaaataagtatattttataaaacttagggtaccaacaaatcattccgatgcaacggtaaagtctcaaatctagtttgtcaccctttgtttttttgtgtcttttgtgtgtgtgatctataacttttttaaccaaattttataaaagtagtttttcctacttataacatcatatttcaatttaaacggcattgttggagatgttctaacatctcagctaaagcctaacatcatcagcttcagtgagtgagtgcgtaaaagtagcaaaagataccggccgtgcgcaagaccgaactaatcgccatggcgcctccgtccccacatgcgctcgtcatcccctacccggcgcagggccacgtgatacccctcctggagctcgcccacgcgctggtcgaccggggcttcaccgtcaccttcgccaactccgagttcaaccaccgccgcgtcgtggccgccgccatgccggagtcggagtcgccgacgctgctgggccggagggggatccggctggtggcggtgccggacggcatggggcccggggaggaccggaacgacatcgtcaggctgaccctgctcacggcggagcacatggcgcctcgggtggaggacctcatcaggcgcagccgcgacggcgacggcggcgcggagggcgggcccatcacctgcgtcgtggcggactacaacgtcggggcgtgggcgctcgacgtggcgcggaggaccggcgtcaggtccgccgccatctggccggcttcggccgccgtgctggcgagccttctcagcatcgacaagctgatccaggacaagatcatcgacccacaagatggtacgcatataataaatatattaaaatatatagtttatataaatacatatatatgctaactatatatataaataagtaataaagtaataaatagtatgcatctgcaaatgataacgcagggtctgcactgagccaaggcacgttccagctgtccccggacatgcccgtgatgcagacgtctcacctcgcgtggaactgcataggctgcccccgcgggcgggcgccgcggcgcccgcgccgccgcgccggcgtccgcgcggtggaagagtgcgacttcatcctctgcaactctttccacgacgccgagccggcgaccttcgcgcggttcccgcggatcgtcccagtcggccctctcctcacgggcgagcgccgtcgccgtggcagtggtggcaagcaggcggcagcggtggtggggcatttctggcggcccgaggacggcgcgtgcatggcctggctcaacgcgcaggcggcgaggtccgtcgtgtacgtggccttcggcagccacaccatgttcgacgcgcgccagttccgggagctggcactggggctggagctctctggtcggccgttcctgtgggtcgtgcgccctgacatcgtcctcggcggcggcggcatccacggctaccccgacggcttcctcgaccgcgtcagcgcgactggccgcggcatggtggtggcgtggtcgccgcagcagcgggtgttggcgcaccctgcggtcgcgtgcttcgtctcgcactgcggctggaactcgaccatggagggcgtccgcaacggggtgcccttcctcgcctggccctacttcaccgaccagttcgtcaaccaggcgtacatctgcgacgtctggaaggtcgggctcccggccgaggccgatgagtcgggcgtcgtcaccaaggagcacatcgccagtagggtggaggagttgatgggtgacgccggcatgagggagagggtggaggacatgaaaagggctgcgcgtgggagcgtcacccgtgggggctcgtcgcaccgcaacttcgacatgtttgttcaggcaatgaaaaggcgtgaatcaatagattcacagaataattaatgtatgtgttttatatatgtatatagattcgttgttatttatataaatataaaaataaaaatttaaaactaatacgattattattttgaaacgaagggagtatgtgtttacggtagtttctttatttctaaatgttggttagttttgactattatattaggttgtcttcaataactatactatcgtattacatattttaaacttttctctataaacagtgtaatttatcgtgcaaaatcctctaaagaatgggatgagatagctgttgaagctaagagcaactctaagaggctcactatattctttataatatatatatatatatatatatatatatatatatatagtgtttttttaaaaaaagcaccatccaataacttatttaaatggctatctaaatatagtcatcttctatttcgagcttctcactatccaaatatagaaaacatgaataactctttagagtgcaaacaaaattcaaaaaggttgttaaaaatcaaaagatatgaaaa

SEQ ID NO: 24953 - DNA, 1954 bp, Zea mays
agttctcctaaaagtatatccaagggactataagagggttttagaaaacatgaagttgcaaaagggtgttgctaatcatgcaaaggagcctaagatggcaaatggaatatctgtgacgactaagaaagtacaacttgatcagtcagcaagccggccaacacgtgttgccaatgccaaaaagtaccgaggttttattacatatgagcgagagagtatttcttacagagatccaaaagagcgtgttaaagattggaaggaagttgcaatcgaatcaacacctggcccactattaaatacacaatctgctcgttgcatggactgtggtactcctttctgtcatcaggaaagctcaggtgctggctgtcctcttggaaataagatcccagaattcaatgaattagttcaccagaacagatggcgcgaagcattggatcgactacttgagacaaacaacttccctgaatttactggacgtgtatgccctgctccttgtgaggggtcatgtgttcttgggattattgagaatccggtgtctatcaaaagtatagaatgtgcaatcatagacaaaggtttcgaagagggatggatggttccacgacctccacttcaaagaacaggaaggaaggtggccattgttggcagtggaccagctggtttggctgctgcggatcaactaatcaaaatggggcattttgtaactgtgttcgaacgtgcagaccgaattggaggtttaatgatgtacggcgttccaaacatgaagactgacaagattggcattgtccagcgccgtgttaacctattggctgccgcggggcccgccggggtggtgattgccaatgttggtagtgatcctctgtactcaattgaacgtctacgttctgagaatgatgcagttattttggcttgcggagcaacaaaaccaagagatctcaccatccctggacgcgagctatctggagttcattttgcaatggaatttctccatgcaaataccaaaagtttactcgacagcaacctggaggatggtaaatatatatccgcccgcgggaaaaaggtggtggttattggtggaggtgatacaggaacagattgcattggcacatctattaggcatggttgcaccagccttgtaaatcttgaactcctgacaaaaccaccaagcaatagagctgctgataacccatggccccagtggccaagaattttccgtgttgactatgggcatcaagaagctgctaccaagtttggaaaggatccaagaacctgtgaagtcttgacaaagcgttttattggcgatgaaaatggcaaggtgaaggctcttgagttagtgcgtgtgaagtgggagaaagtagatggaagatttcaactcaaggagatccaaggatcagaagagattattgaagctgatctcgtcctcctagctatgggattcttgggtcctgaagcgtctatcgctgagaaactgggtttggagaaggacaacagatcaaacttcaaagcgcagtttggagacttcgctaccagtgttgatggtgtgttcgcagccggggactgcaggcgtggacaatcactggtggtatgggccatcacggaggggcggcaggctgctgcagcggtagacaagtacatatcaaggcatgatcagaatgtcgcaggcgacatcactccctttggggcagggctcgttcagccggttggagcataaaaaaaacatagaccgaggcatgttttaggttctcgtcagtggttcctcacagcaaattttgttcttgtatattttgacgatagataaccagttgaaagttttggtgtctattgtttctttttcttctccggttattatgttttgcgtgtctgcatgtggttttctagtccaaaatgtacagttttccttttattaaatagatgtaaatttggtgggtgatatggcgatcattttgtgtgtatatgaaag

SEQ ID NO: 24954 - DNA, 2257 bp, Zea mays
aattcggcacgagggagatgtacaagaaggctaaagaagcttgaaaattggcatagctaccttgactttatcgagaaggaagaagacattaataaggtatgcttttacacttctaggaaccccttgtcctttttatttagtagtttttatggaacacttggaattttataacttacaatccagtcttattggctcaactatatcctttaacggctagtatttggacgaagcttcctttgtaatgggatgttgaactgaggatagagcgtggacataatgtttggtttcgatgaggctaagtactccaaactttcatttggcagtggtcgttctgggttcatgatatatggtaccaaataccagttttgaatttttaatctcatatgcaggtatttgcttaatgctcaccttcttaaccatctatctatcgagcaggatggtccctcctttcctttggaggggcctccataatcagctaatggagtaatctgttatcaaattgtatgaaaggtgtgtgattgcatgtgctagttattcagaattctggatccgctatgtgcaatgtatggaggatagggagtctagacctagcaaacaatgccctggctcgtgctactcatgtgtttgtcaagaagcagccggagatccatctgtttagtgctcgctttaaggagcttaatggggatatttctggagcacgtgcagagtatcagcatctttactcagatttatgtcctggctttctagaggccatcgtgaagcattctaatatggaacaccgactgggagataaagaattatcttgttcagtttatgaaaaggccatcgctgctgagaagggaaaggaacagagccagctcttgccgacgttgcttattcagtactcccgtttcttatttttggccatccgagatttggagaaggcaagagaaatattaactgtgctgcatgagcagttaaatgtaacaaaaacagtgcttgaggctgtcattcatctagagtcaatttttccatgcgaaaagcgtattgattttttagactcacttgtggagaagtttgttacacctgaatcatctcagggagaggtggcaagtctagttgacaaagaggaaatatcttccatatttttagagtttttggatctctttggggatgcaaagtcaatcaagaaggctttaactcggcatacaactcttttttcatgtaagagaagcattctgccatcaaagaaacggaaagcagatgacgctgttgtctcagacagggacaaatttgctaaaactgtggttactcagtcagccacgggaactgatccaaatgcttccaatcctcctgtttggcctgcaacttctgaagcatctgggcaacaatggggagcttcttatgcacagcaggctgcatatcctgcatatggaacttacgactacagccatcaaatgccccagcctgctcctcaagcagctgcctatggtgcttatcctccaacatactctgcacaggcttatacacaacaaagctacccacagcctgcagcaattccagcagcaccagtaccagcacctacagcgccgtcagcttatcctcaacaacctgcggcagctcaaccttattatggcacaacctactactgataagtagagtagtcgtggatggtgatccgatgagcctgttaatctaccttttcgcatgtgtgtggttcctctgtactgccattgtttagctcgcctttagacgaatgctagcgacgagatgatcacttgagaacaaatatgagatttgtacaatcagcatttttgtcgctaggagttgccattgttttcatgcaatagcataatctactgtagacgaggtagcgttgttaaccatgaatatgaacataatcgacataattcagtgttcatgcctccttccgtactgtaaaaaaaaacaaccagtggtgatggcgggattcctgtcaagcacgctcactggtggagccctccgaacaaattgtcagctaatggctcacgatctgcgactacgcagttgactaatttatactgtgtcaatgctcaacagatcagctcctagagttactctccggtaagacagccagatgatgatgtccgctggttggtagttgaaaatttatgtatttttgcttgtgctatacgagatgaaatttagcgagggcaattataatgacccaaataagccttgttcacgggtatctgagcaattcttgttgcttttgcaaactcatgaattgtctagttcg

SEQ ID NO: 24955 - DNA, 5077 bp, Zea mays
tgcttgcacgagatgcacttcgtcttcatgagttagctttcccatcaagaacccctccagctggcagtgcagatgcaaaggcccttcccaacccaggggattaccactggaggaaaaatggtgaagttcatctcaacgacccacttgcaatgggaaaactacaagaagcagctagagtcaacagccgggcagcatacaaggaatattcgaaacgaattcaggagctcaacaaggcgtgcaatttacgtggcatgctgaaatttaaagatatttctgacaagatatctttggatgatgttgaacctgcaagtgagatagtgaaacgcttttgtactggagcaatgagttatggttctatttcattagaagcacatactgcccttgctattgccatgaacaaacttggaggaaaatctaatacaggtatggttctcatccatacgtgatatttctctgttatagatgtggaggaattattgttcttttggcacattagctccatgaaaaaccatctgaacaaatgtaggatgtatggaccattttctagtttttgtaagggtgatgtgctgttcttttcctgaaacatgaactcctgctgcctacgttttattatgtgagcctgtcctctgcactaacattttagacaatcacgttttattatgtgagcattgcttctgaaaacatatcatactgttttgtttgttatagtttattgcaagatatttttttgcttttataatttttaaacgctagtgctaactgatgaggacatctgctataaatttctttggtttaatagaagtggttaaatactgctgtatgcattgttcctttttgattataaaccccttcaacttgttcctatattgtagttcaggaacatgagcagacagtgtgttttctagatcttaatattaaatatacttattcccaagtctaagatttatgtgaccaaatacacttgctttaatatatctgtgaaggtgagggaggggaacagccctctcggatggaaccacttcctgatggctcaatgaacccaagacgaagtgcgattaagcaagttgctagtggacggtttggagtttccagctattacctgactaatgcagatgagctgcagataaaaatggcccaggtactttgtcaacattgtgcactatgcagccgttaacatgaattgcatctttttgaaagaacatgggtcttccatatttcattttggatttactgttttttaccttaaatttctatagggtgccaagcctggtgaaggtggtgagcttccaggccacaaggttattggtgacattgctgtcacaagacattccacagctggtgtaggactgatcagtccacctccgcatcatgatatttattcgattgaggatcttgcacagcttatacatgatcttaaggtatgaattgtaaatagagtaatgctgctttctatacccacaagatccatggctcattgattgttgctgttggctcaatttaattttttacactcgtcttaacaacctctgaaggcctctcttattgatcttaatattcgcggatcacttgctgtgaggcaactcttgctactttttactggtgaacttgcatgtatgtttgcgaatctccaacttgcaaatgctgttcagtgataatgatattcttgcctgtgcagaattcaaatcctggagcccgtatcagtgtcaaactagtttctgaggctggtgtgggagttgttgctagtggtgttgtaaaaggacatgcagaccatgttcttatatctggccatgatggtggcacgggagcttcaagatggacaggtatcaagaacgctggacttccatgggaacttgggttggctgagacacatcaaactctagtagcaaatgggcttcgtggtcgagctgttctgcaaacagatggacagttgaagactggtagagatgttgctgttgcttgcttgcttggtgcagaggaatttggttttagcactgcaccactgatcacactcggttgtattatgatgcgaaaatgccacatgaacacttgtcctgttggtatagctactcaagacccagtgcttcgagaaaagtttgctggagaaccagagcatgtcattaacttttttttcatgcttgctgaggagctaagagaaatcatggcaaaccttgggttccgcaccattactgaaatggttggacgttctgatatgcttgaggttgatccagaagtagtgaagactaatgagaaacttgagaacattgatctctcactaatcttgaaaccagcttcagagattcgtccaggtgttgctcagtactgtgttgagaagcaagaccatggcctagacatggcattagataacaaactaatagatctgtcaagaactgctattgaaaagcaagttcgtgttttcatcgagactccaattcagaacacgaaccgagcagttggaactatgctcagtcatgaagtcacaaaacgttatcacatcaatggattgcctgctggtacaattcatgtgaagtttactggaagtgctggtcaaagctttggcgcttttctttgtcctggagtcactcttgaactggaaggagacagcaatgattatcttggtaagggattatctggtgggaaaattgttgtgtacccaccaaggaacagttcttttagtccagaggacaatattgtcattggtaatgtggctctgtatggtgctaccatgggagaggcatatttcaatggtatggcagcagaaagattttgtgttcgcaactcaggtgctcaagcagtggttgaaggaattggagatcacgggtgtgagtacatgactggaggcactgttgttatcctcggaaaaacagggcggaactttgctgctggcatgagtggaggcattgcctatgtttatgatgttgatgggaaattcagtgctcgctgcaacaatgagttagttgatctatatcatgtggaggaagaggatgacatcatcacattgaaaatgatgattgagcaacatcgtcgcaacactgagagtgttttggctagagatatactctccgattttgataaccttcttccaaaatttgtaaaagtatatccaagggactataagagggttctagaaagcatgaaggtggaaaaggctgttgctaagcatgcaaaggagcctaagatggcaaatggaatttctgtgacaactaagaaagtacaacctgatcagtcagcaagccgaccaacacatgttgccaatgccaaaaagtacaggggctttattacatatgagcgagagagtatttcatacagagatccaaaagagcgtgttagagattggaaggaagttgcaatcgaatctacacctggtccactattaaatacacaatctgctcgttgcatggactgtggcactcctttctgtcatcaggaaagctcaggtgctggttgtcctcttggaaataagatcccagaattcaatgaattagttcaccagaacagatggcgcgaagcattggatcgactacttgagacaaacaacttccctgaattcactggacgagtttgccctgctccttgtgaggggtcatgtgttcttgggattattgagaatccggtgtctatcaaaagtatagaatgtgcaatcatagacaaaggttttgaagagggatggatgattccacgacctccacttcaaagaacaggaaggaaggtggccattgttggcagtggaccatctggtttggctgctgcagatcaactaaataaaatgggccacttcgtaactgtgttcgaacgtgcagatcgaattggaggtttaatgatgtatggtgtgccaaacatgaagacagacaagattggcgttgtccagcgccgtgttaatttaatggctgaagagggtgtcacatttgtggtgaatgccaatgttggtagtgatcctttgtactcgattgaacgtctacgttctgaaaatgatgcggttattttggcttgtggagcaacaaaaccgagagatctcaccatccctggacgcgagctatctggagttcattttgcaatggaatttctccatgcaaatacgaaaagtttactcgacagcaacctggaggatggtaaatatatctccgcccgtgggaaaaaggtggtggttattggtggaggtgatacaggcacagattgcattggcacatctattaggcatggttgcaccagccttgtaaatcttgaactcctgtcaaaaccaccaagcactagagctgctgacaacccatggccccagtggccaagaattttccgtgttgactatgggcatcaagaagctgctaccaagtttgggaaggatccaagaacttacgaagtcttgacaaagcgttttattggcgatggaaatggcaaggtgaaggcccttgaggtagtgcgtgtgaagtgggagaaagtagatggaagatttcaactcaaggagatggaaggatcagaagagattattgaggctgatctcgtcctcctagctatgggattcttgggtcctgaagcgacaatagctgagaaattgggtttggagaaggacaacagatcaaacttcaaagcgcagtttggagacttcgctaccagtgtcgatggtgtgtttgccgccggggactgcagacgtggacaatcactggtggtttgggccatcacggagggacggcaggctgctgcagcggtagacaagtacttgtcaaggtatgatcagaatgctgctgctacaggcgacagcactccctccgggacagggctcgttcagccggttgcggcatagtagcataaactggagcaagttttacgtttgtcagtgtatcctgtgggttccacacagcaaacaccgttcttgtagttgtctaaaagaaacagagaaatccgggctcattaaggaatgaaagcccttctatattttttttgacgatagataaacagttgaaagttttggtggctattgtctctttttttcttctccatttagtatgttttgcatgtctgctgcatgtggttttgtagtccaaataatgtacagtttccccttaaatccatctaaatttgccgggtg

SEQ ID NO: 24956 - DNA, 3016 bp, Zea mays
ctcgaggccggccgggccgggatgcaaccctaaccacctcatcgccggcacgatcttccccgcccccactccccggctattgcctctgattggcggctctccgggattcacgttggtccggggtacggctcctgcgattgccgccccgtggaccaggaccagagcgtggttgtcggcagcgcggactctggtgctgcggcttttggttttgcgactggcaacccccctagcttggctgtgaccggcggaagcgccgtggcccccgacggtggagctcaggcagctgatgcctctgcgtaccaggccgagcacacggcgttgaatgggactgtcggcgatatgggtaattacccatctacaggagctgcagagaacggcgaagccgtccccaacgagacgggcgagccggttcctgagctatcgtacgaagaagccgtgctttcagcagaagaggctaggttatggagtgttgttaccgcgaattccttagattttaatgcctggaccgcacttattgaggaaacagagaaaaatgctgagaacaatattttgaagatacggaaagtgtatgattcgtttcttgcggaattccctctttgctttgggtattggaagaaatatgctgaccatgaagcgagacttgatggtgtgagtaaagttatagaggtgtatgaacgagcagttctcgcagttacttattcagtggacatttggtataactattgtcagtttgcaatttcaacatatgatgattcagatatcatacgaagactgtttgaacgtggcttggcatatgttggaacagattatcattccaatattttgtgggatgagtatattaagtatgaagagtcactggaggcttggagtcatctagctgttatatatacaagagtattggagcatcccatccagcagcttgatcggtattttaattgcctcaaggaattggcttcgaagcacagtttatcagaaatacttactgcagaagaagcctcgttgtatgttgtcacatctgagaccactgctcaagcgcctgatggtgaggcacatcctgatgatgttgataagcttggtcaaccagaaatttcgtcttcaacagacgcagaaagccttgcaaagtatgtctccatgagggaagagatgtacaggaaggctaaagagtatgaatctaagatcattggttttgagctagctattagaaggccatattttcatgtcaagcctcttgacaatccagagcttgaaaattggcataactaccttgactacatcgagaaggaagaagacattaataaggttataaaattgtatgaaaggtgtgtgattgcatgtgctagttattcagaattctggatccgctatgtgcaatgtatggaggataaaaggagtctagacctagcaaacaatgccctggctcgtgctactcatgtgtttgtcaagaagcagccggagatccatctgtttagtcccccccgtccggagcttaatggcgatatttttggagcacgtgcagaatatcagcatctgtattcagatttatgccctggctttctagaggccattgtgaagcattctaatatggaacaccgactgggagataaagaattgtcctgttcagtttatgaaaaggtcatcgctgctgagaagggaaaggaacagagccagctcttaccaacattgcttattcagtactcccgtttcttatttttggtcatcagagacttggagaaggcaagggagatattaactgtgctgcatgagcagttaaatttaacaaaaccagtgcttgaggctgtcatccatctagagtcgatttttccatgcgaaaagcgtattgaatttttagactcacttgtggagaagtttgttacacctgaatcatctcagggagagttggcaagtctagttgacaaagaagaaatatcttccatatttttagagtttttggatctctttggtgatgcaaagtcaatcaataaggcttcaactcggcatacaacttttttttcatgtaagagaagcattctgccatcaaagaaacggaaggctgatgatgctgttctgtcagacagggacaagtttgctaaaactgggtctgttcagtcagccacaggaactgatccaaatgcttccaatcctcctgtttggcctgcgacttctgaaacatctggacatcaatggggagcttcttatgctcagcaggctgcatatcctgcatatggaacttatgactacagccatcaaatgccacagcctgctcctcaaacagctgcctatggtgcttatcctccaacatactctgttcaggcctatacacaacaaagctacacacaacctgcagcaattccggcagcaccagtgccagcagtggtaccagcacctacaccggcgtcagcttaccctcagcaacctgcggcagctcctcaaccttattatggaacaacctactactgacaagtagagtaatcttcgatggcgatctgacgagcctgttaatcagcaggtttgtcgatacgaggtcaaaggcatcgcaaaaccctctgtactgccattgtttagccccccttcagacagatgccgtcgacgagatgatcgcttgagaacaaatttgagattggtatagtctgcatttttgtcgttagcatgtgtcgctagggattgctattgtttttcttgtaatagcataatctttactgtagaagaggcagcgggtgctaaccaatcctatgaacatataattaacattattcactgtttcatgccacctttcggagggctttttttttccccccactgatgatagcgggattcctgtcaagcacgctcactggtgaagtcctcggaacaaaattgtcaagatctgcgactacacagttcactgatttctactgtcactgtaggtcaaactatcttgatttgactaatttggaagggagattcggtaacttagtaacaatatatgaccaaatgactattttctgaaaatgcattttgtttagaatttatcaaattt

SEQ ID NO: 24957 - DNA, 1563 bp, Zea mays
atctggacatcaatggggagcttcttatgctcagcaggctgcatatcctgcatatggaacttatgactacagccatcaaatgccacagcctgctcctcaaacagctgcctatggtgcttatcctccaacatactctgttcaggcctatacaggaaggaaggtggccattgttggcagtggaccatctggtttggctgctgcagatcgactaaataaaatgggccacttcgtaactgtgttcgaacgtgcagatcgaattggaggtttaatgatgtatggtgtgccaaacatgaagacagacaagattggcgttgtccagcgccgtgttaatttaatggctgaagagggtgtcacatttgtggtgaatgccaatgttggtagtgatcctttgtactcgattgaacgtctacgttctgaaaatgatgcggttattttggcttgtggagcaacaaaaccgagagatctcaccatccctggacgcgagctatctggagttcattttgcaatggaatttctccatgcaaatacgaaaagtttactcgacagcaacctggaggatggtaaatatatctccgcccgtgggaaaaaggtggtggttattggtggaggtgatacaggcacagattgcattggcacatctattaggcatggttgcaccagccttgtaaatcttgaactcctgtcaaaaccaccaagcactagagctgctgacaacccatggccccagtggccaagaattttccgtgttgactatgggcatcaagaagctgctaccaagtttgggaaggatccaagaacttacgaagtcttgacaaagcgttttattggcgatggaaatggcaaggtgaaggcccttgaggtagtgcgtgtgaagtgggagaaagtagatggaagatttcaactcaaggagatggaaggatcagaagagattattgaggctgatctcgtcctcctagctatgggattcttgggtcctgaagcgacaatagctgagaaattgggtttggagaaggacaacagatcaaacttcaaagcgcagtttggagacttcgctaccagtgtcgatggtgtgtttgccgccggggactgcagacgtggacaatcactggtggtttgggccatcacggaggggcggcaggctgctgcagcggtagacaagtacttgtcaaggtatgatcagaatgctgctgctacaggcgacagcactccctccgggacagggctcgttcagccggttgcggcatagtagcataaactggagcaagttttacgtttgtcagtgtatcctgtggttccacacagcaaacaccgttcttgtagttgtctaaaagaaacagagaaatccgggctcattaaggaatgaaagcccttctatattttttttgacgatagataaacagttgaaagttttggtggctattgtctcttttttctgctgcatgtggttttgtagtccaaataatgtacagtttcccctttcttaaatagatgtaaatttgtcgtgtgataaaaaaaaaaaaaaaaaaaacacggggggcgccccgccccccgcttcgcctatag

SEQ ID NO: 24958 - DNA, 914 bp, Zea mays
  misc_feature (828)..(828): n is a, c, g, or t
  misc_feature (846)..(846): n is a, c, g, or t
ccttctccttttcttcccttcgctgctctgtcccgtgggtacctccgccccgcccccgctctttccagtgtcaactagtccacgctctaaagtctagtcctcgtcttcctcccgtaaaccacctcgtccctatccgcagcaaccgttcgccgcgccgcgaggcccgctgatcccaccgacctccaccgctatggctcctctgtcccgcgcggctcgcctccttcgatccgccgtcgggcggctgaggttgccgccgccggcccgggccttctccagcgccgcggcgaccgagacgggggcggggaacggacgcgaggccgtgatcgccgctgctgccgtggcgatggccgggtccgggcttgggctgtggctgaaaccgccgtcgcttgccgactccggcgaggcgcccggcggtcagatctcggtcacctgcgctgcttccacggaggcgcaggaggagaaggggaggttcctgttcgcagactcattccgcagaagagtattctttaactatgagaagaggatacggcttctcagccctcctgagaagatatttgagtacttcgcttctgtgaggaacccagaaggggaagtttacatgttgcctggggacttgatgagagcagtagtccctgtttttcctccatcagagtccaccatagttcgtgaaggaagattaagaggggagcggagccctggagagttgcattgtgctccatcggagttctttatgctgttagacactaatagtgacggtctcatctcctttgccgagtacatcttttttgtgacattgctcagcattcctgagtcacatttcactgcggncctcaaaatgtttgacgntgaccacagtggggtgatagacagagaagagtttaagaaaagtatgtcactgatgcggtcctttaaca

SEQ ID NO: 24959 - DNA, 861 bp, Zea mays
atggtggggtggttgagtacttctttgggagtgatgggaacgagcctctacactgtgtcaggttctcaaatttttgaaggagttgcatgacgagattattcgattggagtttagtcattatgatgtcaagtcgtctaaaactataccagcaaaggattttgcattgtccatggttgcttctgctgacatgaaccatatcaccaagctgcttgatagagctgatggtttggtcaaggagccagatctgaaggacatacgcatcacctttgaggagtttaaggcatttgctgacttgcgacaaagattggagccactgtcgatggctatctttgctcatgggaaagtgaatggattattgacaaaggaggatctaaaacgtgcaacacaacatgtttgtggtgtcaacttaactgatagagtggtagacatcattttccatgtgttcgacacaaatcaggatgggaacctgagctcggaagagttcttaagagcattagaaagaagagaaactgatattcgtcaaccaacaataccaggtccatggggttttttgtcttgctggttcagtggtaggaagtgttcacttaaacaggtggtgctctgatttggcccctacttgatcctcactgaatctgtcatccaccttcaattgtcatctcccgttgcaggaggtaatcacgaagcagtgcctagctgatcggtaaaacgactttgttgtacatgtcgtctccgtgtccgaagcttgcctagcagtagcagctgtaattgtaagtagtgtcagccctaggactgaaccttgtgttattctcatatgtaaatcaaaccccatacgatttaaatatatgatatctgttggcgttg

SEQ ID NO: 24960 - DNA, 2102 bp, Zea mays
cgattgggtacctcgaggccggccgggactacgggcgacgcgggaccctcgagcccggccggctctcccacgcactccgcaattccgcatcacgcagaggcagagcgaccaacccagaaccccaccccaccgcccgcaaccgcaagctcagattccctccccaccccaccccaccccaccgtcccgctcactccagcccagcccgcgtccccacagcccagcgacagcgggcaccggcggcatccagccatgtgcggcggcgccatcctgtcggacatcatcccgccgccgccaccgcggcgggtcacggctggccacctctggcccgagagcaagaagccgaggagggctgcatccggcaggaggggagcccccgtggagcagcatgagcaggaggaggatttcgaggccgacttcgaggagttcgaggtggagtccggcgagtcggagctcgagtccgaggacgagcccaagcccttcgccgcccccaggagcgcgctcgccagaggtggactaaacactggtgcagctggtgtcgatggccctgctgcaaattcagttaaaaggaagaggaagaaccagttcaggggtatccgccggcgcccgtggggcaaatgggctgctgagatcagagatcctcgcaagggcgtgcgcgtctggctcggtactttcaactcccccgaagaagctgccagagcttacgacgccgaggcacgcaggatccgcggcaagaaggctaaagtcaacttcccggatgaggttcctacggcggtttctcagaagcgccgtgctgctgggcctgcctctctgaaagcgcctaagatggacgttgaggaggagaagccgatcatcaagctcgcagtgaacaatatgaccaactcaaacgcatatcactaccctgccgtcgtcggccacaacatcatacccgagccattcatgcagactcagaacatgccattcgctcctctggtgaattatgctgccctagtgaacctgtcttcagaccaaggcagcaactcgttcggttgctcggacttcagcctcgagaacgactccaggacccctgacataacttcggtgcctgcgcccgttgccaccttggccgccgttggcgagtctgtgttcgtccagaacaccgccggccatgctgtggcgtctcctgcgacggggaacactggtgttgatctcgccgagttggagccgtatatgaatttcctgatggacggtggttcagacgactcgatcagcactctcttgagctgtgatggatcccaggacgtggtcagcaacatggacctttggagcttcgaggacatgcccatgtctgctggtttctactgaggctgaggcccagcgactggtgcttgtgtacatagggggggacaaagggtaagagcctgcagtaacagagattggctctttctggtacttgcaatttctatcccttcaactctttcttccgcccccgtgtttcaggaataatgttctggagatgaagaaacgcttgcgtgggcgtgcctgcaggcacgcgtgtagtagctgcggtattagtatatatgcttagatgttcagtcactttctttaagtacaatttggcgctggacatgtaccttattttactatgtatccgtgacaacagctatgtgtctgctccttttattttcttgtctttgcttcaaaaaaatggctctgaacattgcgagtttgtactttgtagacaatatatatatatatatatgtgtgtatgtgcttggtttgcgcgctccatcctcagcggcgcgctgtacatcgtcagtgccggcgccagcgacttcgtgcagaactactacataaacccgctgctgttcaagacgcagacggccgaccagttctccgaccgcctcgtggccatcttcggccgcaccgtgcaggagctctacggcatgggggcgcgccgcgtcggcgtcacgtcgctgccgccgctgggctgcctgccggcgtccatcacgctgttcgggcacggcgccgccgggtgcgtgtccaggctcaacagcgacgcgcagagcttcaaccggaagatgaacggcaccgtggacgcgctggcgcggcggtacccggacctc

SEQ ID NO: 24961 - DNA, 1889 bp, Zea mays
  misc_feature (22)..(22): n is a, c, g, or t
ttggggtacccctcgagggcancggcaccagggggcccccgaggccggccgggctctcccacgcactccgcaattccgcatcacgcaccccaccccaccgcccgcaaccgcaagctcagattccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgggtcacggcgggccacctctggcccgagagcaagaagccgaggagggctgcagccggcaggaggagagcccccgtggagcaggagcaggaggaggatttcgaggccgacttcgaggagttcgaggtggagtccggcgagtcggagctcgagtccgaggacgagcccaagcccaagcccttcgccgcccccagcagcgcgctcgccagaggtggactaaacactggtgcagctggtgtcgatggccctgctgcaaattcagttaaaaggaagaggaagaaccagttcaggggtatccgccggcgcccgtggggcaaatgggctgctgagatcagagatcctcgcaagggcgtgcgcgtctggctcggtacattcaactctcccgaagaagctgccagagcttacgacgccgaggcacgcaggatccgcggcaagaaggctaaagtcaacttcccggatgaggttcctacggcggtttctcagaagcgccgtgctgctgggcttgcctctctgaaagcgcctaagatggacgttgaggaggagaagccgatcatcaagccggcagtgaacaatatgaccaactcaaacgcatatcactaccctgccgtcgtcggccaccacaacatcatacccgagccattcatgcagactcagaacatgccattcgctcctctggtgaattatgctgccctcgtgaacctgtcttcagaccaaggcagcaactcgttcggttgctcggacttcagcctcgagaacgactccaggacccctgacataacttcggtgcctgcgcccgttgccaccttggccgccgttggagagtctgcgttcgtccagaacacggccggccatgctgtggcgcctcctgcgacggggaacactggtgttgatctcgctgagttggagccgtatatggatttcctgatggacggtggttcagacgactcgatcagcactctcttgagctgtgatggatcccaggacgtggtcagcaacatggacctttggagcttcgacgacatgcccatgtctgctggtttctactgaggctgaggcccagcgactggtgcttgactgcttgtgtacatagggggggacaaagggtaagagcctgcagtaacagagattggctctttctggtacttgcaatttctatcccttcaactctttcttccgcccccgtgtttcaggaataatgttctggagatgaagaatcgcttgcgtgggcgtgcctgcaggcacgcgtgtagtagctgcggtattagtatatatgcttagatgttcagtcactttctttaagtacaatttggcgctggacatgtaccttattttactatgtatccgtgacaacagctatgtgtctgctccttttattttcttgtctttgcttcaaaaaaatggctctgaacattgcgagtttgtactttgtagacaatatatatatatgtgtgtgtatgtgcttggtttgcttcaaaaaaaaaaaaaaaaagaaaagagtactgtatgcaggcttgcatgtgctgatatgcgtgcagcacacgtctatgaaaaagcattcatgcgaagtagatggataatagcaaacaaattttcttcataatggatgcataatccacttctttttgag

SEQ ID NO: 24962 - DNA, 1528 bp, Zea mays
ccgtggggggcccccggccggccgggcactacaccagggcacgacgtgcgttgcgtcgtgagtgtttgtgtttcagagctgagagtctgagactgagagagatagaggtgatgatggctctgcaggcgcaggggacgcgggtgccgctggtcctggcgctcttcctcctcctggccggttgcggcagcgaggcgcagccgctggtgccggcgctgtttacgttcggtgactcgtcggtggacgtcgggaacaacgactacctccacaccatcatcaaggccaacttcccgccatacggcagggacttcgccaaccacgtcgccaccgggaggttctgcaatggcaagctggcgaccgacatcaccgccgacacgctggggttcactacctaccctgccgcgtacctcagcccacaggcgtcggggcagaacctcctcatcggcgccaacttcgcgtccgcggggtctgggtactacgaccacacggcacttatgtatcacgcgatcccgctgtcccagcagctggagtacttcagggagtaccagacgaagctggcggcggtggccggcgccgggcaggcgcgctccatcctcagcggcgcgctgtacatcgtcagtgccggcgccagcgacttcgtgcagaactactacataaacccgctgctgttcaagacgcagacggccgaccagttctccgaccgcctcgtggccatcttcggccgcaccgtgcaggagctctacggcatgggggcgcgccgcgtcggcgtcacgtcgctgccgccgctgggctgcctgccggcgtccatcacgctgttcgggcacggcgccgccgggtgcgtgtccaggctcaacagcgacgcgcagagcttcaaccggaagatgaacggcaccgtggacgcgctggcgcggcggtacccggacctcaagatcgccgtcttcgacatctacacgccgctgtacgacctggccacggacccccagtcgcagggcttcgcggaggcccggcggggatgctgcgggacgggcacggtggagaccaccgtgctcctctgcaaccccaagtccgtcgggacgtgccccaacgccacgtcctacgtcttctgggacgccgtccacccgtccgaggcggccaaccaggtcatcgctgactcgctcatcaccgagggcctcatcctcgtcacgtaatcatgcttttgttttggcttcaaatcgatcagactacacaaaagtcgtcgttcctaaacgtatactatgcctgtaaatttattcctcttgtttttcttatttgcgttgattaatgttttcggaagtataagcaacaacatgaatgaatgaatgaatgaatgaatggactcctattgttgtcaagttcaaaaaaaaaaaaaaaaaaaaaagaggcccctcgcaacacacgtacaagaggcagattttactcaagtcaaatgtagaaaaagttcatcgactgatgttttggtatcatccgagaaaagtaagacaggtttgtcgtggtcatctcaccacaccgtatt

SEQ ID NO: 24963 - DNA, 1290 bp, Zea mays
  misc_feature (88)..(88): n is a, c, g, or t
gttctgggtctcaaaaaactcgagtgtgattttagaagatgaaatggtcctgaggcgaaggcattattcacgtggacccggagtccanacctgcagaaaatccacaagcgaaattggctgccagctttaattctgtgtctggaacttcgtcgcctgcctaaacagaaagaggcgtaaagaaaacgaaagcaaatttcgcaggtggaaagaagaggaagcgaacgagaggcaacggtggccggtcgcgggacgggtggggccacgcctggcctgacgcgggaagccggccggaaccatccaactccgccgcgtcgtcgtcgccttcgtctcgcgtgctcaccaagagaacaaaacgcgagcagccaagaattcaacgtccacggtccgcccaccctccgtttccgcttcctccctccacgtcgtctcggtcttcctctcctgtaatcccgtgacacgggtggctgcgacggcgaatcagatccctacccgtggcgttggtcgtgaattggcgccgtctccccctgccagccggattccctgctttgttctcaggcaacattttgttcactagtgtggtagctttgttgattggagtgcgcaatgggaggctgtgcgggaaaggtacgtcgtgatgacgaagaaaagcttgattttaaaggtggaaatgttcatattataacaagcaatgagggctgggaccagaagattgcagaagcaaacagagatgggaaaactgttgttgcaaatttcagcgcttcctggtgtgggccatgccgtgtcattgctcctgtctatgctgaaatgtcaaagacttatcctcaactcatgttcttgacaatagacgttgatgacctgatggacttcagctcttcatgggacatccgtgcaaccccgacattcttcttcctcaagaacgggcagcagatcgacaagctcgtgggcgcgaacaaacctgagctcgagaagaaagtgctagcagccgctgatgccagtacgtcctagtgacacaagtggaagtgggcaaacgatctgtgatggcttcccggtgtatagtttccatggttcatttgtgtgcttgtcccatgtttgcctggggacgatgacgttttacaattttggcccccatcgcgcgcactcgtctgtttctctcatggaagccgtgtgaacctgtgcgtgtgtgtgacgaatgaacggaactttatatggaccagtgcttaagagtctttgcaacataattatgaaggtttgtttgcatgctcttggtggaaaaaaaaaaaaaaaaaagcggcc

SEQ ID NO: 24964 - DNA, 1194 bp, Zea mays
agctccctttaatacctcaccctcctctcctcccttctctggactggccggatctcttccctgcagatcgagaggcactgccacaccaccatcaccccatgctcaacatgatgactgatctgagctgcgggccgtcgtccaaggtcaaggagcaggtggcggcggcgcgacgggctccggcgacaggcaggggcaggggagaggcaagatcgagatcaagcgcatcgagaacacgacgaaccggcaggtgaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgactcctccaactctggcacagttgcagaagtcaatgcccagtactaccagcaggagtcctccaagctgcgacagatgatccacagcttgcaaaacgcaaacactaggaacatagtgggagattccatccacaccatgggcctcagggatcttaaacaaatggagggcaagctggagaaagccataatcaagattagagctagaaagaatgagctgctatacgctgaagttgactatatgcaaaaaagggagatggatctgcagactgacaacatgtacctgaggagcaagatcgctgagagtaatgaaacggggcagccggcgatgcacatgacgatgggagcgccgccgacgagcgagtacgaccacatggcccctttcgactcgagaaactttctgcaagtgagcatgcctcagcactactcccatcagctgcaacctacaaccctccagctcggatgatgaaatcagcgctatacctggcggcgcccggcccccaatcgagatagatcacgcatgcagttatatcatgtgccaaatcgagatctcaagtaactctacgtacgtttgcttaattattaataattgtgattagtgcaactgttagggtatatatatttgtgagtgccaccactgtgtgcgtgcatttgtacgtgtgaatttagctgttgcatctactactattgtaccctccggccaggccatatcatcagaaacgcgggtttatataaagcacacaaatcatatatatataagtatgcgtaaatatagattgaaaa

SEQ ID NO: 24965 - DNA, 1231 bp, Zea mays
ctcacatcctctttcagttccctctctggatctcttcctgaagagaggcactactgccacaccaccacgccacccatgctcaacatgatgaccgatctgagctgcgggccgtcgtccaaggcggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccaccgatgaacatgattggattgccgtcgacgagcgagtacgatcacatggccccgtttgttgactcgagaaactttcttcaggtgaacatgcagcagcagcctcagcactactcccatctatcagctgcaaccaacgaccctccaactcggatgatgaaattaagaatcttcggccaacaatccatgcacgcaagcacgcagtaaatcatgtgtccaattcagataaaaaaatctactctagcgtttgtataattattaataatcgtgactagtaaactgttatatatatagccatgtgtgtgtggcgcctacatatatgtcatgtggctgtacggcgagtttttctttttcacaagcgtttgcagcagcatttggtgttgctcatcgatcaattaatcgcaagaaattaaacttgtcaccactgtgtgtgcattatttgtacgtgttaatgcagttgttgtatctgttaattgtaccctccatcagataaacgcgggtgcgcgtatgcatatttatgtgt

SEQ ID NO: 24966 - DNA, 946 bp, Zea mays
ggtcctggtccccgagcggcgcccttttttttttttttttttttttttatgtaccagtgcctccaaatcgttccgtgtaaaacttaaagaggggcccaaaaggaaaagaaaaaaaaataaaaacaaacgtacaaagagtcgaaggaccatcaggagcacggcgcggtggcggccaggctgagctcgcggcggcggccgaagacgacggcgcactcgggcagctcgccgagccccgcaaacagggcgtcctccccctgcagctcccgctcccactcctccggcggcagcagaggggcgtacagcgccgaccggtgccacgtcgggtactggtcgaaccacccaaagtcgaagctttcgtcctcctcggccgccggcgccaccgttaaggttgctgccgcttccggaccggccagacatgggacgccctcttccgccggctcgtgctcctcttctggctccgtctcctgctcctgctccggcacctctgtttctaccagctcgtgctccgggccgagctcatcccgctggaccaggaccacggacggctcaggcttcggcgccggcggccgcgcggacggcttgccttgctggtggcagcagctgccgccgctggtcttgggctgcggcgcctcgtgattgtgctcgaaggtgtaggtgacgagcagcgcggtggggtccgcgtggctgcgctccacctgcttcctcgctgggcaccccttggagctgctgcagcggtagtaaccccgtgggtagggggagcccttgatgggcttctgcccatacttgcgccacgcccacgagtccgacggcggcggcccctccccgctggcccctctgggccggtccccgcactcggccagcggcaccgacacaacccgcttctccaccgatctccggctgctcgcacagaaatagacaagagccgagttagccatcttcgtagctc

SEQ ID NO: 24967 - DNA, 935 bp, Zea mays
gcggacggcttgccttgctggtggcagcagctgccgccgctggtcttgggctgcggcgcctcgtgattgtgctcgaaggtgtaggtgacgagcagcgcggtggggtccgcgtggctgcgctccacctgcttcctcgctgggcaccccttggagctgctgcagcggtagtaaccccgtgggtagggggagcccttgatgggcttctgcccatacttgcgccacgcccacgagtccgacggcggcggcccctccccgctggcccctctgggccggtccccgcactcggccagcggcaccgacacaacccgcttctccaccgatctccggctgcgcttagctggcggcagcggcgacgacggcgaggcggggaggtcgcgctcgcgcttgttcagcccggccccggcgcgcggcgactccgcgtccgcccccgcctgcggctcgtcgggggattccgcccgcggcgaatccgagctgcagtacccgtcctcggccgacgacatcgatcagatccccccctctctcgccgctgctccctcggtgaccacgcccggccggagtacacggaggcggaggcggagcccacagccccggcccggacggataaaaaggcggaggcagcttcaaagcaaaacgagctcgcgctttcccaaagcgcgcataaattttttcgcactgatggtggagaaagcggggctgttggaacgaatgatggaggggattgaaggcgggcgagatggtggcgcacagggcacagatgatgggcgctctcttgtgtcgctcgcttgcgatgcgcggcgtgcctggccgctgtttatgcgggtgcgtgcgctagtgggcgccttttttatattttatgggaacgatgcttgtgtcatcgggggagcaccggggtgagcagggcgagcgatatccataccgacggcaggcggcctgca

SEQ ID NO: 24968 - DNA, 1962 bp, Zea mays
  misc_feature (1898)..(1899): n is a, c, g, or t
  misc_feature (1944)..(1945): n is a, c, g, or t
  misc_feature (1947)..(1947): n is a, c, g, or t
ccacgcgtccgcttaatatggtatttttggccttggaaacaggcagtacgaacactttaataaggttgcaaaggtggtagatgagctactagaggagcagggtgggaaacgtattgttcctgttggccttgggggtgcccccccgtgcattcggccggatgatttcactgcatggaaagaactagtgtggccagagttggatcaattgctccgcgacgaggatgacacaaatggtgcatcaactccatatactgctgctattcctgaatacagagttgttttcattgataaatctgacctgtcattccaagatagatcatggtcactagccaacggtactggtgtgattgatattcaccacccttgcagggctaatgttgctgttcgaaaggagctgcacaaaccagcttcagaccgctcttgtattcatcttgagtttgatatttctggcactagtcttgtgtatgaaaccggagaccatgttggtgtatatgcagaaaattctgttgagactgtggaggaggctgaaagcctacttgacctttctccagatacagtcttctccatccatgcagatgcagaagatgggtctcctcgtaaaggaggaagttccttggccccacctttcccatctccatgtactttgcggactgcgcttctacgatatgctgatctactcaatccaccgaagaaggctgctttgcttgctttagcttctcatgcatctgatccagctgaagctgaacgacttaggttcttggcctctcctgctggaaaggatgagtattctcaatggataactgctagtcagaggagtcttcttgaagttatggctgcattcccttcagctaagccaccactgggagtgtttttcgcagcaatagctcctcgtctgcaaccacgatactactcaatttcatcatctccaaagatggctccctccagaattcatgtaacatgtgcattagtttatgggccttcaccaacaggaaggatccaccaaggagtttgttcaacatggatgaagaatacaattcctctggaatatagcgaagaatgcagctgggctcccatatttgtgaggcagtcaaatttcaagttacctgctgacccatccactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccagcgaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacatatcacccccattcagccatagctctagcgtgtggaagtaaagctggctttgcgtgtacgacatgcctaatgccaaatgaagcgtgccattgtttagaaactgaaatgttcagtcgatcagtgtaattctttgacatctaactatttatcattatatggaatgggaggaactgttgtagatttgtagaactacaaaaaaactgtgtatccctaacaagtttgtagcaaaggggggtacattattacagtttgagaaatgaggacatcatgtaaatactgtttgaagacgaggacattatgtaaatatacttggtacattagannagcgccacccgaaacacaaatatttgcactcctggtttttgaaanngncatgtgcttccctaa

SEQ ID NO: 24969 - DNA, 614 bp, Zea mays
  misc_feature (124)..(124): n is a, c, g, or t
  misc_feature (131)..(132): n is a, c, g, or t
gcttttgtgcaaactttcctatgagagggggcgctttctgagctaattgttgcattctctcggtgagggccaacgaaagaatatctgctgcataagatggcggaaaaggccatagcaaatttgngaacatnncatctgaaatggcggttacttgtctatgtgcggtgatgccaagggaatggctagagatgtacacaaaatgcttcatacaatagtccaagagcagagatctttggatagctccaaaaccgagagctatgtaaagagcatgcagatggaaggcaggtacctccgtgatgtatggtgacacatcacctcaaataagccatagctctagcgtgtggaagtaaagctggctttgcgtgtatgacatgtctaatgccaacctaatcgtcagctttggaatgaagcatgccattgataatatactaaaatgagttgatcagtgaaattctttgacatctagccgagaatttttgtttggttatcgataattcactctcattcatgtgagatattgtgctctgcttatttattgatagctgacactggtcacccaggagcacgagattagcgcgttgatgtacctgcccccgcgcccgctcgctggagga

SEQ ID NO: 24970 - DNA, 1707 bp, Zea mays
gtcaatgacagcttgtaataccttatctaacatagtatgtttgtgttagttgcttcagttagtgctaataggattttgccgttgttctagttaggagatggctatatgttgtgaacataaaaattagtaatctggagagggatttacaatattgtactattttaacctagacgagcaaaactgaagctaaagtgttctactcgtttagtgcttttatctaacctattttactaatcattctggtttcttatggttatagcaaagtttcgtttcctgtagcattccttccaagttgtccaaatgttaggcatggaagaacatggagataggaggtggcaatggtgaatggagtttattttgttcgtataatacttttcaatcatgttctcatttacatcattggcctcccccaggccggccgggttatctatgatctatctatggtcatcattttgtgttgaaaaaacagatgcaaattattatggcaacaatcatgttactattgttctacaagaggccaatttttttgtagaccgattggcttgctaagttttggtgctactatatctgtggtgatcttttaactggaggaacatatttaaaggcctcaacaaaggagaaccaggccaagttgtcggtcgtgcgttcacaaatatatttaaatcttccgccatgaaattatttaaatcttacagttcaggcaccagctaagcctaagatgctgagtttccatatgtgataatgttggactgtcttgttcatatcggtgtggcatatcattatgcttgaggtggtggtatgtaccttccattaggtaggcctcttgacaacttatgtctcagcaggatggctccctctagaattcatgtaacatgtgcattagtttatgggccttcaccaacaggaaggatccaccaaggagtttgttcaacatggatgaagaatacaattcttctggaatatagcgaagaatgcagttgggctcacatctttgtgaggcagtcaaatttcaagttacgtgctgatctgtccactccttttatcatgattggtcctgagacagggctggctccttttagaggcttcttgcaggaaaggttagcattgaaacaatctggggcagaactgggcacttcaatccttttctttggatgcaggaaccgtaatatggactacatatatgaagatgagttgcaaactttccttgaggagggggcgctttctgagctaattgttgcattctctcggtaagggccaacgaaagaatatctgctgcataagatggtggaaaaggccatagaaatttggaacatcatctgaaatggtggttacttatatatgtgcggtgatgccaagggaatggctagagatgtacacaaaatgcttcatacaatagtccaagagcagagatctttggatagctccaaaaccgagagctatgtaaagagcatgcagatggaaggcaggtacctccgtgatgtatggtgacacatcacctcaaataagccatagctctagggcctgtttggttcaacttttttctgagcagcttttctgaaaatctggctgtgaggagaatctggttgtagggagaatctgagtatcattatgattacgcgtggaggaagataaagttgttcatagaactcaggatctagaaagtgacggattcttactattacaacgactccaaccgattatggtgtt

SEQ ID NO: 24971 - DNA, 3185 bp, Zea mays
gccctgggatatttctttcccatctacgttctccgcaggaataattcccgaaggatatctcgttttcatttaaattataattacgacatacatcttttattattaatgcaaaacatttttacttatacttatcgtaagacataataaatcattatgtgtcattaaaatgaacacatttatataataattaatctctagacaaggaaattatttatttttattattaattagtttaaaaaacattgtcgtatgctggtttaaagggtctctgggtctccgcggggaacagagatgggaaatgcttccctgtccccatcatctcggaaagaattcctctctattttatatcataaactttctcatcttcgctctctagatttctgtttgagtactctagtattgatctcaatctataatattaaagtgaattgaggtataaattagtttaatttacgtcttaattcacctcaagattgagatactaggccttggagggaatttccgtggagaatcaggatcggccccattgccgtctctagcaccactagtagcgaagccactggttgttggtaggtgcacgcaccccaccccctcctgccgtcctccatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccactcgccgcgctggcggccaccgccgcggccctcgtcgcggggctgcttattatcgctgtctggttccgatccggaggcgggacgccgtccaagccggtcgccacgccggtacggccaccgccggtcaaggtggacgccgacgccgacgttgatgacggccggaagcgcgtcaccatcttcttcggcacacagactggcaccgccgaggggttcgcaaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatggggatggggagccaactgataatgcagcacgattctacaaatggtttactgagggaaaagagaaggaagtttggttgaaggatcttaaatatggtatttttggccttggaaacaggcaatacgaacattttaataaggttgcaaaggtggtagatgagctagtagaggagcagggtgggaaacgtcttgttcctgttggccttggagacgatgatcagtgcattgaggatgatttcactgcatggaaagaactagtgtggccagaattagatcaattgctccgcgacgaggatgacacaactggtgcatcgactccatatactgctgctattcctgaatacagagttgttttcattgacaaatctgacctgtcattccaagatagatcatggacactagccaacggtactggtgtgattgatattcaacacccttgcaggtctaatgttgctgttcggaaggagctgcacaaaccagcttcagatcgctcttgtatccatctcgagtttgacatttctggcactggtcttgtgtatgaaaccggagaccatgttggtgtatatgcagaaaattctgttcagactgtggaggaggttgaaaggctacttgacctttctccagacacattcttctccatccatgcagatgcagaagatggatctcctcgtaaaggaggaggttccttggccccacctttcccatctccatgtaccttgcggactgcgcttctacgatatgctgatctactcaatccaccgaagaaggctgctttgcttgctttagcttctcacgcatctgatccagctgaagctgagcgacttagattcttggcttctccttctggaaaggatgagtattctcaatggataactgctagtcagaggagccttcttgaagttatggccgcattcccttcagctaagccaccactgggagtgttttttgcagcaatagctcctcgtctgcaaccacgatactactcaatttcatcatctccaaagatggctccctccagaattcatgtaacatgtgcgttagtttatgggccttcaccaacaggaaggatccaccaaggagtttgttcaacatggatgaagaatacaattcctctggaatatagcgaagaatgcagctgggctcccatctttgtgaggcagtcaaatttcaagttacctgctgatccgtccactcctattatcatgattggtcctgggacagggctggctccttttagaggcttcttgcaggaaaggttagcattgaaacaatctggggcagaattgggcacttcaatccttttctttggatgcaggaaccgtaatatggactacatatatgaagatgagttgcaaactttccttgaggagggggcgctttctgagctaattgttgcattctctcgggaagggccaacgaaagaatatgtgcagcataagatggtggaaaaggccacagatatttggaacatcatctcaaatggtggttacttatatgtttgcggtgatgccaagggaatggctagagatgtacacaaaatgcttcatacaatagtccaagagcagggatctttggataactccaaaaccgagagctatgtaaagagcctgcagatggaaggaaggtacctccgtgatgtatggtgacacatcacctcaaataagccatagctctagcgtgtggaagtaaagctggctttgcgtgtatgacatgtctaatgccaacccaatcgtcagctttggaatgaagcgtgccattgatgatatactgaaatgagttgatcagtgcaattctttgacatctaactatttattattatatgagatgggaggaactgatggagaataaatgctgctgtagatttgtagaagttcaaaaaaattgggtacccctgacaagtttgtagccaagggggtacatcatacagtttgagatgaggacactatgtatactgtttgagacgaggacattatgtatactactctagaaggctaccgaaaccaaattttgcatctgtttattaaaagcttgtacttttatcatggtatcaaaaaaaaaaaaaaaaaaaaaaaaaaaaaaa

SEQ ID NO: 24972 - DNA, 2238 bp, Zea mays
gccggccgggtcggggtccgcagtagcagcagcaacgagccaacgatgcgctggcggctcgtgggggcccccccccccccccccccacccaatccctcgcggcgggcgggcgagagagcgagcggcgatggcggcactggaggcggtgaggtcgtgggcggtgtccgtcatcccgccggagctcgccgccgccgcggggggagacccgctcgccgcgctggcagccaccgccgcggcccttgtcgcggggctgcttatcctcgccgtctggttccgatccggaggcggggcgccgtccaagccggtcgccacgccattacggccgccgccggtgaaggtggacgccgacgccgacgtggacgacgggcggaagcgcgtcaccatcttcttcggcacgcagaccggcaccgccgagggattcgccaagtcgatggcggacgaggcgagggtgcggtacgagaaggccgtgtttaaagtggtggatctggatgactatgctcaggaggacgaggaatacgaggagaagctgaagaaggaaactgtggcgctgttcttcttagcaacatatggggatggagagccaactgataacgcagcaagattctacaaatggtttactgagggaaaagagaaggaagtttggctgaaggatcttaaatatggtatttttggccttggaaacaggcagtatgaacattttaataaggttgcaaaggtggtagatgagctactagaggagcagggtgggaaacgtcttgttcctgttggccttggagatgatgatcagtgcattgaggatgatttcactgcatggaaagaactagtgtggccagagttggatcaattgctccgcgacgaggatgacacaaatggtgcatcaactccatatactgctgctattcctgaatacagagttgttttcattgataaatctgacctgtcattccaagatagatcatggtcactagccaacggtactggtgtgattgatattcaccacccttgcagggctaatgttgctgttcgaaaggagctgcacaaaccagcttcagaccgctcttgtattcatcttgagtttgatatttctggcactagtcttgtgtatgaaaccggagaccatgttggcgtatatgcagaaaattctgttcagactgtggaggaggttgaaaggctacttgacctttctccagacacattcttctccatccatgcagatgcagaagatggatctcctcgtaaaggaggaggttccttggccccacctttcccatctccatgtaccttgcggactgcgcttctacgatatgctgatctactcaatccaccgaagaagcttctcacgcatctgatccagctgaagctgagcgacttagattcttggcttctccttctggaaaggatgagtattctcaatggataactgctagtcagaggagccttcttgaagttatggccgcattcccttcagctaagccaccactgggagtgtttttcgcagcaatagctcctcgtctgcaaccacgatactactcaatttcatcatctccaaagatggctccctccagaattcgtgtaacatgtgcattagtttttgggccttcaccaacaggaaggatccaccaaggagtttgttcaacatggatgaagaatacaattcctctggaacatagcgaagaatgcagctgagctcccatatttgtgaggcagtcaaatttcaagttacctgctgacccatccactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggcgggggcgctttctgagctaattgttgcattctctcaagaagggccaacgaaagaatatgtgcagcataagatggtggagaaggtcagcataaaattgtgtatccctaacaagtttgtagcaaagggggtacataattacagtttgagatgaggacatcatttatactgtttgagacgaggacattatgtatatacttggtacattagaaggccaccgaaaacaaattttgcatctggtttttgaaagcatgtaatccttccaactatcgtctgtctgcaatgtgggtggaaggtgcagtggcagtcaataaaaaaaaaaaaa

SEQ ID NO: 24973 - DNA, 2576 bp, Zea mays
  misc_feature (1742)..(1742): n is a, c, g, or t
ggccgggcaacaatctcgggccaccgcactcgttgactttgtttgagcttatgtttagttgcccgtacatgggagacgtagacagcatgagtggatgcaaaacaagttattttaaagttattaacctgcatctgtctgaacgcctaaaactaccgtatccagctacccagggcacgtccagcctgttcgtacatgcgcagctatccaatcaagctcatttagaagtataaacattggaattcaaaataattctaccacaaagtagcagtgatgcatcacattggtttagttgtgtctttgaactactggcaatttgttttttacatttactccaaggaaagcattcctagccatccagcagttatgattttgaaaaacatagacaaagcctgagtcatccagaggtgtgcaagaaaactgccagtttaattggtgtgcaaggaaactgccagtttattggggtttaatggttttgttggttatgtgaataagtttaatgtgataattttaatgcagcattaggttcaacttacttccattgaatcaacacccctgccactacttattaactggcttgtgtgattagagcaatcctatccaacattgtcaactgacttgtgtggtttaattttataaactatgagtatggattttccttagattagaaaaaaaggtgaatcatttcttagtccactgtctgtcatacacagtgctagagagtagagagtagagacactgtctgtcatacgcactgttcattatgtatgtgaattcgccaggagggtcaatgacagcttgtaataccttatctaacatagtatgtttgtgttagttgcttcaattagtgctaatggattttccgttttctattaggaatggctatatttgtgaacataaaaattagtaatctggagagggatttacaatattgtactattgccgcctccacgcgcaaaactgaagctaaagtgttctactcgtttagtgcttttatctaacctattttactaatcattctggtttcttatggttatagcaaagtcccgtttcctctagcattccttccaagttgtccaaatgttaggcatggaagaacatggagataggaggtggcaatgatgcaaattattatggcaacaatcatgttactattgttctacaagaggccaatttttttgtagaccgattggcttgctaagttttggtgctactatatctgtggtgatcttttaactggaggaacatatttaaaggcctcaacaaaggagaaccaggccaagctgtcggtcgtgcgttcacaaatatatttaaatcttccgccatgaaattatttaaatcttacagttcaggcaccagctaagcctaagatgctgagtttccatatgtgataatgttggactgtcttgttcatatcggtgtggcatatcattatgcttgaggtggtggtatgtaccttccattaggaaggatccaccaaggagtttgttcaacatggatgaagaatacaattcttctggaatatagcgaagaatgcagttgggctcacatctttgtgaggcagtcaaatttcaagttacgtgctgatctgtccactccttttatcatgattggtcctgagacagggctggctcctttcagaggcttcttgcaggaaaggttagcattgaaacaatctggggcagaactgggcacttcaatccttttctttggatgcaggaaccgtaatatggactacatatatngaagatgagttgcaaactttccttgaggaggggggcgctttctgagctaattgttgcattctctccgtaagggccaacgaaagaatatctgctgcataagatgggtggaaaaggccatagaaattcggaacatcatctgaaatggtggttacttatatgtgtgcggtgatgccaagggaatggctagagatgtacacaaaatgcttcatacaatagtccaagagcaggtagatgacaaccgcaattcatcatctaatacgtgactattaacttcagtatgttgtttgtaacatcttatttgtattttacctcagggatctttggatagctccaaaaccgagagctatgtaaagagcctgcagatggaaggaaggtacctccgtgatgtatggtgacacatcacctcaaataagccatagctctagcgtgtggaagtaaagctggctttgcgtgtatgacatgtctaatgccaacccaatcgtcagctttggaatgaagcgtgccattgatgatatactgaaatgagttgatcagtgcaattctttgacatctaactatttattattatatgagatgggaggaactgatggagaataaatgctgctgtagatttgtagaagttcaaaaaaattgggtacccctgacaagtttgtagccaagggggtacatcatacagtttgagatgaggacactatgtatactgtttgagacgaggacattatgtatactactctagaaggctaccgaaaccaaattttgcatctgtttattaaaagcttgtacttctaaaaaaaaaaattagataaaaaaaggactggaataccaaaataaaaa

SEQ ID NO: 24974 - DNA, 1096 bp, Zea mays
ccctgggcatgcttttacgcagcattaactcctcgtctgcaaccacgatgctactcaatttcatcaactccaaataggctccctccacaattcatgtaacatgtgcattagtttatgggccttcaccaacagggaaggatccaccaaggagtttgatcaacatcctctcggcgtccgcaattcctctggaatatagcgaagaatgcagctgggctcccatatttgtgaggcagtcaaatttcaagttacctgctgacccatccactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccaacgaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacacatcacccccattcagccatagctctagcgtgtggaagtaaagctggctttgcgtgtacgacatgcctaatgccaaatgaagcgtgccattgtttagaaactgaaatgttcagtcgatcagtgtaattctttgacatctaactatttatcattatatggaatgggaggaactgttgtagatttgtagaactacaaaaaaactgtgtatccctaacaagtttgtagcaaagggggtacattattacagtttgagatgaggacatcatgtatactgtttgagacgaggacattatgtatatacttggtacattagaaggccaccgaaaacaaattttgcatctggtttttgaaagcatgtgctcctatcggccccta

SEQ ID NO: 24975 - DNA, 1397 bp, Zea mays
catggactgaaggagtagaaaattgttcagcaacaacaacaacacaaatcatcggttccgttccgtcgcagaaatagaaaaaaggctttcttgtcccacagggcagggagaccgagagagcagtctagtgattagttgatcaccagacgtccagacaccatgagctcccgcatggctggagcagcgcttctgcgccacctaggcccgcgcctgttcgcggccgggcctgcggtgtccgggctcaccgcgaggggcggcatgcccgcggccgcgaggcttctccccgcgcggatggccagcaccgctgcggaggctgccagagaggacgccggtgcaaataaacagcacggcggcaccgagaagcatgaggaggaggcagcaggcgggcagagcaagaaggccgtcgtcagctactggggcatcgacacgcccaagctcgtgaaggaagacggcacggagtggaagtggaccagcttccggccgtgggacgcgtacacgtcggacacgtccatcgacatagggaagcaccacgcgccgacgacgctgcccgacaaggcggcgtacctgatcgtcaagtcgctgcgcgtgcccatggacctcttcttccagcgccggcacgccagccacgcgctgctgctcgagacggtggcggccgtgccgggcatggtgggcggcatgctcctccacctgcgctccctccgccgcttcgagcacagcggcggctggatccgcgcgctgctcgaggaggccgagaacgagcgcatgcacctcatgacgttcctcgaggtcacgcagccgcgctggtgggagcgcgcgctcgtgctcaccgctcagggcgtcttcttcaacgcctacttcctcggctacctcctctcccccaagttcgcgcaccgcgtcgtcggctacctcgaggaggaggcagtccactcgtacaccgagtacctcaaggacctcgaggccggcatcatcgacaacaccccggcgccggccatcgccatcgactattggcgcctccccgccgacgccaagctcaaggacgtcgtcaccgtcgtgcgcgccgacgaggcgcaccaccgcgacgtcaaccacttcgcgtcggacatacattaccaggggatgaaactcaaggacacgcccgcaccgctcagttatcactgacaagtaggcgttgcctgcctgctgctcaattcagagttcttacacgttagactatcgttggtcttaatatgttgttgtgctagccaaagttgcttagcagatcaagactggtttgctactcggaggtgaactagttgcctatatggtttgtactttgtacgtaccagtatattgtagatatttgaaataacaaatataagaatccagtgtgatgttacttattaacaaaaaaaaaaaaa

SEQ ID NO: 24976 - DNA, 1872 bp, Zea mays
gattctgtatcctatttattcgcaattaaaaaaaacgactaaaaaactgttaccgaataaaataccatttccaaccattttcatccgcttgtgtactcgtctctattgcttcggtcccgatcacatcatgttcctgctgtcctgcacgtgcacggcacttggagaccacggctcaccgcaacgctactccgccccggaagcatcgtgctgggggtagcgtggtacggccagccaacccgggcccccgggcccaggacgcgcccgtataaaacccaccccaacggaaaaagttcagcaacaacaacaacacaaatcatcggttccgttccgtcgcagaaatagaaaaaaggctttcttgtcccacagggcagggagaccgagagagcagtctagtgattagttgatcaccagacgtccagacaccatgagctcccgcatggctggagcagcgcttctgcgccacctaggcccgcgcctgttcgcggccgggcctgcggtgtccgggctcaccgcgaggggcggcatgcccgcggccgcgaggcttctccccgcgcggatggccagcaccgccgcggaggctgccagagaggacgccggtgcaaataaacggcacggcggcaccgagaagcatgagggaggaggcagcaggcgggcagagcaagaaggccgtcgtcagctactggggcatcgacacgcccaagctcgtgaaggaagacggcacggagtggaagtggaccagcttccgggtgagtaccgtaccgcacatttcgcaatcacactctgttccacgacgcttgcttgcgctgcacctgcatgaggaggcccgcaccggggtggcagtggaccagcttccggccgtgggacgcgtacacgtcggacacgtccatcgacatagggaagcaccacgcgccgacgacgctgcccgacaaggcggcgtacctgatcgtcaagtcgctgcgcgtgcccatggacctcttcttccagcgccggcacgccagccacgcgctgctgctcgagacggtggcggccgtgccgggcatggtgggcggcatgctcctccacctgcgctcgctccgccgcttcgagcacagcggcggctggatccgcgcgctgctcgaggaggccgagaacgagcgcatgcacctcatgacgttcctcgaggtcacgcagccgcgctggtgggagcgcgcgctcgtgctcaccgcgcagggcgtcttcttcaacgcctacttcgtcggctacctcctctcccccaagttcgcgcaccgcgtcgtcggctacctcgaggaggaggcagtgcactcgtacaccgagtacctcaaggacctcgaggccggcatcatcgacaacaccccggcgccggccatcgccatcgactactggcgcctccccgccgacgccaagctcaaggacgtcgtcaccgtcgtgcgcgccgacgaggcgcaccaccgcgacgtcaaccacttcgcgtcggtacgcactctgcaccttgcaacaggattcattgctgtgagcaatctccagcagttctagctaattcattggtttatgtttgcttaatggagtacattattttgcaggacatccattaccaggggatgaagctcaaggacacgcccgcaccgctcagttatcactgacaagtaggcgttgcctgcctgctgctcaattcagagttcttacacgttagactgtcattggtcttaatatgttgttgtgctagccaaagttgcttagcagatcaagactggtttgctactcggaggtgaactagttgcctatatggtttgtacgtaccagtatattgtagatatttgaaataacaaatataagaatccggtgtgatgttacttatcaaaaaaaaaaaaaaaa

SEQ ID NO: 24977 - DNA, 2426 bp, Zea mays
  misc_feature (1647)..(1647): n is a, c, g, or t
  misc_feature (1713)..(1713): n is a, c, g, or t
  misc_feature (2384)..(2384): n is a, c, g, or t
tcggcaaatatacactgcgcccgtccgcctccgcaatcgacaacgaaccactgggcaccggccgcggctcgcaagtggcctgcgttcctcttccacgctccgcccacccgtcccggggcccgccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgtcccacccgtccctgccccgctccctctccttccacctcgccaacaagctctgctcctccacgctcctctccacgctcctctacgacctcttcctcgccacgctcaccgcgcacccctctctccgcgccgccgtcgtcgccgacctcctcgcggcccactcccgcgaccccgcctgcgtcggcttctcccactgcctcctcaactacaagggcttcctcgccatccaggcccaccgcgtcgcgcacgtgctctgggcgcagcagcgacggcccctcgcgctcgcgctccagtcccgcgtcgccgacgtcttcgccgttgacatccaccccgccgccgtcgtcgggaagggaatcctcctcgaccacgccaccggcgtcgtcatcggtgagacggccgtcgtcggcgacaacgtctccatcctccaccacgtcaccttgggcgggaccgggaaggcggtgggtgaccggcaccccaagattggggatggcgtgctgattggagcaggggccaccattcttggtaacgtgaaaattggtgccggggctaagattggagccggatccgtggtgctgatagatgtgccggcgaggagcacggcggttgggaaccctgccaggctgattggtgggaagaaggccgagggtgcgaatgaggaggacatgccaggggagtccatggatcacacgtccttcatacgtcaatggtcggactacaccatttgagagcggttatccaaggtctattgctcttcttttgtatcactagtaatggtgatgtaccaaataccgagtacttgctctttgttgtgtgctatggtttgtgtattgtacttagaagcctagtggtgtttatgatcattgtcagctgagtgtgccatgcctgaatactggtaaatttcgattgatggatggacaaatctgtatgagagttggttggaatttgtcacattccttatgaaacaaattctgaggacagaatgaagcgtgtaaagcgattatcttatctgatgcagtttttgttatttgatattatgccatttataaaaaaaaaaaacttattaatcttagaatagcctctcatcaagtttgttttgcatgtccactctgtaaataagtacaaagttggttggaatttgtcacagtcctgaaccaagctccaaggacagaattaagcatgtaaattgatatattatatattgcagtttttgttatttgatgtcatgctatttattctctgatactgtgnttttgttaattgaataattgaatgtggtgcattgtcccatctagaagatactagatcttagaatanccttccattgagtttattttgcatgcctactttatagataagtatgctttactgccacaaacttgttatgaaacgtagtcctggagtattttcgttagtaactattatctggaaaaaaatatgtctagaggtgatgcatgtctgtatgatatattctgtttcgttggaacacttagggtgtggatacaagggctaattattagctagctatttttaagcccaaattagttctagtgcattcaaacaagagagttagtagatgagataatttttagccaagtcttcaactagttattatacaactagctagccaaccacagctaatttgggttatattttagcctcacctaggaacaaacaggcccttaaaattgctgctgctctgttcaggaagaaaactaatgttagtgtattatataaacaagttttcgctgttcgtgatggatgcggctttagttcattctcatcaactttcacatgttttcttattcattcatttctggaaggacacagattcaccatcgtttgtctgcccagagggagtacttaactaccaaattggtcagttcacatttttgttaaacctttttcttggtgtgtttcttttaactttagttatttgctttgacaattaatgtccaagtatcagacaatgcggaaggcactggttnaaatcacatgacatcacatgtgaccttttcaatttcaaaact

SEQ ID NO: 24978 - DNA, 2136 bp, Zea mays
attttttttgtcacgcttcacgcacctgtaacccagacgcagtctgcttcctcgaaacttcgccttctcggttgcctgcctccgccgccgcaggcagacacgtatatataggagcgcaaacaccttgccctgtctaagcggccacaacctcccagccgtcgctagtcgctcgctccatcaccgataaccaagatcccaagacctcctccagcctcctctgctctcgcgccggcacccgcacgcatggctgcctgtgtcgacaagtggcaccccacgcacgccggccgcctcaccggcgccatctaccgctacttgccggacggcgccacggaccgcgcggtggccgccgccgccgccgcgccggcgtccgcgagcggcggcgacgacgacgacgtctgggacgagctgcgcgcggaggcgcaggccgacgcggacgccgagcctctgctccgcaagtactacgccgacctcgtcctgtcgcgcccgtcgctggaggccgccctcgccgcgcacctgtcggccaacctctgcgtccccggcgcgctgccgcaggacgcgctccgggacctcctggccgccgcactggccgcgcgcccggagtccggccccgccgcgcgcgccgacctccccgcggcgcgcgaccgcgacgcggcctgcggccggatggtgcactgcttcctctactacaagggcttcctcgccctgcaggcgcaccgcgccgcgcacgggctgtggtgcgagggcccctccgcgccggccttcctcctccagagccgcgcgtccgaggtgttcggcgtcgacatccaccccggcgcgcgcattggctcggggatcctgttcgaccacgccacgggcatcgtcatcggcgagacggccgtcgttgggaacgacgtctccatcctgcacggcgtcaccctcggcggcacgggaaaggagtccggcgaccggcacccgaaggtcggggacggggtgctgatcggcgccggcgccagcgtgctcggcaatgtgcgcgttggagccggggcgaagattggagcaggggcggtcgtgctacgggacgtgccggaggggaccacggccgtcgggaaccccgccaaggcggtcgggaagaaggcggcgccgcagcggcggccggaagagcagcctggggtcaccatggagcaagggtggtcggactacgtgatttgataacttccagagggtctgtttgcaaatatttagtgcaggagagtttccctcccagaagatatttagtcaagtcgttattgagagataggtgcattgccgttgctgcattgcataaagagggagctcaattaggcattgagccctagagcaactccatatttttctttgttttgcgtgaggggaataacaatactatatgcatctgataagttatcggttgcttgtacatatactttcaagctataaattattgtgtccgcctggctcgtttcttctcctaagggctagtttggcaaaccgcatttttctatgggatttttaatttttcaagggaaaataaactaatttcccttgagaaaagaaaaaaaccattgaaaaaatgtggtttccaaactccctaaacttataaaaccccaagcaggacataaatgagatgttcgctttgaagaatcactaaattctaaataaagtgatgcatcatagatccattcttcaaatttagtgagatgaccagatgaccacattcctcatattagtactaactaaatgaggaatgatttggtgatggatcaactcatttcatttcgcaaaccaaaaaagagtaagaagatgatagactagctcattctttaaaccaaacactctagaagtctatcctgcaggagactttataattatacagtactccactatccatgtacagactttgaccaagtagagttggatatataagcctctgcttcaaccagtaacggaacatattcggtaagcagatttgatagttgactcatggtcatgatgactgcttcaaaccactagagcatagatattgaatagcatgttttaatcatgtattatgttttggatttgatatagactagttcaagtccatattgtatttatacgccttcgtgagtagtagttctcaatccaatggaatcaacgcaa

SEQ ID NO: 24979 - DNA, 1518 bp, Zea mays
ctctagaacctcgcgggccattcaaaaggctgcgccgttaaccccatcccttcgcctgccctgcccacgtggccacgtacgagtgacctcgattattctgtttgctctcgttcaagtcatcgtctggtcgcgtcggcagcagacgcccagagccggagggagcgccatggccgcgtcggatctggagagcaaagccaaggaggccttcgtcgacgacgacttcgagctggccgccgaactctacacccaggccatcgacgccgggcccgccactgccgatctctacgccgaccgcgcccaggcgcacatcaagctcggcaactacactgaggctgtggcagatgctaacaaagcaattggtcttgatcctacaatgcataaagcctactaccggaaaggtgctgcatgcattaagcttgaagaataccaaactgcaaaggctgctcttgagttaggttcttcctatgcaccaggcgattcaaggtttacccgtctattgaaggaatgtgatgagcgcattgctgaggaatctagccaggcaccagcaaagaatgtcgaggctcctgtagctgctactgttgaggacaaggaggatgtcgcaaatatggataatacaccgccagtggtagaacccccaagcaaacctaaatataggcatgactactacaacagtgccacagaagtggtcctcacaatatatgctaagggtgttcctgctgatagtgtagtcattgattttggtgatcagatgttgagtgtatccattgaagtacctggtgaagaaccgtaccattttcagccccgtctgttttctaagattatccctgagaaatgcaagtatcaagttttatccaccaaggtcgaaatacgccttgcaaaagctgagcaggtgacatggacaaccctggattatagtggaagaccaaaggctattccccagaagataagcacgccagctgaaacagccccaagaccttcatacccatcttcaaagtcaaaaaaggactgggataaactggaagctgaagtaaaaaaggaggagaaggaagaaaaacttgaaggtgatgctgcattgaacaagttcttccgtgatatctacaaggatgctgatgaagatatgcggagggccatggacaagtcattcagggaatctaatggtaccgttctctcaaccaattggaaagatgttggatcaaagacggtggaagcgagccctcctgatggtatggagctcaagaagtgggaaatttgaagtttggactgcccctcttgtaaatccaggtcttggaagttatgacctagttctgtccacccatttggtgtcgtaagtttggttaagtgtgtgtgtgtttttggttcagctgtcgttcgaggaaaagctattgtaagttgtggactgtgtaaaagctgcaatagattgtgggttgtgaaaaaggtgtatgctgtttaatttaaacaagcataaaacttacacgtatctctattttttctttttacaaaaaaaaaaaaaaaacggcc

SEQ ID NO: 24980 - DNA, 1666 bp, Zea mays
aaatttttcgcgaagtttgtgttgtgattgcgccgttacgttacgtgaagaagacggatcttctacaagctgacggaagggcggatcgtgaaattgcgagttgcgacgccgtcattacaaatacgttatctgttcatccgtcaagccgtcagatctcccggcctgaggattcgattattctttcgctctcgcccaagtcatcgtctggtcgtcgcccgcagaggcgcagacgcccaaaaccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaaagcaattgagcttgatcctatgatgcataaagcttactaccggaaaggtgctgcatgcattaagcttgaagaataccaaactgcaaaggctgctcttgagttgggttcttcttatgcatcaggcgattcaaggtttgctcgtctattgaaggaatgtgatgagcgcatcgctgaggaatctagccaggcaccagtaaagaatgttgaggctactgtggctgctactattgaggacaaggaggatttcacaaatatggagaatacaccaccagtgatagaacccccaagcaaaccaaaatacaggcatgactactacaacagtgccacagaagtggtactgacaatatttgctaacggtgttcctgctgatagtgtagtcattgattttggtgaacagatgttgagtgtatccattgaagttcctggtgaagaaccataccattttcagccccgtctgttttctaagattatccctgagaaatgcaaatatcaagtcttatccaccaaggtcgaaatacgccttgcaaaagctgagcaggtgacatggacaaccctggattatagtggaagaccaaagactgttccccagaagataagcacgccagctgaaacagccccaagaccttcatacccatcttcaaaggcgaaaaaagactgggataaactggaagctgaagtcaaaaaggaggagaaggaagaaaaacttgatggtgatgctgcattgaacaaattcttccgtgacatctacaaggatgctgatgaagatatgcggagggccatgatgaagtcattcgtggaatcaaatggcactgttctctcaaccaattggaaagatgttggagcaaagaaggtagaagggagcccccctgatggtatggagctcaagaagtgggaatactaaagtttggactgcccatcttttgtaaatccaggtcttggaaactatgacctaattccgtccacccatagtgccatgagcttgcttggttaagtctctgcttttgtaagctttctgtatgacagtctagcgtgtgtctgagtgctacttgccgtagcttttgatggacataggtatgctattatgtggtatcgaccgggaaccatctgtggtatcaaagacagcaaactataatgtatggaatgcctattctttttggcccaaaaaaaaaaaagaaaaaaaaaaaaaaaaaaagaaaaaaaaaagaaaaaaagcggccaaaaagcggcc

SEQ ID NO: 24981 - DNA, 5741 bp, Zea mays
tggattgtttgtacatgttctacagtttgcgatgaacatatttctgtttataatattggccaatcgacaatctggatcatttcttgaatcgtcttgcatttctacatttttctgtagagtcgtcctgcagctgaaacagccccaagaccttcatacccatcttcaaaggcgaaaaaagactgggataaactggaagctgaagtcaaaaaggaggtttgatgaagatcctcacttatatatgtatcgatcttattgctagaacttgggtttatcgaatatgaatggggtttcatgatttgtgtctgcatcaggagaaggaagaaaaacttgatggtgatgctgcattgaacaaattcttccgtgacatctacaaggatgctgatgaagatatgcggagggccatgatgaagtcattcgtacgtgatgtttggcccagctaatactggatttggagccaactgtattttatgtctatactcacgtatccttgcccgtttctccaggtggaatcaaatggcactgttctctcaaccaattggaaagatgttggagcaaagaaggtagaagggagcccccctgatggtatggagctcaagaagtgggaatactaaagtttggactgcccgtcttttgtaaatccaggtcttggaaactatgacctaattctgcccacccatagtgccatgagcttgcttggttaagtctctgcttttgtaagctttctgtatgacagtctagcgtgtgtctgagtgctacttgccgtagcttttgatggacataggtatgctattatgtggtatcgaccccgaaccatctgtggtatcaaagacagcaaactataatgtatggaatgcctattctttttggtctaagatgtttttcttgtcagcgtagtgtgatcttcacaactgaataatagaaactatgcagggacctatgttacagtggtccaccgttggcacagttgcatttgcgtctctttggtggatgaattgaatttatgggaaaattgatttctacctggcatttatgcatcggcgttttacttggtttcaggtttcaggtatgttgcctggttcatgcgctcaatacagccaggtggcacctgaattataggagtacatgtacaaaactcaatgcgcaccgacttctcggagattacgcaagcacgatatacaacggaaattcatcagcccgttagttttcggggtcctgtttgtcagaaacacgcacaaaaaagacgcctatacatagaatctcttcgaggcgaggtcttttcgtcctccattgccattgaaggttctgatttctggcgttacagcgcccacctagagggagagccggcgtcccagtacgccatcttccgcctcgatgacctgctcgaaatcgaagtcgtcgtcgacgggcgccaagagctcgtccaggtccagcccctcaggccagaactcgctgtcgtcgtcgacggccgctatctcctcgccgccaatctccccggccaccgttgacgtctcgctgctgccatgctcgcggtcgccggtgccacggccggccgcctgtccaccatgctcgtggctcttgggagaggaggccgcgctgtgctcggcggccgcgccggacgacggcttgtggcgagtggtgcccgcgagcgcgttgagctgcgtgggcacggggtggcagtgctccgccatgtaggtgacgatgagcaccccgggcttcgctgggctgcgctccaccagcttccgcgccatgcaccccttcatgctgctgcacttgtagtaccccctgcggccacagatcaattcccatcgcaacagtcgcgttagttcgctgagcgtgcgggccagcagccacagggtcaactgcaagcacgcagtacggctatcgaattacagtatcttgtacgtagtactgtactgcaaaaagcttgattggtgatgtccaagtggctttggcgtctcgctcttgtggctgaattatcaaagctcctaattacactagctaggctaggacacctatgcgaagcctcaaggatggcatgcatgccatccctttcttcttgtttccttaaagaaaaggtgccttcttgtttccttaagaaaaggtggcaataattaaggtgttgggagtgattgagtcaacgttcgacgataaggccacctataccagctagctagtagcaggcagtgagtgcaacgcgtggaaagcatgttaaggcgaggtcaaaggtagttaccgcggataaggcgagcccttgatgggcttttggccatacttgcgccacgcccacgggtccgacgacgacgagccgccgtcggccgccggcatctcccgcaccaccttcttcagctggctcttcttgctgccataccacaaccagggaagaaaaaaaagaagagaaaagcaataagccatcatatcatcgcaccaccttcttcagctggttctactactaccgttctatgctgcacgggacgaccggtacggtaccttcttttaggccgcgaagtgcgcgcgccgggcttccggcctggcggcgacgccctctgctgcgtcccggacgtggacgccgccgccgccgcggggaaagagatcatcacctcgcgctcgcgcccgccggcccccgcccgcggccccggcgacggcgacggcgacggcgcggccggcagcaggaacggcctgtggtccaagtccaggtactccaggtcgtacaggagcgccgcggccttagccgcgggcggcgacgcccgtccctgtcgccggacaggcaccgtcgtcggcgtggcacgggcggcgggcgcctcgtctcgccgcggcgcgggcaccggctccggcgctgcgtctggctgatccgccctcggcgccgcggcggcgggctccgggtgcgccacgctgccgcagctcctgacgacggcctgcaggtcccagtcgttgaagtgctccgccatgagcagcggctagcatagcacgccgcgcatgaaccacgacgggcggtctctcgagcggcctttggcgaggcggagggccggccgggacgcgtgcgtgctgctcgctccttgctcctgggggggactggcgggcagggagaagggggtggggttgacttttggcagtgcgagtccagcagggccccgcatatatacgcgtatgagaacgccgagtatttggagacgcggcacggcgcgggctctactctaccggcagcgcagcgcaggcccgatctctgcgatgggatgcgatgcggtgcgaggtcaacccgctgcaaagtggtgggcacggcggcagggattgaaaaaaggagagagatcgcgcacggatttgcatcccctaggcgagggaatagctgggatgggatgctactgctgctgcagtgtcgccaagtacacttgtcaagagggagcggtgccggggccaggggcccacgtctgtcgatgtcgtcgtcgtcgtgcatagcttaggcttggctttttcgtgttgttcgctttgactctgctccaaatgtcaaaagggagaggagagagagagagatagagatgtgctggaagattcgagccctctgtcgcccgtggcataaagaagcctgcagtgcaggctgaggcgtgggaataaaccggaatttataatacggtgatgggggtgaatcgtttttttacacacttcgggacccttttttttaatttatatgtacgttatttcggtccctccctcaggcagtatcggggccgcgattgactagtaggcaggcgtcagtttattcttgttccgatctgaccctgcgcaaatgtcaaagggcaggcagagacattgttgctgcgtgggggccaggcggtcaggccaatcgacgcggcggtgagtggtaaaagcgtgaggcgcttttggacacgacaacgacgcgcgcgccagacgcgcgagagcattgttgctgtcttgctcttgccgccgtgcgcgtgccgtcgatgccggggccgggacctggagaccgcatgctttatttgtgccggccgcggcggcgacgacgacgacgacgacgaccgagatcggtatccccgcttttctcgaacggtcggtccactgcaggtgccccatgccacgacagcagcagcagcagcaggagcagcgagccacgcacgcaagtaggcacgcgagtgcggcgggtttttggataagtttggtgtgccgaatgcattagccgaggcggtgcgtgcggtccggcctgtccgcgttatatcgctccagcttgttaggtctgggcgtgctccagctccgcaggcgcgcgccactgcaacgaatcgatcgataatggatggatggttgacacgtgactgcgtttgtcgcgatcggctacctgacttcggttgaagcaaccgactgcaggtccaggtcccggtccggtccatacgcaccttttttttttcaaatggctgccctagtttgttgaattgtgtgtacactggtaggtgtcaagcttcccggccgggatttgtattctttcccccccttcttttctttttacaacgattttattcttcttccaaggacatggccaacaacgtgggggcggttttggttacggtcttcgacacagattattgcctggcttctaccattttcttaattacaaatgttttggatggaaaccagttcaaatatctgattatcagtcggtgcccatatatgctgatggagcccgttatatgaaattactatacgaacggttcaagaaaacaacgtgtctacgtccttgtctctcgcctctcagaattccaaacatcaactcaaccgcgcgcgcctgtcccggcccgccctttcaaatttaacccgaacctaggagtttctctccatgcaaacgctttgtcaccctaagggctaatttaaaaccattgtcttataatatactttgcaattgttatgataattgaccagctctaagaatactatctattgtttgcatacactactgtaaaccatgaccatgtcatgcaaactttagtttcgagtggaattttcaataaaaaaatatcatagtatttacaatactatacttttgaaaacctagttttttttaaaaaaaaatgcaactaaacacctcaagacataaaatactctgtatttctataaaccatggcattacctagaaaccataaaaatattgtacttccaaacaagtcctaaggagatgttggggactgctcacctagatagaccggtggcgattagaagttcagtggtcacctagagagccgtgggtgaatccacttgatgtgaacacgattatggttggttcaccatgctagagtgacaaagaattagtccacagagagcacctggtccttgcatggtttaatggggagccacacccttgcgtgggtggtccaatgagaactggtgaatagtgttgactctttgatacctcaggaaagcaccgtgacgtttgtaatccattatttactttgaacattttacttttgagcaattacattcaaatacttatattgctagaattgccatggtaatataagattggaacataagatgcaaaacatttgatggttacatagaaacacttcctagacataataggtgaattgggatcattgataggttttaatttatgttgcaaattttatacaaactcacttcatcatttctcttgagcatcttgatcctttcaaagacctagatatcactattagtttctcctataactttcgattctagccacgaatcagtagcggtatactatt

SEQ ID NO: 24982 - DNA, 4964 bp, Zea mays
tttcttatagacacattttatttgtatatatattctgcagctgaaacagccccaagaccttcatacccatcttcaaagtcaaaaaaggactgggataaactggaagctgaagtaaaaaaggaggtttgatcaagatgcccacttttaggcatcacttttacttcagcaacttgggtttctcaaatatgaacggtgtttgtgtcggcaacaggagaaggaagaaaaacttgaaggtgatgctgcattgaacaagttcttccgtgatatctacaaggatgctgatgaagatatgcggagggccatggacaagtcattcgtacgtgatcgttggcccagctaataacgcatttggaaccaactatattttatgtctatactcacgtacccttgctgttcctgcagggaatctaatggtaccgttctctcaaccaattggaaagatgttggatcaaagacggtggaagcgagccctcctgatggtatggagctcaagaagtgggaaatttgaagtttggactgcccctcttgtaaatccaggtcttggaagttatgacctagttctgtccacccatttggtgtcgtaagtttggttaagtgtgtgtgtgtttttggttcagctgtcgttcgaggaaaagctattgtaagttgtggactgtgtaaaagctgcaatagattgtgggttgtgaaaaaggtgtatgctgtttaatttaaacaagcataaaacttacacgtatctctattttttctttttcgaaaaaaacaattgttctctagtttcatttcgctattttagaaagtagaaaaccaacaaaaaacaggatctgcaataactaaaagtagctgcttctgacaagcagcttctggtttctacttttttatttctggtttttactttttgtttactggcttcaaaagcagcttaactaaagcctatgcgtttgtaacctttctgtctagcgtgtctgagtgcttcctctattgcaaattgcagttacatcgccctaccctagggtaggttcggttttatctaaaccggaggggattgaatcctaatcgaaaacctccgagagatccgtcgttcgccaaagttgttttcagtttgctactcgtattatcttgttataggcaaccgtatgtgttgattttcactgaacgtcagtttgatggaatatacgtgaggaatactaaccacatgaacagatacaaaataagctattttaagactatttacttacatctaccatattctacaaataaacgtacccagctggtaatgctcgcgcgtgcctgggtgcgcgcgcgtagcaaaacaatcagccgctatgtgtatgaacatgggagcatgtggcgttaagggcaaattttctgcggccgccgccgtcccagtacaccatcttcctctatgacgtgctcgaaatcgaagtcgccgtccacgggcgccaagagctcgtccaggtccatctccgcgggccagaactcgtcctcgtcatcgacggccgctatctcctcgccgccaaactcgccggccattgttgaattcgaagtctcgttgttgccaatgccacgctctcgaaggccggccgctttctcgactgtctggccctgctcgtggctactgggagaggaggccgcgctgtgcagctcggtggccgcgccggacgacggcttgtggcgagtggtgcccgcgagcgcgttgagctgcgcgggcacggggtggcagtgctcggccatgtacgtgacgatgagcaccccgggcttggctgggctgcgctccaccagcttccgcgccgtgcaccccttcatgctgctgcacttgtagtaccccctgcggtcacagattcgaatcgcaacggagcattattagttcggtgagccctgcgggtcagcgcctcagcggccacaatgtcgactgcaagcacgcactactgctgtcgaattgtcttgtggctgaattatcaaagctcctaacactagcaagcacgcagtatggaaggcgaggtcaaagtaaaaaacaacgtagttaccgcggataaggcgagcccttgatgggcttttggccatacttgcgccacgcccacgggtccggcgacgacgagctgccgtcggccaccggcatctcgcgcaccaccttcttcagctggctcttcttgctgtcatatgtcatacgacaagcagggaggaaacggaaagcaataagccatcgcacttcattcttctctaaccaaatcatgcgcgcgcgcaaaacaagtctaaataaaaaaaggaatcttgcataaatggagctgagcgcacagcatcggtacggctacggttacggtaccttcttttcggccgcggcgtgcgcgcgcctggcttgcggcgtggcgacgatgccctctgctgcaccccggacgtggatgcggcccccgcggggaaagagatcatcacctcactcccgtggccgccgccccccacgcgcggcctcggcgacggccgcgcgaccggcagcaggaacggcttgtggtccgaatccaggtactccaggtcgcacaggagcgccacgggcggcggcgcccgttcctgtctccgggcagacaccgccggcgtggcacgcgcgccgccgggcacccgctccggcgcctcgtctcccctcggcgccgcgggtgcggtggccgcgtcggcgggctccggcggcgggcccgcgtgcgcgacgccgccgcagctcctgacgaccgcctgcaggtcccagtcgttgaagtgctccgccatgcgcagcagcacgtcgcgcatgaaaccacgaccggcttcgacgaggcggagggagggacgctgctcctgaccgtatgcgggggactggcgagcagggggtggggtggggttgacttttggaactggtagtccagtagggccccacggcccccagcacgcgcgcatatatgcgcgtagtatatatgtgtattatctactatacgcgtgagagtatttggacgcgcaaacccggggcagtccgcattgacgcggcacggcgcgggggctcaacctcgtgctcaagtgctcaacccgaacttgcgataggatgcgatgagaagtcaacccgatgcaagcggtggacacggaggcaggcaggcaggcagcggcagccggcagggacaagcaaaaaaaaaaaaaaaagatcacgcccggatttgcatccttacccctcggcgagcgcattttaaaaaattgttgcggctggtttctggaagcatgctgctgctacagtgtcgccaagtacacctgtcaaaatgggggcggtccggggccctcgtccgtcgtcgtcgtcgccgcccttggtaagctttttcgtgtcgttcttttgactctgctccaaatgtcaaaagggaggagagagatagagctgggaacggaagattcgagcccccctcccacccgtgccataaaagaaggctgcaggccgaccgaggcgtgggaataaaccgggaattataatacgatgatgacgaagaatcgtttttacagttgcatcctcttttactaattcaatatatttctttttcagtccccatgattggtcgcgcttgactgcaggcgtcagttattctcggtccgatctgatcctgcgcgaatgtcaaagggcagagatctgcactgctgcatggatcccgtagtttatgaggcccttttggttttggacacgaaaacgacgcgcgcgccggcccgacgccggacgctatagttgacaaaaaatatgaagaattgtcgttcgaaaattcatgtgtagcgtgatttaaacaaattatgaagaaatcttatcgagtttttttatttttccaatttattcagcatttccagttggtaaatcgacaaattgaataccgtttttaaatttcaaatctcaaaccgttcaggaattgcgaaatttggcaaattccgagcggcttcctgatttttcggtgatcaccgcgaaataactgagagtcttttagtgagcagatctgaaagcatttacactgtgtttatatcctaatgttcaattatttgatcttggaatttctcctttacaacataatacttaatgtcaatgtgtttagcagtagcacttgacttcttgttatagaagcaacatattgttggtttattatctcagtatagctccagttgttttcatatgttgtctaccactttttaactaggtacaaacttcttaaggcacataccatgccatgttgccctataagatgcaataaactcgatattacattatgaatgatgtggtgatagtttgttttgagcttttccatgatatagctctttctctgagtgtgaatatgaaatcaatcatgaactttctatcttcttcacaccatgtacaatccaaatctgagtatcctataatattaaggctagttaattttatgtatgttaacatgagactgtttatgccttgcaaatactgtaagactttcttaacatttttctagtgttctatcactagattcttatgaaaactgccagatattctggtggttatgaacgagaacatacttgagcatatattatgctttcgataattaaagcatacaaaactggtttcatttgatcaatctcgtattgcttcctaaggccttgattactccccaacttatctcccttgtctactagaatgctgcttgatgagattccttaatagttagggcctatttggtagggcttcgacttttttaaaaatgactctggcttgcagctcctccacacgagccaatgcttttttaataaattgtttagcaaaacgagtcctcttgtatttttatttgatatataaggtaaatatccatagtgcaatgtgtagccatttgcacggataccttatgtgtgtacttacaaataatagttgaacaatttatggccatgacaaattataaagactgaaaaccaaatagcctggctgagatcgggagcgaagctagcaacaaaatccaccaagg

SEQ ID NO: 24983 - DNA, 1645 bp, Zea mays
gcacgagcggatcttctacaagctgacggaagggcggatcgagaaattgcgacgccgtcattacaaatggtgtggctccatggggccggccggcagatctcccggcctgaggattcgattattctgttcgctctcgcccaagtcatcgtctggtcgtcgcccgcagaggcgcagacgcccaaagccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaaagcaattgagcttgatcctatgatgcataaagcttactaccggaaaggtgctgcatgcattaagcttgaagaataccaaactgcaaaggctgctcttgagttgggttcttcttatgcatcaggcgattcaaggtttgctcgtctattgaaggaatgtgatgagcgcatcgctgaggaatctagccaggcaccagtaaagaatgttgaggctactgtggctgctactattgaggacaaggaggatttcacaaatatggagaatacaccaccagtgatagaacccccaagcaaaccaaaatacaggcatgactactacaacagtgccacagaagtggtactgacaatatttgctaagggtgttcctgctgatagtgtagtcattgattttggtgaacagatgttgagtgtatccattgaagttcctggtgaagaaccataccattttcagccccgtctgttttctaagattatccctgagaaatgcaaatatcaagtcttatccaccaaggtcgaaatacgccttgcaaaagctgagcaggtgacatggacaaccctggattatagtggaagaccaaagactgttccccagaagataagcacgccagctgaaacagccccaagaccttcatacccatcttcaaaggcgaaaaaagactgggataaactggaagctgaagtcaaaaaggaggagaaggaagaaaaacttgatggtgatgctgcattgaacaaattcttccgtgacatctacaaggatgctgatgaagatatgcggagggccatgatgaagtcattcgtggaatcaaatggcactgttctctcaaccaattggaaagatgttggagcaaagaaggtagaagggagcccccctgatggtatggagctcaagaagtgggaatactaaagtttggactgcccgtcttttgtaaatccaggtcttggaaactatgacctaattctgtccacccatagtgccatgagcttgcttggttaagtctctgcttttgtaagctttctgtatgacagtctagcgtgtgtctgagtgctacttgccgtagcttttgatggacataggtatgctattatgtggtatcgaccccgaaccatctgtggtatcaaagacagcaaactataatgtatggaatgcctattctttttggtctaaaaaaaaaaaaaaaacagcggccaagaaaaactcggggccggcccggtgcccctatgcaggggaccaaaaaaaaaaaaaaaaaaaaaaaaaaaaaaaaaaa

SEQ ID NO: 24984 - DNA, 1793 bp, Zea mays
cattggggacctccctggagatagcatcacacactgacacacctcgcccccaccgcgacagtgattcggagcgcgaggcccgttcgcaggtcacttctcaattctcaaccttttcttctgccggcgtgcgctctctctctcctcctcgtgcggcagctgggtgaggtttccaggtcttggtcttgtcattcgccagcgacgagactcaccaggtttgcattgatcagtatggtgactgaaaatgcagatgaagaacgtgacactggtccagaaaataagttaagacacaattttcgattgggagatataacatgggttaagtacaatggctcttcatggtggccatcccaggtcattgatgaatcatgtgttggtagcaagcctaagaagaaagacaagtatgattgcctagttcggctctatggaacatgtcaatatttatatgtagacccttggaagtctaactcagaatttgaaatgatgctgaagcaagaaaacaagagcgcaatggaagcattccgtgaggtgcttgagaaggagctctctggcgttaacttgcgcagtgattatgaggatggttatgaagaggaagatgtcaactcaaaaggcggtgacaacaaagggacctcaaagaagacctcttctagaaaagccagaaaacaagaaggtctgaagcaacaatataatggagaggaagaccaaaatggtgggagcaatgcaactactggaggtgctcggaaaaaaaagggtgggcatgtaagacaatcaagtgctactcatgatgccattgataaaaattatagtggcagttcagctgaaggtttaaggaacaagagacagaagtctgctgctcaaagcgcttcggtaggcagaagggaagggttgaggcaacgatctgatgccaagcaacatccagatgcagccgagggcagtacagaaccactcgctgatgtacctggaagcgatggtgcagctcaaggttcaatgcaacatggaacttcggctcctcataccgaaataaaagcgatggtcaggaacatactgttcaaggacatcgttgacaaggagcacgatgctgagatggcttatgtggatgaagtgatcaatggcatctgtaacgctactgacagcatggtcggcggcggcggcggcggtgatgcttccgcgaaaggcggacgaggctccaagcagagcggcagcggagtggagggtgagtcgagcaatgccacagaaaggcgaagagatgaagcaactgagaatgccctcgccgtgaaagggaatacccctgggaacaacggcgatgacgccggggcagcttagcgcacgccaaaataggcagaacaggatcatgcaaaccctagctctgatccctccatcaggatctccgtttggcaggaatgaagaggttgcagccagccgtcaaaaactctaattcacttatgagcgccctaagaaacagtccgtgagcccccctagcgttttgcagtcctgtcctcttgcgcaccatgcctagtatcgctgctgccattcagcttgcttttgggagacgcctatatattgcgcctgatctgctgaattacctagcagttgctattaatctatccagaagacttggattgagtttgattgctatgtaaccacgcggttggttctgtacttgtacgcaactgtgcgacattggccaatgtggtgccgttgaacctttatgtattattgtgcacccccatcaccatgttattactagcccccttcggcatttcagaaaaaaaaaaaaaaaaaaaaaaatcgagagt

SEQ ID NO: 24985 - DNA, 1631 bp, Zea mays
  misc_feature (1627)..(1627): n is a, c, g, or t
ctgtcagtgatgatttgtctgcaaaaaagaaaaactcctcgtgcggcgctgggtgaggtgtccaggtcttcgtcttgtcattcaccagcgacgagactcaccaggtttgcattgatcagtatggtgactgaaaatgcagatgaagaacatgacactggtccagaaaataagttaagacacaattttcgattgggagatataacatgggttaagtacaatggctcttcatggtggccatcccaggtcattgatgaatcatgtgttggtagcaagcctaagaagaaagacaagtatgattgcctagttcggctctatggaacatgtcaatatttatatgtagacccttggaagtctaactcagaatttgaaatgatgctgaagcaagaaaacaagagcgcaatggaagcattccgtgaggtgcttgagaaggagctctctggcgttaacttgcgcagtgattatgaggatggttatgaagaggaagatgtcaactcaaaaggcggtgacaacaaagggacctcgaagaagacctcttctagaaaagccagaaaacaagaaggtctgaagcaacaatataatggagaggaagaccaaaatggtgggagcaatgcaactactggaggtgctcggaaaaaaaagggtgggcatgtaagacaatcaagtgctactcatgatgccattgataaaaattatagtggcagttcagctgaaggtttaaggaacaagagacagaagtctgctgctcaaagcgcttcggtaggcagaagggaagggttgaggcaacgatctgatgccaagcaacatccagatgcagccgagggcagtacagaaccactcgctgatgtacctggaagcgatggtgcagctcaaggttcaatgcaacatggaacttcggctcctcataccgaaataaaagcgatggtcaggaacatactgttcaaggacatcgttgacaaggagcacgatgctgagatggcttatgtggaagaagtgatcaatggcatctgtaacgctactgacagcatggtcggcggcggcggcggcggtgatgcttccgcgaaaggcggacgaggctccaagcagagcggcggcggagtggagggtgagtcgagcaatgccacagaaaggcgaagagatgaagcaactgagaatgccctcgccgtgaaagggaatacccctagcaggggaacaatggcgatgacgccggggcagcttagcgcacgccaaaataggcagaacaggatcatgcaaaccctagctctgatccctccatcaggatctccgtttggcaggaatgaagaggttgcagccagccgtcaaaaactctaattcacttatgagcgccctaagaaacagtccgtgagcccccctagcgttttgcagtcctggcctcctctccgcaccatgcctagtatcgctgctgccattcagcttttgggagacgcctatataatgcgcctgatctgctgaattacctagcagtttctattaatctatccagaagacttggactgagtttgattgctatgtaaccacgcggttggttctgtacttgtacgcaactgtgcgacattggccaatgtggtgccgttgaaccttatgtattattgtgcacccccatcaccantgtt

SEQ ID NO: 24986 - DNA, 539 bp, Zea mays
gcaccaggagagagctcactagtccccccccccccgaccaaatacaaaccctagccgccttattcgtcttcttcgttctctagttttttcctcagtctctgttcttagatcccttgtagtttccaaatcttccgataaaaatgtcgggtaaaggagaaggaccagctatcggtatcgatcttggtaccacttactcttgcgtcggagtatggcaacacgaccgtgttgagatcattgctaatgatcaaggaaacagaaccacgccatcttacgttgctttcaccgactccgagaggttgatcggtgacgcagctaagaatcaggtcgccatgaaccccgttaacaccgttttcgacgctaagaggttgatcggtcgtcgtttctctgacagctctgttcagagtgacatgaaattgtggccattcaagattcaagccggacctgccgataagccaatgatctacgtcgaatacaagggtgaagagaaagagttcgcagctgaggagatttcttccatggttcttattaaaaaggggggg

SEQ ID NO: 24987 - DNA, 523 bp, Zea mays
ggtaataaacaaattaaaaagcaaaaatataataaagagaaaacaaacgtttttttcctgcttgcttctctctttgcttgcgttttctcaaaggttcgaagaaaacgaagaaccacgcttttgcttttttcccaagacttaatctaaaaagcgagatttccttctttcgattcttttttctcaatctggttttcagtcttcggattcaatggcgtctggatcttcgggtcgggtcaactcaggatccaaaggtttcgattttggctccgatgatatcctttgctcttatgatgactacaccaaccaagactcctctaatggtcctcactccgatcctgcgatcgctgcttccaactccaacaaggaattccataaaacaaggatggcaagggtcttcggttttccctacaagctcttacagtccaccagaggattctttgagccaggacattactgacactgtcgaaaggaccatggaagatgtatgctgataacatgaggcgctttcttgaaaggctcagta

SEQ ID NO: 24988 - DNA, 541 bp, Zea mays
  misc_feature (117)..(117): n is a, c, g, or t
  misc_feature (476)..(476): n is a, c, g, or t
  misc_feature (515)..(515): n is a, c, g, or t
  misc_feature (525)..(525): n is a, c, g, or t
  misc_feature (540)..(540): n is a, c, g, or t
gacaatctcaaattcttcggaccttttctctctcccctgaagctcccctcactcactcttctccgaggaagaacaacagagacaatggcggttcccaaagccattattctacctatncttgctactcatctgtggtgctgctctcggagctcctgcttctgaaggttatcttcgtaatggaaacttcgaagagtcaccaaagaaaaccgacatgaagaaaacagttctactaggcaaaaacgccttgcccgaatgggaaaccaccggtttcgtcgagtacatcgccggcggtcctcagccaggaggcatgtacttcccagtggctcttgggagtccacgccgtgaggctcggaaacgaagctacaatctctcagaagttagaagtgaagccaggttctctctacgccctcacgtttggtgcgtcgagaacttgtgcacaggacgaagtttttagagtcctctgtacttttccagtnccgggggacttgccacttcaaacactttacaaaagtttncggagggtgnacgtgtacgcttggnc

SEQ ID NO: 24989 - DNA, 487 bp, Zea mays
  misc_feature (487)..(487): n is a, c, g, or t
ggccaccaacaatatttttctctactcaattcactcacactccaaaagcggtagcaatgtcagccaccgccgccgcctcctcctcgatcgccgttgccaccaactctctcaggaacgtgactctgtcttccagatcgccccttccatcagccatctccgtggctttcccttcccgtggacgcaatactcttcagcgacgcctcgttctcgtttcctgcagtactggagacggatctaagcctacgattctcgtggcggagaagctcggtgacgctggtattaagcttttggaggatgtcgcgaatgtcgactgttcgtataacatgactcctgaggagctcaacattaagatctcgctctgtgacgccttgatcgtgaggagtgggactaaggttggccgtgaggtgttcgaatcgtctcacggacggctcaaggttgttggtcgcgctggtgttgggatcgacaacgtggatctgagtgcagcgan

SEQ ID NO: 24990 - DNA, 3813 bp, Zea mays
aatcaggtcagggtggttatgagtgaggtcatttcgctgacttgtgttggccaggctcctcaaatgcctgctcgccgcctctacacctgacctgtactatgtactagaatgtactccctccgacccgaccacatgatttactcattttaggtttatcttaaatcaaactgttttaatttgaccaacaatatatataagattaaattattttaaaccaaaagaattacatattatggtagttcaagttttaataaatctaataactttacttttatcttataaaatcttattgaacatccgttgtaatcggccaaaacgactgaatcatgtgaaccgagggagtagcatgcaaccaccagtgctgcgtagtaattctcttcaatgcttattggagttgggccccttcacgcctatagcgtcgatgtgatagctgctagcacaatatatcaccaaatgtgtggggtgcggcagcaaccctcctagcgtcgatgtgcgtgctagaaagtgtttgctagtgaaggggagaacttagagtgaatcgctgtggagggtagagatataggaggagagagtgtgctgatgtgacacactaatgggatataggggggaaatttagaggaaaccactaaagacagtctaaacaatttaggctagtttgagaaaattctcaagggattcctatttcccgaggaaaaatgaactaattttctttaagaaatagaattcccttgaaaaatagggtcccaaactagttcttagaaggtgttaatatttcccttctcttatacctccactaggcatggtgaagtaaatggaatgggtccatttaagttatgcaatttttagtggcaaatcttgggtacgaaaatgaaaaaaagttatatgaagaagattgtataactaaaaggtgtttggtatggttcatagcaaaattccaagcagaagctcgtctgagccagccaaatatcccaactccaaagttataaactgtatagttttggtagttatacacatttttaggaagtacctattatactgcttcttgaaatttagagtagagctgttttttgggtgcaacatgataatgacaaacacccctaccctaatgtaaccactctttctatatatcaaccccgttgtttatggtttatgcatctctaaacatggtatttggtgcctcaagtacatcaagtgtgccaccccactactaaccaatatatgtatgtcgtcttattaattattgaagattttttaaagagatcctaagtgagaatgatatataaacaaatagataaataaatcaatggatcaattatatgctacatggaggattctaacccaacgcatatatttttttcaaagatgatgcagtcatccaaaaagcaatgcatatacaacataacggatccaaaagcaaagaaaaatcacatttctcagtatatggaccattattccttaatttaaaaacttagactaaatataacaagcaattatatgctaattgccgtacaatatataaaccgttaaccggttctgaaaataagaacaatcaatcaaacaaaaccagaaacgaaaagtaaaactcgcaaggaaagtgtgggcggaagctcaagattcatgtgtgttgccttgcccccaacgccgggaaaaaaagtgcttttggctcccgccgggaggcccaacaaacccacggactaacacacgcgcacgcgtacagcaaagaaatggcgatggcgatgcagccatcttagcccccctcccctctccctaccctccatggccgtccctcctctgctgctcgtcgccgttgccgtagccgcgctctccatcctcgtcctcgtcgtcttcgccttccggcgatgcaggcggcggcggcaacgccacccgctgcaggccgcggcggtggccccgaccccggtcgctgtccaggatgaggacatagataggcctcttctttctgaaaatcagagcgatcactctagacagaatattagttttcttggaagttctgtaggagaaccttcgaagattcaaacaaataggagtaacacttcgcctagaagtcatgcaattgctgatacagggaggatttatcctgctgaatgttgtgttacacaaggagaaactcatgtaatcaatgttgaaaatgatacttctgaagagttccaattaggaagcacactaagacgtacaccgccaccaaaatggccaacacctgaccagaagcacagaagaagggtttctggagatgacaatcataatggaagtgttcctttgaaggataatacatatcatagccgcctggatttagaggttatagctggtccatctcatggaataagctgttctcggcagtcaagtagaccttctatgctcccaataactcttggaagggttcccccaagtgatttagtgttgaaggactctgaagtatcagggaaacatgctcagataaactggaatggaaagacattaaaatgggaacttgtggacatgggcagcttgaatggaactttcttgaactcccaggcggttcaccatccaagtgctgggtctaggcattggggtgaacctgctgaacttgcacatggtgatattataactctagggacttcatctaaactgtctgttcaaattttactgcaaaatcaacgagttcctgctggtgttggtatggcatccgatccaatggtggcacgtagaagtggaaagaaacttccaatggaagacataagcttttgccagtgtcctctgcagggtgttgaacattttgggctctttggaatttttgatggacacggtggggatggagctgctaaagctgtcagcaagattcttccagaacatctgggatacattttatctcatcctgaaacaaaagatcgagtgcaatcatgttctgatgcttctgatgttcttagatatgcttttactttgacagaagacaccattgatcatcagtacgagggatgtacaggcacagcacttcttatttggtttgaccagaataaagattgttttgcccagtgcgctaatcttggtgactctgcatgcgtcatgagtgtcaacggcaagacgatcgatatgactgaagatcaccgggtaactagcgcgaccgaaagagctaggatagcaagaactgggcagcccctgagagacggtgaagctcgtcttagcggactaaatcttgctaggatgtttggtgacaagtttctcaaggagcaggacccgcgcttcagctcagaaccatacgtgagccaagccgttcgcatcaccaaagcgtgcacagccttcgccgtcattgctagcgacgggctgtgggacgtcatcagcacgaaaagggcggtacagcttgtcgtcgagggaaaggagaggaggagctccggcgacgccacctcagcggcggccagagtagccagccgtgtgctggacgaagctcggagtctgcgaaccaaggacaacacatccgtaatattcgtagattttgacgtcctgagaagggatccctgtatctcgccagttgattgacatggcagattccggagactgcagcttcccatggatcgtcgtcttcctggctgctctattatatagctcccaagttttgttgtgttttcagtgaggtgatgtggggtaggaggcagagtgcgtgcataccgggtaatctggtgcatgccttttagagtctcctctctctctctctctctctctctctctctctctctctctctctctctctctctgtcaccctagttgatgaaccgatgatcacccatcatccaggaatggcttaacaaatctccattaactgtg

SEQ ID NO: 24991 - DNA, 2087 bp, Zea mays
aaaaataggctccccaagaacatcctaatcaaaaaaaagattagcttaaacacgcgctcgcgtacagcgaagaaatggcgatggcgatgcagccatcttagtcccctaccctgatcccctctccctctccgtctccatggccgcccctcctctggtgtttgtcgccgctgccatagccgcgctcgccatcctcgtcctcgtcctcgttgtcttcgccttccggcgatggtggtggtggtggcggcagcgccgcccgctccaggccgcggcggaggcctcgaccccggtcgctgtccaggaggaggatatatataggcctcttctttccggaaatcgggacgatcactctagacaaagtaattattttcttggaagttctgtaggagaaccttcaaagattcaaacaaataggagtaacacttcgcctagaagtcatgcaattgctgatacagggaggacttatccagatgaatgttgtgctacacaaggagaaactcatgtaatcaatattgaaaatgatacttctgaagagtttcgattaggaagcacattaagacggacatcaccagcaaaattgacaacacctgctcagaagcacagaagggtttctggagatgactatcataatggaagtgttcctctgaaggatagtacatatcatagtagcctagatttagaggtcatagctggtccatctcatggaataagctgttctcggcagtcaagtaggccttctatgctcccaataactcttggaagggttcccccaagtgatttagtgttaaaggactctgaagtatctgggaaacatgctcagataaactggaatgcaaagacattaaaatgggaacttgtggacatgggcagcttgaatggaactttcttgaactcccaggcagttcaccatccagatgctgagtctaggcattggggtgaacctgctgaacttgcacatggtgatattataactctagggacttcatctaaactatctgttcaaattacactgcaaaatcaacgagttcctgctggtgttggtatggcatccgatccaatggtggcacgtagaagtggaaagaaacttccaatggaagacataagcttttgccagtgtcctctgcagggtgttgaacattttgggctctttggaatttttgatggacatggtggggatggagctgccaaagctgtcagcaagattcttccagaaaatctgggatacatgttatctcatcctgaaacaaaagaacgagtgcagtcatgttctgatgcttctgatgttcttagatatgcttttactttgacagaagatgcaatcgatcatcagtacgagggatgtacaggcacagcacttcttatttggtttgatcaaaataaagattgttttgcccagtgtgctaatcttggtgattctgcttgcgtaatgagtgtcaatggaaagacgatcgatatgactgaagatcaccgggtagctagcgcaactgaaagagctaggatagcaagaactgggcagcccctgaaagatggggaagtccgtcttaatggactgaatcttgcgaggatgtttggagacaagtttcttaaggagcaagactcacgcttcagctcagaaccatatctgagccaagctgttcgtatcaccaaagcgtgcacagcttttgccgttattgctagtgacgggctttgggatgtcatcagcacgaaaagggcggtacagcttgttgttgagggaacggagaggtactctggtgacagcgcctcagcggctaaagtagccaaccgcgtgttggacgaagctaggagcttgcgaaccaaggacaacacatccttaatatttgtagattttgacattctgagaacagatccttgtatcgccaaatgacatgtcagattcaagacacctttccgtgaaccatcttcctggctgcttatatagctccaagttttggtccacccatccaaaaaaaaaaaaaaaagtgatatatatattcagctgtagattggcataggagcagagtccataccatgtaatctggtgcatgcttttagactctaatgcgtgcgcgctgcctgcgtgtgggtgtgtg

SEQ ID NO: 24992 - DNA, 490 bp, Zea mays
  misc_feature (379)..(379): n is a, c, g, or t
  misc_feature (425)..(425): n is a, c, g, or t
  misc_feature (447)..(447): n is a, c, g, or t
  misc_feature (471)..(490): n is a, c, g, or t
atcccagggtgggacacccaaaagggagatggacgcacggctggtaaattgcatgcatcacatataccgcacctaagataggtcgactcgggatacgaagacgacgagcgctctggacggaggcctggggacgacgaccgcgcctgtcacgtcggtcagtcaacaatagtccaatgcagcctacgcttctggtcttcttccccaggacggacccctttccatcccaacgcggaggtgaacccgcagtcttgttagttcagtagcagtcggtggtccgtgtccgttcttccattgattccagaacatttccctgcgagaagaccctgaggaagcttggaccaggcccgcccgtttgtggctgggtggaacactgagtcangggcaagacacactctgaaagtctgggtgatcctttttccaggctngctgagccacttttttggtgtntcaatgcccacactttgcactggnnnnnnnnnnnnnnnnnnnn

SEQ ID NO: 24993 - DNA, 2036 bp, Zea mays
gggaccctcgagtgggcccccgcggggcggcccggccggaattccgtccacagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcttatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgtactgaaaattttatgtttgtttcacaaaaaaaaaaaaaaaaaacccctaaaaaaaagtaaaaaaaaaaaaaaaaaaaaaaaaaaa

SEQ ID NO: 24994 - DNA, 2276 bp, Zea mays
tctcggccgggaaaaaaagaaaaaaaaaaaaaaaaaaaaaaaaggccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggtatggttctagcattttcttttgggtttcaaactagtagattttcaaattcaaggttataattgttttgaacatgcaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcttatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagctccttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgtactgaaaattttatgtttgtttcacatgcttgcttgttgattttatttcgtttggcaaaaaaaaatttcttgtttggttcagcgaaatcaatttattacctacctagtgctattgaaccaactagtttttttacaagaatatattgattttaatgatcatcaaacatcgagttgatacaagtcaacactgtgtggcaacctctaactaactcaaacgtagcctacatagttgtacgtagctcttgcttatgtagctagttttggataaaatcaaacaggcgacaacatgtgtagctcaaacctcacaaaagcaaccactccatccgttttaaattataacccaactcg

SEQ ID NO: 24995 - DNA, 1987 bp, Zea mays
  misc_feature (173)..(173): n is a, c, g, or t
cactgcaattctagagataaaatattgtagaagccgtaaccgcaaccagattaaagtcgcagcaggattaaaactacagcaaactacaacgaacaagctaaactgatatgtttaaaattacctcaatttttataaaccaatttcttaaaatctaggtgcttccaaacaagacntaaagccatcaaataatatgagtcatactattctatctctcaactactttcgtatccgacgtgttattatgctaattttgaaccaatcaaatagaaaaaagtcgatttctaacatttttttatttttttttgccatcatcaaacaaatatcacgtattaggatgtcaggagtgtacaccggacccggactgggattaggtgaacccggtccacagggtgcagctatgcgaagggcgaggattgcttataaaaggcggtgccctcgcagcccgcccgcacctttggcttttctggctttatataatcattcgttcaccctttatccatcaccacctaatttcccaacaaatttcaatctccatcgatcgattcctcccgaacccgacccgatggcctccgacgccgccgccgagccctcctccggcgtcacccaccccccgcgctacgtcatcggttacgcgctcgcgccgaagaagcagcagagcttcatccagccgtcgctggtggcccaggcggcgtcgcggggcatggacctcgtccccgtggatgcgtcgcagcccctggcagagcaagggcccttccacctcctcatccacaagctctacggagacgactggcgcgcccagctcgtggccttcgccgcgcgccacccggccgtccccatcgtcgacccgccccacgccatcgaccgcctccacaaccgcatctccatgctccaggtcgtctccgagctcgaccacgccgccgaccaggacagcactttcggtatccccagccaggtcgtcgtctacgacgctgccgcgctcgccgacttcggactccttgccgcgctccgcttcccgctcatcgccaagcccctcgtcgccgacggcaccgccaagtcccacaagatgtcgctcgtctaccaccgcgagggcctcggcaagctccgcccgccgcttgtgctccaggagttcgtcaaccatggcggcgtcatcttcaaggtctacgtcgtcggcggccacgtcacttgcgtcaagcgccgtagcctgcccgacgtgtcccccgaggatgacgcatcggcccagggatccgtctccttctcccaggtctccaacctccccactgagcgcacggcggaggagtactacggcgaaaagagtctcgaggacgccgtcgtgccgcccgccgcattcatcaaccagatcgcgggcggcctccgccgcgcgctgggcctgcaactcttcaacttcgacatgatccgcgacgtccgcgccggcgaccgctatctcgtcattgacatcaactacttcccgggctacgccaagatgccaggatacgagactgtcctcacggatttcttctgggagatggtccataaggacggcgtgggcaaccaacaggaggagaaaggggccaaccatgttgtcgtgaaataagatgatgattgatggcactggatatctggcgaatgctgctgattctggatgcagaattcgatgaggggatttagttggttgtagtatctggcgaatgctgctggttctggatgcagaatttgatgaggggatttagttggatttcaacccatagcatgccgaggacctcctagctctttccaaaccagttgtttaggtatcttttctgggtaagtcagcttcatctagtttagtctgtctgaacaaaagagtgggacatgacccaaacggaattctaatgaaaaacgagctctctatctgcaatcctattgttcttgagcaatggatgaatggcaaacgctgtatctcttcatgcaaaaaaaaaaaaaaaaaaaaaaaaaaaaaaaaaaaaaaaaa

SEQ ID NO: 24996 - DNA, 2089 bp, Zea mays
cattgggtacctcgaggccggccgagaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggccccggcgccggccgcgccttcgtcggcaacctcctcttcccttttatcgcgttcgctggcctcttcttcctcttccgccgcgcgcagggcgggcccggcgccgggcctggtggcctcggcgggcccatggacttcggccgctccaagagcaagttccaggaggtgcctgagacgggtgtcaccttcctcgacgttgccggcgcggaccaggccaagctcgagctgcaggaggtcgtggatttcctcaagaaccccgacaagtacaccgcgctcggagccaagatccccaagggttgtctcctcgtcggcccgcctgggaccgggaagaccctccttgcgcgtgccgtcgctggggaggccggggtgcccttcttctcctgcgctgcctctgagttcgtcgagctcttcgtcggtgtcggtgcctccagggtgcgcgacctcttcgagaaggccaaggccaaggcgccctgcattgtcttcattgatgagattgatgccgttggaaggcagcgcggtgccggacttggtgggggtaatgacgagagagagcagaccattaaccagctcttgacggagatggatggcttcgctggcaacagcggtgtcattgtgcttgccgccaccaacaggcccgatgtgctggactccgcgctcctacgaccagggagatttgataggcaggtcaccgttgacaggccagatgttgccggacgcgtcaagattcttgaggtccactcccgaggaaaggctttggcgaaagatgttgattttgataaaattgctagaaggacccctggtttcactggtgctgacctccaaaacctcatgaatgaggctgccatccttgctgctcgccgtgatcttaaggaaattagcaaggatgagatctctgatgctcttgagagaatcattgctggccctgagaagaaaaatgctgttgtttccgaggagaagaagaggctcgtcgcttaccatgaggctggccatgcccttgtcggcgccctcatgccagagtatgatccagtagccaagatttccatcatccctcgtggccaggctggtggactcacattctttgctccaagcgaagaaaggctagaatctggattgtacagcaggagctatcttgagaaccaaatggctgtagcccttggtggcagggttgctgaggaggtgatctttggccaagacaacgtgacaacaggagcttccaacgacttcatgcaagtgtcacgtgtcgcaaggcagatggtcgaaagatttggattcagtaagaagatcggccaagttgcgatcgggggaccgggtggaaaccctttcttggggcaacagatgtcaagccagaaggactactctatggcaacagcggatgttgtggacgccgaggtgagggaactcgtggagaaggcctactctagagcaaggcagataatcaccacgcacatcgacatcctccacaagctcgcccagctcctgatcgagaaggagaccgtggacggggaggagttcatgagcttgttcattgacggccaggccgagctgtttgtcgcttgagatgtcacaaggcttgcggtgcgtatgcttttcggtgttttgtgtcagagcgagcaatcacaaagcaatggagagcccagcttgtaggaaccacatcgatgtatagtagttgatacgcatgtactgactaatttgagcaagtaaaatgttactgctcacaattatagcacacggttcatctgtgaaaaaaaaaaaaaaaatctcgtgctaatgggctttattaggctatctccaatagatctactatgccttccggtaaattaatcttaggctcaatattaggagtaacaagagaaatatcagtacattgaattgcttcttgaattcctccatggccaaagccaaggttgggcaaaaaaaaaaaaaaaaaa

SEQ ID NO: 24997 - DNA, 879 bp, Zea mays
  misc_feature (46)..(46): n is a, c, g, or t
  misc_feature (111)..(111): n is a, c, g, or t
gctaaagttgctctctaaaaaagcagctgctgcgacaaacagggcnttacaaagtgatctgtcaagaacaaaactggcaagctgtgacagacagggctacaaagtgatctntcatgcgtcaaaaaatcttaaaacacatggctacatcagtcatatcaggttgtacaagcaaaaattgatgagtctgtctcagcataataaatacagatgctcggaatgtgtaaagataacacagacttggcatggcatatagtcaaaatttcaaaacttgaaaggagcaacgtctcgaaacttctatcacacgtcatccggcatagataacaagctgaagcagcattatcaaacttgctctcatggtatgcatttaagtgctagatgattgaacccttcgacttaatcctcatcctcaacaaccttagttcccaaacctttgagaccctccggagggatctcagctactgtgaccagagagtactgcccctccttggcgtcttcctcgtcgttcctcttgcgggcaatcctgacacggactcgcctcggaacactccggataccgctgctccagacgtgcttgttgagcttcacatcgatccgaacatcggtggtacccatggtcttctgggcgaacttcctgatctccttgatggcattcggtgccttcttcttgaaggtgcatccgtggaggcgcttgtggaggttgatggtgtactcgcgggtcaccacctcatccttgcgggtgccggcgccgcgcctcctctcggacatctccgctccgccgccggcagagcaccctcctttcttcttcgctcgggctagagggaggttgcggagtcgagattgcccggccggcctcgagggacccaatcgcccataggagtg

SEQ ID NO: 24998 - DNA, 762 bp, Zea mays
cttgcatgcctgcagatagtctaaaatgtttttcaccagcttctctgataagttgcttctctaaaaagcagctgctgcgacaaacagggcttacaagtgatctgtcaagaacaaactggcagctgtgacagacagggctacaagtgatctttcatgcgtcaaaaaatcttaaaacacatggctacatcagtcatatcaggttgtacaagcaaaaattgatgagtctgtctcagcataataaatacagatgctcggaatgtgtaaagataacacagacttggcatggcatatagtcaaaatttcaaaacttgaaaggagcaacgtctcgaaacttctatcacacgtcatccggcatagataacaagctgaagcagcattatcaaacttgctctcatggtatgcatttaagggctagatgattgaacccttcgacttaatcctcatcctcaacaaccttagttcccaaacctttgagaccctccggagggatctcagctactgggaccagagagtactgcccctccttggcgtcttcctcgtcgttcctcttgcgggcaatcctgacacggactcgcctcggcacactccggataccgctgctccagacgtgcttgttgagcttcacatcgatccggacatcgggggtacccatggtcttctgggcgaacttcctgatctccttgatggcattcggggccttcttcttgaaggtgctgcatacaattgtagattaattagtgttgactaaactgacaagatcaa

SEQ ID NO: 24999 - DNA, 4224 bp, Zea mays
caaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgccgcgcgcagggcgggcccggcgccgggcctggtggcctcggcgggcccatggacttcggccgctccaagagcaagttccaggaggtgccggtgccgcgtgtcaccttcctcgacgttgccggcgcggaccaggccaagctcgagctgcaggaggtcgtggatttcctcaagaaccccgacaagtacaccgcgctcggagccaagatccccaagggttgtctcctcgtcggcccgcctgggaccgggaagaccctccttgcgcgtgccgtcgctggggaggccggggtgcccttcttctcctgcgctgcctctgagttcgtcgagctcttcgtcggtgtcggtgcctccagggtgcgcgacctcttcgagaaggccaaggccaaggcgccctgcattgtcttcattgatgagattgatgccgttggaaggcagcgcggtgccggacttggtgggggtaatgacgagagagagcagaccattaaccagctcttgacggagatggatggcttcgctggcaacagcggtgtcattgtgcttgccgccaccaacaggcccgatgtgctggactccgcgctcctacgaccagggagatttgataggcaggtcaccgttgacaggccagatgttgccggacgcgtcaagattcttgaggtcagtgatgaactcctgccactactagcctgtaaatttgtgcttagctagcagttgatatgcttctgaactactagtagtattgaggaacttatttatagacctgcttagggcccttgccacctgccactgaagatacttgcattgattaagtgacattaatgcagttagtctagcaaagggtacttccttgcttggaaattgacaaacacagagaaaactttttttgaatatttgcaaaagttaacgtggatgctggaaacgctcatcttcttagagtgttataagatttcgttagtggaaatggtgctacatatttggcagttggctgccccttaaggccttagtcggattacatgggattagaaaaaaatatatgaagaattttaacttgctttggatttaaaccctctcaatcccatccaatccacatggattgagattaaaacgaacacacactaaatgtataagtcatcagcatgatttgttaaatctaccaatgccatggttctatgtatcgaataacagaacagagggttcatatccttgtaagattagaacatatgttgttttctagctttgtgagttcaaccgcaatgcccttaatatgtctccatctactcatgctagcctttgtaggtacaagctatactagcatgcacaatattatttaaaaaagaagtttgatttttcccagtatcctgatttcattttaaatgtatgtatacatgagcttacaagtctttttttatcaaataggtccactcccgaggaaaggctttggcgaaagatgttgattttgataaaattgctagaaggacccctggtttcactggtgctgacctccaaaacctcatgaatgaggctgccatccttgctgctcgccgtgatcttaaggaaattagcaaggatgagatctctgatgctcttgagagaatcattgctggccctgagaagaaaaatgctgttgtttccgaggagaagaagaggctcgtcgcttaccatggtaaatgttgtcaaatttatattataaccagaagtttgactcccgcttacggggctcaggttcctaatctgttgttgaactttggaatttgtagaggctggccatgcccttgtcggcgccctcatgccagagtatgatccagtagccaagatttccatcatccctcgtggccaggctggtggactcacattctttgctccaagcgaagaaaggctagaatctggattgtacagcaggagctatcttgagaaccaaatggctgtagcccttggtggcaggtgctctttctgcatactctgttcatttctgcatcattgactgttgctgctgcgcatattgatggactgtgagatgtaatcttatggtttgctgcaggcttgctggggaggtgatctttggccaagacaacgtgacaacaggagcttccaacgacttcatgcaagtgtcacgtgtcgcaaggcagatggtcgaaagatttggattcagtaagaagatcggccaagttgcgatcgggggaccgggtggaaaccctttcttggggcaacaggtatgctgctgtaactgaaatggatgttagcctggaattaggaacatactaaaactaagtgaagaagaactaggcatgtaaacttcaacaatggttgtctccatttgcttggagcccagaaatctccaccagcgtctagggaaggtcattttctacatgttcagtagtgcccacttacctggatgagcagttgagtacacgcaacttgtatactgccaattctgtcgtcatcggtttgttacaatggtgtgagagtagccacgtatctcattttgtgtggctgctgcgatcctggttgccctgcctaacacggaaatatctcgtctacattagccttttcttctcagaatttctctcttagccagtatgaatagtagtcgcacaaatgttcacaattcctagcaccagtttgaagagcaatctgacaaatattcacattttttcccccacagatgtcaagccagaaggactactctatggcaacagcggatgttgtggacgccgaggtgagggaactcgtggagaaggcctactctagagcaaggcagataatcaccacgcacatcgacatcctccacaagctcgcccagctcctgatcgagaaggagaccgtggacggggaggagttcatgagcttgttcattgacggccaggccgagctgtttgtcgcttgagatttcacaaggcttgcggtgcgtatgcttttcaatgttttgtgtcagagcgagcaatcacaaagcaatggagagcccagcttgtaggaaccacatcgatgtatagtagttgatacgcatgtactgactaatttgagcaagtaaaatgttactggtccaaaaaaaaaaaaaaaaaaaaaaatttgtctgcttttttttttttctttcatgcgtcaaaaaatcttaaaacacatggctacatcagtcatatcaggttgtacaagcaaaaattgatgagtctgtctcagcataataaatacagatgctcggaatgtgtaaagataacacagacttggcatggcatatagtcaaaatttcaaaacttgaaaggagcaacgtctcgaaacttctatcacacgtcatccggcatagataacaagctgaagcagcattatcaaacttgctctcatggtatgcatttaagtgctagatgattgaacccttcgacttaatcctcatcctcaacaaccttagttcccaaacctttgagaccctccggagggatctcagctactgtgaccagagagtactgcccctccttggcgtcttcctcgtcgttcctcttgcgggcaatcctgacacggactcgcctcggcacactccggataccgctgctccagacgtgcttgttgagcttcacatcgatccggacatcggtggtacccatggtcttctgggcgaacttcctgatctccttgatggcattcggtgccttcttcttgaaggtgcatccgtggaggcgcttgtggaggttgatggtgtactcgcgggtcaccacctcatccttgcgggtgccggtgccggcgccggcgccgcgcctcctctcggacatctccgctccgccgccggcagagcaccctcctttcttcttcgctcgggctagagggaggttgcggagtcgagatcccccggccggcctcgaggtacccaatgtatagcggcgcgagttagg

SEQ ID NO: 25000 - DNA, 1127 bp, Zea mays
caagatttgttagtggaatgttctgttccaaagggaagttggttaggctcacagtcaatagagggaatgcagaggtcaaagccaaagatttctgcagaagaggtgataggtccaccctgcgcccgacctgaacgattggaggaggagccaaaattaaaacgatatggattgggcgcaaaccgaaacagagtcccacatcagaaaccagtcctgaaacctcttgaggacgttccaacatattctactgagtttcccatcaacattatcataggtagcaaagcaccgtctatgaatgaggacgaataccagaactaccgcagggctgcaaagcagcactggtttatgatgaagcagtactatgagaaggctgctgatgctttcagggagggtaaccagaaagaagtcgattatcttatacaggaaggcaagcgctattatcagatggctcgactcgctgatgagaaatctgctagggagattatcaagcccagggaaacagagtcaaaaaatgaattttgtcttgatctgcgcaaacaagatgcaggaaatgtatctaatctcttgagactccatcttaaacagttggcaaacattccatcttttgattacctgagagttattattggtattgacgacagcagtttcaagatgggacaaagaagaagaaaggtgatgaagtatgtggaaaagaattcactccagtggactgaagaagacctcgctctgggaacatcctcatccggattaatcaggtggaaaatcggcagggataggttcatgtatacaaaggtggcgtgacacaaggtgacagaagatggatcgtagatcttaataagtgccgttttgaatcaaggtgatgttctttcggcacagggagtcatgtaattgctgcattgctgacgtaatgtaaccagcaatgcagcaattaactcgaaacgtctgcaatgtatgcacaaaaagaataccattcatggcaacttgaacatgtggacaatggtttctgatctctcaagggtcctttgcagtttcgaaaccggtttcttctttctaggttcaccattcagaacctggttttcaaaaaaaaaaaaacgaaaaaaaaacgctctgagcgccctagcgtacgcacg

SEQ ID NO: 25001 - DNA, 2362 bp, Zea mays
gtagttatctcgtttttctttttgtggctgttccgagattgagtggggtatttgaggtggggtttggagtccgtaaaaagtgacttggagaagaagctggccagctacgtccggagaagaggcggctcgccgtcgtgtaataactccagatactttttataccctaaagatcttcgtgagaggattttataccctaaagatcttcgtgagaagagacgagtgctgggagcggtgctcaactcatcagcaacccagcggtgatcttacagcttggcacagaagccagcagggacgcgcggcagtggcagttggagaagacgatcccggtgccggggctgtcagaccaccggtctctctgcctctgaggcacagccaacggatgcctcatcattgaagtcagcgagggcaaaaaaaaacggtatccatgaccagctccggaagatctgccgggcgcggtgcgccggcagtgctgctggtgctggccctacttcggcttcccgccaatgctgtccttcccactgtgtgagcggagcagcatgatgccaccgaattttttttttgttcaacttcagagccttcagtttgtatggtctaacatgtctgggcaacacttatactcgtcctgtttgtttacaaattgcgacgcacacatacagatacagtttatacaagtacgaagcaaactaccaccagacatttaccaaaagaggggttatagtcaaagccaccccttgatcttgacatttattgattgatttcctcttgtattccccgccccattgccatggttgcttccagtggtaccatagcaatgagcaagtacagcattgcacccacctacagaaaaaataacagctgctgtacagtctagagggtaatccataggccatgcctggcgctcctagattgctctatgtttcgatatcttccactgcatgtttgtcgtcatcttcgttctcttgaaggactgctcaaggtcagctgaggaccatccggtgagaccagaagaccgtccacggcttgccgaggatgaccctgcgccacggaaagatggcccagggtccgccatggacggttcagccagacgagagcggtcaccatatgacgcagtcgagctcaccaggcctgtcgtggcaggcgcaaagctctccacaaacatgccacaggatatcaaagtctcaccggaaggcatgttgatgtatgaaaccgtaccgtcctgaagatctacgcagaggagtctcttctggttgccgaagaagaccttcgtcttgagctggaaaaacgggcttatgcccagatgcgtcagggggatgatagtctgcaagtggacccagtcttcacgagccaagtccgctacccaaatatctgacactatattgctagatccatcggaatgtgtcgacaataaacggagctttccttccccctcgaatagttccaacttgtggctttttacagcatctgggatggcaatttttgagaacctctcgtctgtcaggttgagcgtcaggatttctcgagacgaataggaggaagcctcatcgagaagtagccaatacatgccatctttaacaatgactgccttcgttgccactaggagctctgcagattcatgtattgtcctccacgacggtgcgccaatagtgcagatttcaaatgtcaagaaccgcacatggtgacggatagagaccaccttgtactgttttgtggagtgcacgaatccaacaaaatattcagagtaaagagaccgtgacttgagtgctgaatctgggagcctcaaatgcttccttgttgtgggattcaagacctcagcatcgccttttatatcataggcacacaccaagccgttgcagggggctgacatgttaaacctacttgagaacacgagctccacacttctgaaattcattgtggcaggatcgaatgtgtacatgtggactaggccatgatcaagcgaggtgaaacaagcaatggactggtggtagcggcaagcattattcaggtgacggtccataaaactatgttcttcaacgcactctagccagaacttgcacacactgcggagcttgacaacatccctgccaggaagaaaagcaaggataaccccttgggcatcttgaggaatgaatactcgagatcccgtcacttcattctgcttatcaagatcatcactattacagtccatgcttaggatgcaactacaattcttctcgtgctcggcgccggcgaagggggggcaggaagacctgggcaccgtaggcggcagcgacggccgccccggcgtcgccacgagagagagaaagaaaatagctgggggcggcgatggacgaagaaaaaaaagcagactgcaccgctgcagcgt

SEQ ID NO: 25002 - DNA, 2160 bp, Zea mays
  misc_feature (2160)..(2160): n is a, c, g, or t
ctcgaagccggccgggccgggatcgtggaccactcccacggctccacccactcagccggccggccccgcaaacaacccccggctggccggttcccccggtctcggtctcggcctcggcctccctccccaatccccatccccaaatcgctttcgctccgccccggtcgccggaccatggccgcctccgcctcaaccacgctcttctcaccgtgcgccctcacctccaagctcggggcaggacacgcgtcctatggctccgtacgccgcgctaacgtgcgccggcgcggccgcctctcggtggtggccgtacaaacgggcccgcagaagccgtcgccgttgtcgtcccaggccgccgcggcggaggatgaggcggacgcgctgcagaagcttctgaagagggagtacaaatacgggtttgtgtccgacttcgagtccttctccatccccaaggggctgtcggaggccaccgtccgccgcatctcggagctcaaggcggagccggcgtggatgctggacttccgcctcgccgcctaccgccgcttcctcaccatggtcgagcccacctggagcgacaacgagtacgcgcccgtggacctgcagtctatctgctactactccgcgcccaaaaccaagcccaagctcaatagcctcgacgaggtcgacccggagctgctcaataccttcgaccgcctcggcatcccgctcagcgagcagaagcgcctcgccaacgtcgctgtcgacgccgtcatcgactccacttccatcgccaccacccatcgcgaggcgctcatggccaagggcgtcatcttctgctccatctccgaggccatccgtgagtacccggaccttgtcaggcgctacctcggcagcatcgtaccgccgggcgacaactactatgccgccctcaattcagcggtgttcagcgacggatccttctgctacgtgcccaaggacacggtctgccccatggaaatctcgacttacttcaggatcaacgacaaggagacaggccagtttgagaggactctgattgtagccgatgagagaagcactgttagctatttggaaggctgcactgcaccagcatatgactcaaatcagctccatgctgcggttgtggagcttgtgtgtgagaatggggcagagattaagtactccacggtgcagaattggtactccggtgatgaggaggggagaggaggcatttataactttgtgacaaagaggggaaggtgcaaagggcggggttcgaagatctcatggacacaggttgagacaggatctgctattacatggaagtacccaagcgttgagctcgtcggggatgacagtgttggagagttctactcggttgcgcttacaaaggattgccagcaagcagacacagggacgaaaatgatccacaaggggaaaaattcacgcagccggattatatccaagggcatctctgcagggaagtcaaggaattgctaccgtggcttggtcctgatgaactctagtgcagagaatgcttataattcttcacagtgtgactcattgttgatcggggataatgcggctgcgaacacctatcccaccattcaggtggggtgcactagtggccgggttgagcatgaggcaagcacttccaaaattggagaggatcagctattttatttccagcaaagaggggtagatcatgaaaaggcagttgccgccatgattggtggattctgcagatctgttttcgagcaccttccctatgaattcgcacaggaggtggacgcactcatgaacctgaaactcgagggatcagttggctaatttgttggctcagcgatttcgtgtaatactccatgacagccagttagctagaaaatccatgtgtacagcagtacgagaagaataaattacaggataagtatacatttcctggctggttgtaatactgaatgttgatgatgtctatggcaattggcaacgaactatgaagatgtagcagttgagcctgtttgtcttctgttgcccagtttttgctattgctgtaagcgagctcacatggctcacctatacaagaacggaaatcaacgtgttggcgttacagaaaaaaaaaaaacagtccttggtatgtcgtcaatgataacaagttgtcttaaaaaaaaaaaaaaaaagcggccctcn

SEQ ID NO: 25003 - DNA, 1833 bp, Zea mays
ctctcggttgtggccgtacagacgggcccgcagaagccgtctccgtcgtcgtcccaggccgccgcggcggaggatgaggcggatgcgctgcagaagcttctgaagagggagtacaagtacgggttcgtgtccgacttcgagtccttctccatccccaaggggctgtcggaggccaccgtccgccgcatctcggagcttaaggcggagccggcgtggatgctggacttccgcctcgccgcctaccgccgcttcctcaccatggtcgagcccacctggagcgacaacgagtacgcgcccgtggacctgcagtccatttgctactactccgcgcccaaaaccaagcccaagctcaatagcctcgacgaggtcgacccggagctgctcaagaccttcgaccgcctcggcatcccgctcaccgagcagaagcgcctctccaacgtcgccgttgacgccgtcatcgactccacctccatcgccaccacccaccgcgaagcgctcatggccaagggcgtcatcttctgctccatctccgaggccatccgcgagtacccggaccttatcaggcgttacctgggcagcgtcgtaccgccaggcgacaactactatgccgctctcaactcagcggtgttcagcgacgggtccttctgcttcgtgcccaaagacacagtctgccccatggaaatctcgacctacttcaggatcaacgacaaggagaccggtcagtttgagaggactctgattgtggccgatgagagaagcacagttagctatttggaaggctgcactgcaccagcttacgactcgaatcagctccatgctgcggttgtggagcttgtgtgtgaggagggggcagagatcaagtactccacggtgcagaattggtactctggtgatgaggagggcaaaggaggcatttataactttgtgacaaagaggggacggtgcaaagggcatggttcgaagatctcatggacacaggttgagactggatctgctattacatggaagtacccaagcgtcgagctcatcggggatgatagtgttggagaattctactcggttgcgcttacaaaggattgccaacaagcagacacagggacaaaaatgatccacaaggggaagaattcacgcagccggatcatatccaagggcatatctgcagggaagtcaaggaattgctaccgcggctggggcctgaggaaccctagtgcggagaatgcttataattcttcacagtgtgactcattgctgatcggggataatgcggctgcgaacacctatcccaccattcaggtgggttgcactagtggccgtgttgagcacgaggcaagcacttccaaaatcggagaggatcagctattttatttccagcaaagaggggtagatcatgaaaaggctgttgccgccatgattggtggattctgcagatcggttttcgagcaccttccctatgaattcgcacaggaggtggacgcactcatgaaccttaaacttgaggggtcagttggctaatttgttggctcagcgactgcgtgcaaaactccatgacagccagttacctagaaaatccatgtgtacagcagtacgagaagaatgaagtgcacgatagatatacatatacatttcctggcttgtaatactgaatgttcacattatgcctatggcaattggcaacgaagatagcagttgtgcctgcttgtcttctgtttgcccagtttttgctaatgttgtaagccagctcacatggctcggctagacaagaatgaaatcaatgcgattgtgttggcgttagctcactgtccccaccagcacagcaaagaaaaaaaaagaaaa

SEQ ID NO: 25004 - DNA, 519 bp, Zea mays
  misc_feature (489)..(489): n is a, c, g, or t
  misc_feature (507)..(507): n is a, c, g, or t
  misc_feature (511)..(511): n is a, c, g, or t
  misc_feature (518)..(518): n is a, c, g, or t
tagtccccccccccccccgagaagtctgagcttaaaccctaaacccctttctccacgatcttccttttcctctctctgcgacttgaagcaaagtttccagaaaaagagatgaacaacgtcaaagttccaaagataccaggtggtggtgccattttcgacgttgcttaaggttgggattattggtgggcttggtctctatggtgctacgcacagtctctacaatgttgaaggaggacatcgagccatcatgttcaatcgtttagtcggtattaaagataaggtttaccctgagggtacacaccttatgattccttggtttgaaaggccggtcatctatgacgttcgtgctcgaccttaccttgttgagagtacatccggaagccgtgatcttcagatggtgaaaattgggcttagggttctcacacgtcccatggcagaccagttacctgaaatctacagaagccttggtgagaactacagcgagagagntctaccttctataatcancganactttgna

SEQ ID NO: 25005 - DNA, 850 bp, Zea mays
  misc_feature (38)..(38): n is a, c, g, or t
tttttttttttttttttaaaaatcagtccaacttccanaatggagttcatggtagtattatatatcagttttcctactacatgtatcctgaactgaacaaatttgaggagcaagagggactgactgaaaaaaggaccttcctttaagccaagccgcagctgtaaaaccatacaacaaagcagaggcagagtgagacgagcggcaagagaccttgtcgacgggtcacttctcctcagccggcgcggccgccttcccctccccctcggcgggcggcttgtcggcctccgcggacagtgcctcctgacgcgcccgtaggacggcgaggacgttgacggcgggcatctgcaggcatccgaggaggtactggtaggactgcgccctggtgggcatgttctcgagctgcgcgaagtcgtcgggcccgtagagccgtccctcgtagacggcgccggtgaagtcgttgagctgcagcttccactccttctggaagtcgcggtagggcttgagcgccggcgggatctcgtcggagcgcacgaacagccacgcgttcatgccccgcgcgcacggcctcagcgcctcccaccgggtgcccgccaccgccgccgccatgtccgagttcttcgccaccaccagccgcgccgcgtcgggcagcgacgcgcggatgctccgcagctgcgccaccgtgaacccgtggcaccagatgcccgccagcagctggcacccgtccagctcgcgccgcagtgcctcctgccggaccagccccgacatcccgcggatcgacggggttaacgacgcggcacagctgcgcacggacgtcatcggcggcggaggcggcgagggttctgcctgggat

SEQ ID NO: 25006 - DNA, 1599 bp, Zea mays
cattgggtacctcgaggccggccgggcgcctcctcgtcggtaccccgcgttcccttcttcatctcttctcctcacaaggcttcctcccaccacctccagtcctccaccggaccaccacctccagtcctccaccggaccaccacctccaccactcctctctcagaacacgcgcaaaccgctcgaaccctagctggtggcgggaggcggaggtggctccgggatgacgcggcggtgctcgcactgcagccacaacgggcacaactcgcggacgtgccccaaccgcggggtcaagatcttcggggtgcacctcaccgatggctcggccatccgcaagagcgcgagcatggggaacctctccctcctctccgcgggatccaccagcggcggcgcgtcccccgccgacgggcccgacctcgccgacggcggcgggggctacgcctccgacgacttcgtccaggggtcgtcctccgccagccgcgatcgaaagaaaggtgttccttggactgaagaagaacaccggaggtttttgctgggattacaaaagctcgggaaaggggattggcgaggaatttctcgtaattttgtggtctcaagaacacctactcaagtagcaagtcatgctcaaaagtattttatacgccaatcaaatatgagcagaaggaagagaaggtctagccttttcgacatggttcctgatgagtccatggaccttccgccccttcctggaagtcaagaaccagagacctcaatgttaaatcaaccgccactgcctcctgctgtggaggaggaggtggaatcgatggagtcagatacttctgctgtcgcagagagttctggagcttctgctctcatgcccgagagtttacagcctacctatccgatgattgttccagcttatttctcgccgttcttgcaattctcagttcctttctggccaaatcaggaagatggaggcgatcttccccaagaaacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggctttccatgcaaaccctcaaacaagagctcaagcctgatcatcccctaccagcacagaaactgcattttagatggaatcctgggcaaaataagctttgctcttttttcttcttctaaatttaagatcactgagtcataaggtcactggttcgaagtagcttctccgtatttgcggggaaagcctgccctggtttctctccttcatcagaccccactcatatgggagccttcaatattgtcttttttatatatttaagattgaccgtgctcggtagcttgtatcatgtgctgtaagttatgctatgtatgaatgtacctgtagtttgtatggcacgcatggtatgccactcttatgttagcaaagtcattaatgttagtgctgatctttatggttgtaattttataaacttctaaaaaaaagtataagccagttcttttcaactgcaaaaaaaaaaaaaaaaaagcggcc

SEQ ID NO: 25007 - DNA, 1521 bp, Zea mays
aaccccgcctcctctcccctcccttcttcatctcttctcctcacaaggcttcctcccaccacctccagtcctccaccggaccaccacctccaccactccctctctcacgacacgcgcaaaccgcttgaaccctagctggcggcgggaggcggaggtggctccgggatgacgcggcggtgctcgcactgcagccacaacgggcacaactcgcggacgtgccccaaccgcggggtcaagatcttcggggtgcacctcaccgatggctcggccatccgcaagagcgcgagcatggggaacctctccctcctctccgcgggatccaccagcggcggcgcttcccccgccgacgggcccgacctcgccgacggcggcgggggctacgcctccgacgacttcgtccaggggtcgtcctccgccagccgcgatcgcaagaaaggtgttccttggactgaagaagaacaccggaggtttttgctgggattacaaaagctcgggaaaggggattggcgaggaatttctcgtaattttgtggtctcaagaacacctactcaagtagcaagtcatgctcaaaagtattttatacgccaatcaaatatgagcagaaggaagagaaggtctagccttttcgacatggttcctgatgagtccatggaccttccaccccttcctggaagtcaagaaccagagatctcacagttaaatcaaccgccactgccgcctcctgtggaggaggaggtggaatcgatggagtcagatacttctgctgtcgcagagagttctggagcttctgctctcatgcccgagagtttacagcctacctatccgatgattgttccagcttatttctcgccgttcttgcaattctcagttcctttctggccaaatcaggaagatggaggcgatcttccccaagaaacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggctttccatgcaaaccctcaaacaagagctcaagcctgatcatcccctaccagcacagaaactgtattttagatggaatcctgggcaaaataagctttgctctttttttcttcttctaaatttaagatcaccgagtcacaaggtcactggttggaagtagcttctccgtatttgcggggaaagcctgccctggtttctctccatcatcagagccttcaatattgtcttttttatatatttaagattgaccgtgctctgtagcttgtatcatgtgctgtaagttatgctatgtatgaatgtacctgtagtttgtatggcacgcatggtatgacactcttatgttagcaaagtcattaatgttagtgctgatctttatggttgtaatgttataaacttctaaaaaaaagtataagccagttcttttcaactgcaaaaaaaaaaaaaaaa

SEQ ID NO: 25008 - DNA, 1537 bp, Zea mays
ccgcccggccgggaattcatcacctcctctcctcacacggcttcctcgcaccggctccggtcctcctcccatcaccatcaccaccgtcgttcctctcacgagtcccgacacacgcaaaccgcacgaaccctggctggcggcgggatgacgcggcggtgctcgcactgcagccacaacgggcacaactcgcggacgtgccccaaccgcggggtcaagatcttcggggtgcgcctcaccgatggctcggccatccgcaagagcgcaagcatggggaacctctccctcctctccgcggggtcaaccagcggcggcgcgtcgcccgccgacgggcccgacctcgccgacggcggcgggggctacgcctccgacgacttcgtccaggggtcgtcctccgccagccgcgagcgtaagaaaggtgttccttggactgaagaagaacaccggaggtttttgctgggattacaaaagcttgggaaaggtgattggcgagggatttctcgtaatttcgtggtctcaagaacacctactcaagtagcaagtcatgctcaaaaatattttatacgtcaatcaaatatgagcagaaggaagagaaggtctagcctttttgacatggtgcctgatgagtccatggaccttccaccccttcctggaagtcaagagccagagacctcagtgttaaatcaaccaccactgcctccccctgtggaggaggaggaggaggtggaatcgatggagtcagatacttctgctgttgcggagagttctgcagcttcagctcttatgcccgagagtttacagcctacctatccgatgattgttccagcttatttctcaccgttcttgcaattctcagttcctttctggccaaatcaggaagatggaggtgatctgcctcaagaaacgcacgagattgtcaagcctgttgcagttcattccaagaatccaattaatgttgatgaacttgtgagcatgtcaaagctaagcataggggagcctggtcaggaaacggtgtctacttctctgtcgttaaatctgctggtgggtcaaaataggcagtcggccttccatgcaaatcctcaaacgagggctcaagcttgatcccgcttccgcacagaaactgcattaagaaggattccctctctttttttttctatatgtaagattgaccgtgctctgtagcttgtatcatgttgtaagttatgctatgtatgaatgtacctgttgtttgtctggcacgcatgacatgccactcatgataacaaactcataatgttagtgctgatctttatggttgtaatgttgtaaacttttctgagagaaaaaaacgtactagccagttgttttcaaaaaatgtgttgctttttgggttaaggaggaaaaaaaaaaaaaaaaaaaaaaaaaaaaaaataaaaaaaaaaaaaaaaaaaaaaaatggccaactaagcacaagaattaatccctgtcgtgggcggtaattgcctcaatgtgcccaccatgcacaataccaaacccttccgaataataaattgccccgcct

SEQ ID NO: 25009 - DNA, 3409 bp, Zea mays
agtcgttctcttgatgcgttgatcttttgaatcacatcctttgaactctataaataatcacttagtaaagttatcagtccaaataattgtgttggtcatcaatcaccaataccagtagtaaaatggatcgaggtccatttttcttacaccaacatgtgaattgttgtgggtcttgcgccgaccagacatactagctaggttgggttgggtcaggtttttttttacagattggatcaagccagatcaagtagtcggtgatcatgtctactcgagactaacccgtgatttggagtagaatagtcttcggcaaaactagagatatatcttggtaggacgtctaaggtggcatctcagtcagaagacagcgttttctctagtggggagtagtaagtatatcaacattgcgagataatcatcagttcccttttctctggtttttgttcactgagaataggttagtagttttaatctgatttacaattttttgcactgattatagttagtgcacagctagtaagtgaactcaggtccagaggagcttgcagatccagttaaaatgaatccatgctctgtagggcagatttatttgatgaaacccgtttgaagtgacaccttgaaaagagctttgtggtgtgattttctttacggtctgttcatctggtagatgcccaagacccaactattggtttcttgtcactggaaatttgatgttatttttttcctggctattttttgacgttcattaggattagggtggatttggttggctcgcgtggcccctggggagggctccaaacgcgtccactgttaaaactacttgcagtgagacgaggaaggcaagcgctagcaagttttggctggtgatgataatacccaggcaaaccaatccaaatgaacccaaacaggagttgcattgcatggttccaacttacagcactaccacatggataataactgctcaaactcagaactaagggggtgtttggtttaaagaagcaatctattctagaatttgatggaacgaactcatttctcatattattactaattattagcctacgaggaatgaaatgataaactcatctcattccacaaaccaaacaagaaagtgatgaatgagaagatgatggactaactcattcttcaaatcaaacacgccataaatttctaaagacatggtcaaatccagaatggtttggacacatcaccagccttcttctgtcctaaaatactccaacacatctggtccgctcccttatatttctgcatggctccagccataaggcaatgtttctgacgacgcccccaagttgatgttacaattcttcagcacaaaataccatacaggttattgcattgtttataatctacttacaagtcaatggtgacatgctagcatcatatccttccctggggatctagctcggggccaagacaaatgaggagaaaaagggctaaactaaagcagtcagccttcaattccaacagagatagtatgtaatcatattccattttaagatagaacacttctgaaaataatccaggactcggaactgatcaacttgaaagttcccagcattcacatagttgcccctgaaaatgaaagaatggaaacctaaccttccaaaggtgaacatgaatccatgtactatgtgacaatcagctgacggttgaattacatcatggttgcactgcgctgcagagttagcgcatggggaacaagcaggcccatgaaatttcatatcataaacagatagaagtgggtttgtctccaaagaagaacaagacatccaaatgtttctgtgaagatggaattgtcaagttattgtaatagacagaaatgaagcatgcaatgtgaactgcaagctcaaaagccatatatgcaggcgctctttctcttgcttttatagagacaagtcctttcatatccatccagtcttactaagtaaatgtgacaggcagcattgaatcatcttccccttccctggtataagcagtaaacaagcatggggtagaaactttacacagacaggtaagacagacaaaatcggaggaaatagcaaaccaagcaagcatactgaccatgatccctatgatgcgtactgcggtggcgcccgtgctgccatgctagcaaccttagcctgctgctgcgcgctatgcaccttggcagatagggcgcggtggaaaaactgttcacgggacagtgcacgcacgctcctgaggtagccgtcaaagggcacggatccttcctggattgccttgtcgagcgcgtagatggtgtcctcgagcgccaaatctgccgctgtgcactggatcatctgcctggacagcacatccgccggctcgatggcttcgtcgtcctcggtggcttggttgctgcctctcctgttgttctgcctgacccagtcctccacaacatcggtggccatcatgacgtcctgcaggcgccgctcgagcgcttccatctcctcccccatgttgcgcacaccttgagcgacgatgcctcccctgtgccgcagctcggcctggacggcgaagagggcgtcgacctcagcctcccgtgcggtgcgcagtgcggcggcgtcggcgtaggccatgtcgacgagcttggcgacggcgttgcgcttgaagacctcggcggggtcctccgtggggggcgggcggggggcgagctggggcgacgccgggaagccggcggcacccccaagcctgctgtaggagggggaaggggaggcggcgagccgtggtgggggctgggtcggcgagggattcggtggcggagcctgagcggcggcaggagggttcctggtgaagaggggcgggtcgaggccgaataggtgcgagagggatcggacgaggtcgacgaggttggaggaggggaagacccaggagcggaggtagggcgcgttggcgacgaggccggagctgtcgacaaggcggtggtggggcttgatgaccatgtctcgggtcggggagaggaagacgagcggcggggagcgcgggtagggctcgggcagccagatgacggcggggaggttgtaggaggcaccggcgtggtggatggggatggtgccgtcggcctggaggaggtgagcggcgcggccgtcgttgtgggtgaagagggcggccttgggatggagggaggggaaggcctcggccagcgccaccaggtggttgcggatgagccacttgacgtcctcggcgtacggcagcgcggacgggccccgctgggagagcgccgtgttgaggaactgctgcgcgtactgcgcgccgccggccgacgaagaaggcggcggcgaacgagccatcggatccgagatagggtttcgattccgatttgcgtatgtagttgaacaaactaaactgtatgcgtgtgtcgtgtcccggcccggcccgcgccgccctgccc

SEQ ID NO: 25010 - DNA, 1044 bp, Zea mays
cttgcatgcctgcagagttagcgcatggggaacaagcaggcccatgaaatttcatatcataaacagatagaagtaggtttgtctccaaagaagaacaagacatccaaatgtttctgtgaagatggaattgtcaagttattgtaatagacagaaatgaagcatgcaatgtgaactgcaagctcaaaagccatatatgcatacattcaaactcaagctattatagagacaagtcctttcatatccatccagtcttactaagtaaatgtgacaggcagcattgaatcatcttccccttccctggtataagcagtaaacaagcatggggtagaaactttacacagacaggtaagacagacaaaatcggaggaaatagcaaaccaagcaagcatactgaccatgatccctatgatgcgtactgcggtggcgcccgtgctgccatgctagcaaccttagcctgctgctgcgcgctatgcaccttggcagatagggcgcggtggaaaaactgttcacgggacagtgcacgcacgctcctgaggtagccgtcaaagggcacggatccttcctggattgccttgtcgagcgcgtagatggtgtcctcgagcgccaaatctgccgctgtgcactggatcatctgcctggacagcacatccgccggctcgatggcttcgtcgtcctcggtggcttggttgctgcctctcctgttgttctgcctgacccagtcctccacaacatcggtggccatcatgacgtcctgcaggcgccgctcgagcgcttccatctcctcccccatgttgcgcacaccttgagcgacgatgcctcccctgtgccgcagctcggcctggacggcgaagagggcgtcgacctcagcctcccgtgcggtgcgcactgcgcgtactgcgcgccgccggccgacgaagaaggcggcggcgaacgagccatcggatccgagatagggtttcgattccgatttgcgtatgtagttgaacaaaactaaactggtatgcgtgtgtcgtgtattctgctggcctgcctgcctccggcgag

SEQ ID NO: 25011 - DNA, 1250 bp, Zea mays
atgccagagcaaacccataggtccagtccaaatccaatccctgttgccatcagaatttcaggggcagccatggccgaaaaggagagcaacggagtgcgggtgtgcgtcaccggaggagccgggttcatcggctcctggctcgtcaggaagctcctcgagaaaggctacaccgtccacgccaccctgcggaacaccggggacgaggcgaaggcggggctgctgcgtcggctggtccccggcgcagcggagcggctgcggttgttccaggccgacctcttcgacgccgccaccttcgcgccggcgatcgctgggtgccagttcgtcttcctcgtcgccacgccattcgggctcgatagcgccggctcccagtataagagcacggcggaagctgtggtggacgcggtgcgcgcgatcctccggcaatgcgaggagtcccggacggtgaagcgagtgatccacacggcctccgtagcggccgcctcgccgctgctggaggaggaggtccccgcctccggcgtcgggtacagagacttcatcgacgaatcttgttggacttcgctcaacgttgactatcctctacgaagcgcacacttcgacaagtacatactgtcgaagctgcagtcggagcaggagctcctgagctacaacggcggcgagagcccggcgttcgaggtggtgaccctgccgctggggctcgtggcgggcgacacggtcctcggccgcgccccggagacggtggagagcgccgtggcgcccgtgtcccgcagcgagccctgcttcggcctcctgcgcatactgcagcagctcctggggtcgctgccgctggtgcacgtggacgacgtctgcgacgcgctcgtcttctgcatggagcggcgcccctccgtcgccggccgcttcctctgcgccgccgcgtacccgacgatccacgacgtggtcgcccactacgccagcaagttccctcacctcgacatcttgaaagagacgacggaggcggtggcgacggtgcggcctgcccgggacaggttgggcgagctgggcttcaagtacaagtacggcatggaagagattctggatagcagcgttgcctgtgcggcgagattaggttcccttgacgcatccaagctcggcctacagaaaggataaaagctcgaagcttactcataagcaccatggggaacttggattgttcgctgtccactatacgcgttcgaaatttggaaactataaaaaaaaaaaaaaaaaaagaaacg

SEQ ID NO: 25012 - DNA, 6067 bp, Zea mays
  misc_feature (2557)..(2557): n is a, c, g, or t
  misc_feature (3067)..(3067): n is a, c, g, or t
gctcgtgttgtcggtcctgcattgtttgtatgggagtgatgccctcatcatcctcccccacttgaattagagtcatcctcgactcaggcggtggccaagggggtggccgagcaaccctaggatgtacaaagcctttaggcccaaaaacatgcgtcgctgatttctagcagattctggatatcactttgttacaatgattctgataagccttgagattattttgatgtgggatcaattgatttggaaagcttatatccttagctttccaacgatgtctagaatgtctaaaatatggtctatatgtggcctgggcgttcatttttgtgaggaccactcctgcaacccaaactggattcgtgaataaactggatttcaactccccttgagtttggaactctattattgattgggcctttaccatatagttgacgcccatgtactcatcacaagtggtcaccaagctaggaagggtttacagagttacacaaataatctttggtaatgcatacatgttgcagacattgcaaggtgatgagttacctaagacattgaatggtcgtttcctagaagcaatatcatcctagtgtatgacaagatgcttaggaaactgatgctcgcacatcaagttgctaatggcttgtactagatgcttttggttcgctgatctttcctaaaggcaaggcatgtgttgaccaccatatgtggcacctggagatgtcggacggttcggccatgtggcctggacggtccgtgccccggatagtccgcgaggtagctcggatggtcctcgatcagattaacttaggcgagaaaacccatgtttccatgcgtgcttagccatataatcatgtgggtttatttggggaacgcctaggaatgagtcccgacctccactatatatatatatgaagtggtacgacttattggcgtataacacaatcgatccaaaccaatacaatctactttatttgcttcgttcttcatcattctaggagtaggagtaatttaggtctagattagcctttcccaaccccaaatcttcatctctatccgactctatgttgtatatggacgtcccgggcagcctaccgaccttaggcaccctctggaactctcctccatgacggggtccctcgcaaggggcgagttctagggttttctgaggaggaaatgactctgtgccatcgcggaccgtccaaagcagcgcagagaggagacactcctgcagcaaggtcatggaccgtccgatccttggccgtggaccgtccgtgttttcgcagagagcaccgcttgacggttcacctctagtgtttggccccaatcggaaccaacacattatttattaacttctccacgtcgttgaagcagggataaagattcaacaaggaacatttcctcgatgttagagatggaaaatgttaggtggtgagtctacttagatagtgataggacgcgaatcatcgtgagtccataccgtggagaatattttttagagaaatgctcttgtggagaaggctaagaagtaggggtggatacgacctggctcaactcgttaagtaactgaaccagagaattagctcgatttggctcgtttgcaagcttgagctgactcgtttagctcgcgaggtacaacaaaaaataatatgcatatccatataacaataaaatcatttgctagttaattccaaaccaattaaacaccagaaaagagtaataatgcttaaaattttatataccaagtctttcaataccaaattaataatgttcgtcgcttattagttcatccaacacaagtgtaggttttgttttgccgataaatgctagctcattcgaaccaacgagcttggctcgagctcgactcgagctggctcgtaaataaaccgagctgagatgctagctcagctcatgataaaattgaaacgagtcgagtcaaaccgagctgaccacgagtcgagcgagctaacgagccacgagtattttgtccagccctaccaagaagattggtttagtgatccaatccatgatgctaacaaaataaatagggtagattagaataaggttcaaatgatttcatattttctttggattttgaccgtggcttttgtcccccacaagttcaatcaaagagtcaatccaatcaacaacttttttcaaaaactgacttctcacaatgcaaaattgaaataacatctagacctacttttagtagtttttcggatggaagaactctgtaaatatacatttaaaatttttagtggcttgtaacggctttcaccaaacgacttttagcttttttacagctcataattcacaataaatttttcacaactcataattcataaccacctttttatagtcatagttcaaccaaacagacctcaaacacatcatgaattcctcattaccgtcctaggtgtgacacttctagttttaggccttctaaagccgtgctcagtagcgtgcatatattcatataaaacacaacactgttttatgttgtagtctgtattatttatatagtgaaatttaaaatagagaatgtgataataggtgaganaagaaggttattagagataacctgaacatttaggcccgcattggcctgctgctgagttttgatcgatgagttgtgggcgcacctgggacagaataccctatctcggtctgcccatgtgaaaaaaacagaaaagcaagcagcccaatcagccccaccaagaaaagccgaagcccaagaagcccagtgagcaccttctccactaggttagtctttagtacacggtcagccgcccgagccgggtcggagttgagcacttccccttctcctacccttcacctcccgtttgcccgcagccgccaccgcgtccccaagcactccagcgcccccgtccccgatcgacgccatggtgtcggaggccagcaagaagaaggccgcccagaagaaggccgctgccgccgcaaagaggggaggcaaggcctcggtggcgtcctcgtcgtcttcatctgcggccgcggccgccgataaggtggcgaacggcgtcgtggcgcttaagctatcagaccgcacctncaccggggtcctcgcatctcaccccctttcccgggatatccacgtgagcactcatttccgatcgaaccctcgtcttcctattctttcgtgattcgtggtgtgaatcttttacactcccgaacttaccctggacgcggaggacctagcagttaaacagtttattttttccccatactacgccacgtcagatttaggacgtttggagtcgctgcttccatcgatctccagagatctcttctgctctgttccacagcaaaccgatctctggttttgatatgcgcactgacctttgttctctgaattagattattgtttattttattagatatcgttgccccaagagggagctcaccagtccccccccccccccaacgggtggaaaattagaattatgtgttgtttgtgaataaagataggcatataaagggacaaaattaacgaatctctctgataatccagtatcattgaatattatgctatatatctgaaagcagaggtcagaaaaaatcaatcgataacgtttctctcgtggatatcttgcttttactttttttaatttggctggaacttctgctcgcactttttaactcttcctgcctctagcacaatctctatatcctgtcgcaagtactacatataccattgatcattgccttcaatgcatcgtggtccaaaataaatggatctatgtgcatcattgaaattcaacgaccatgtgaatggtagtcagttggcagatataacttggagcagactgccttgctaacagttccatgtgaagttcaagtttggattctgtgtagattgttactatgaaatacaggcagtagcttttttcatataactttttcctggcacttccttttgccattataatgaagtgagaaagaggtctttggcctcttttaaatttgaactcttgtttctatttttgggtgctgcgtctcctgttaatttgtttagccctttgctgattagtgatttcttagttccctagtaatatatgttttggatgttgcagatagagtctctttctttaacattccatggacacgaccttattgtggattctgatttggagctgaactacggaaggtaaacacataaatacataatgctaccattcagttacgagctggtatgctcttggagcatgtcacttgtaccttttatctgttatatttttatttgatatatcaggcgatacggtttgcttgggttgaatggctgtggaaaatctactcttctcacagcaataggctgcagagaacttcctatccctgaacacatggacatataccatctaagccatgagattgaagcttctgacatgtctgcactgcaagccattgttagttgtgacgaagaaagagtgaagttggaaaaggaagctgaaattttggctgcacaggatgatggtggtggtgaagcattggagcgtgtttatgagcgtctagatgcaatggatgctggaactgcagaaaagcgagctgctgaaattttatttggtctgggttttgacaaacaaatgcaagcaaagaaaactaaagatttctctggaggttggcgtatgaggattgctttagcaagagcactgtttatgaatccaacaatccttttgcttgatgagcccacaaaccatctagatcttgaggcttgtgtctggttggaagagacactgaagaaatttgaccgcatacttgttgtcatatcacactcccaagattttctaaatggagtgtgtactaacattatccatatgcaaaacaagaagctcaagttatacaccggtaactacgatcagtatgttcaaactcgctccgatcttgaagagaatcaaatgaagcagtacaaatgggagcaggaacagattgcttcaatgaaggagtacattgctcgcttcggtcatggttctgcaaagcttgctcgtcaggctcagagcaaagagaaaactcttgcaaagatggagcgaggtggtctcaccgagaaggttgttagggacagagttctagtgttcaggtttacagatgtaggcaaacttcctccacctgtgctgcagtttgttgaagtcaagtttgggtatacaccagataatctcatatacaagagtcttgactttggtgttgatcttgactctagaatcgcattggttggtcccaatggtgcagggaagagcactcttctgaagcttatgactggtgaccttgctccattagatggcatggttcggcgccacaatcacctgcgcattgcacagtaccatcagcatcttgcggacaagctggatctggacatgccggctctggcttacatgatgaaggaataccctgggaccgaagaagagaagatgcgagctgctgttggcaggtttggcctatcaggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggctgatcaaccaggttgctcaagagatttgggtgtgtgagaatcaggcggtgacaaggtgggaaggtgatatcatggatttcaaggcacacttgaagagcaaggctggtttatctgattagagggctttttccagcaaccatgagctttttaactctgtatcacgaagtcccagttttccaatagcgaactatcagagttactttattgtatcggatttcttttgacttgcattgcaacctgattaccttatactacctggaatatttatttatatatcttttgaaatgctattatgtgtaaagttaagtttcgtacccggtgacccctttgatttgtcaaagttactagattctatgatcattgtgaacatacaacttaaatttagttttcaattcaactgattttatttcttcag

SEQ ID NO: 25013 - DNA, 2325 bp, Zea mays
gccggccgggcccggaaatcctagtcttgtggtggtgtgctgtgctgtcgtctctcgccgcgcggcccgattcttcttaccccttcttcgtcaagccgcagccgtcgcctcccttcctcaccaccatggtgtcggacgccagcaagaagaaggccgcgcagaagaaggcggccgccgccgccaagaggggagccaaggtcccgaccccttcatcttcgtcctctgccgacgctaaatccatcggtgccgtggccgcgctcaagctctccgatcgcacctgcaccggcgtcctcgcctcccacccgctctccagagatatccacatagagtctctttcattaacgtttcatggccatgacctcattgtagattctgagttggagctcaactatgggaggcgttatggtttgcttggccttaatggctgtggaaaatctactcttctcactgcgataggctgcagagaactccctatacctgaacacatggacatataccatctcacccatgagatcgaggcttcagacatgtctgcactacaagctgttgtttgttgtgatgaagaaagagtgaagttggaaaaggaagcggagattttggctgcacaggatgacggtggtggtgatgctttggatcgtgtatatgagcgtctagaagctattgatgcatcaactgctgaaaaacgtgctgctgagatattatatggtttaggttttaacaagcaaatgcaagctaagaaaactcgagatttttctggtggttggcgtatgaggattgctttggctagagcactcttcatgaatccaacaatccttttgcttgatgagcctacgaatcatcttgatcttgaggcatgtgtctggttggaagagacgctaaagaaatttgaccgcatactggttgtcatatcgcactcccaggactttctcaatggtgtgtgcactaacatcatccatatgcagaacaagaagctaaagttatatactgggaattatgaccaatacattcagacacgctccgagcttgaagaaaatcagatgaagcagttcaggtgggagcaggagcagattgcatcaatgaaggagtacattgcacggtttggccatgggtctgcaaagcttgcacgtcaggctcagagcaaggagaaaactctggcaaagatggagcgtggtgggctcaccgagaaggttgttagggacaaaatactggtcttccgcttcacaaatgttggcaaacttccaccaccagtgcttcagtttgttgaggtcacgtttgggtacacaccagataatctcttgtacaagaagcttgactttggtgttgacctggactctaggattgcattggttggtcccaatggggcagggaagagcactcttctgaagctgatgacaggtgagctggttccattggacggtatggtgagacggcacaatcacctgcgcatcgcacagttccaccagcatctggcagagaagctggacctggacatgtcggccctgcaatacatgatgaaggaataccctgggaacgaagaagagcggatgagagccgcagttggtaagtttgggctgtcagggaaggctcaggtgatgccgatgaggaatctgtctgacgggcagaggagccgtgtcatctttgcgtggctggcatacaggcagccgcagctattgctgctggacgagccgacgaaccatcttgatatcgagaccatcgactccctagcggaggcgctgaacgagtgggacggcggtctggtcctggtgagccatgacttcaggctgatcaaccaggttgctcatgagatctgggtttgtgagaatcaggcagtgacaaggtgggaaggcgatatcatggatttcaaggagcacttgagaagcaaggcttgtctatcggattaagggaaggccttggctttccttaccttctctttggagatgtattatcccttgtataattatgtattattataggccctccaagttttactagtagctagctgatcatctgagcaagtacctctgtatctgtatcctgctgagtctcataataagaagcgaaagttttgtagtactaacgtaattgtcacggcaggaagtgccatggagagcaaggatgcgggagaagagaggctgggagactgaagaagcaggaagtgcgtggtgtgcgtgctgttgggctcaatgtgtgtgggcgtgagtttggtgggttcggcccatgtaagtgacctataattctgtagcgaactgagaataaggcagacaagccatagaaccagagaaaagttcccaaccgtaacactggcagcgtacctggcggctgcag

SEQ ID NO: 25014 - DNA, 2084 bp, Zea mays
  misc_feature (39)..(39): n is a, c, g, or t
  misc_feature (43)..(43): n is a, c, g, or t
  misc_feature (87)..(87): n is a, c, g, or t
  misc_feature (117)..(117): n is a, c, g, or t
cggcgtcctcctcgtcgtcgtctgccgccgccgccgggntgcngaacaaggcggcgaacggcgtcgcggcgctcaagctatcggacnggacctgcaccggcgtcctcgcgtctcacncgctctcccgccctcgccgcatagagtctctctctttaacattccatgggcatgaccttattgtggattctgagttggagctgaactacgggaggcgatacggtttgcttgggttgaacggctgtgggaagtctactcttctcacagcaataggctgcagagaacttcctatccctgaacacatggacatataccatctaagccatgagatcgaagcttctgacatgtccgcactgcaagctgttgttacttgtgacgaagaaagagtgaaattggagaaggaagctgaaattttggctgcacaggatgatggtggtggcgaagctttggaacgtgtttatgagcgtctagatgcaatggatgctggaactgcagaaaagcgggctgctgaaatattgttcggtctgggctttaacaaacaaatgcagacaaagaaaactaaagatttctctggaggttggcgtatgaggattgctttggcaagagcactttttatgaatccaacgatccttttgcttgatgagcccacaaaccatctagatcttgaggcttgtgtctggttggaagagacactgaagaaatttgaccgcatacttgttgtcatatcacactcacaagattttctaaatggagtgtgcactaacattatccatatgcaaagcaagaagctcaagttatacactggtaactacgatcagtatgttcaaactcgctctgagcttgaagagaatcaaatgaagcagtacaaatgggagcaggaacagattgcttcaatgaaggagtacattgctcgcttcggccatggttctgcaaagcttgctcgtcaggctcagagcaaagagaaaactcttgcaaagatggagcgaggtggtctcacagagaaggttgttagggacagagttctagtgttccggtttacagatgttggcaagcttcctccgcccgtgctgcaatttgttgaagacaagtttgggtatacaccagataatctcatatacaagagtcttgactttggtgttgatcttgactctagaatcgcattggttggtcccaacggggcagggaagagcactcttctgaagcttatgactggtgaccttgttccattagatggcatggttcggcgccacaatcacctgcgcattgcgcagtaccatcagcatctggcggagaagctggatctggacatgtcagccctggcttacatgatgaaggaataccctgggactgaagaagaaaagatgcgagccgctgttggcaggttcggcctgtcaggaaaggcgcaggtgatgccgatgaagaatctttctgatgggcaaaggagccgcgtcatctttgcatggctggcatataggcagccgcaactgctactgcttgatgagccgacaaaccatctggatatcgagaccattgactcactggcagaggcgctgaatgagtgggatggtggtttggtcttggtgagccacgatttcaggctgatcaaccaggtcgctcaggagatctgggtgtgtgagaatcaagaggtgacaaggtgggaaggcgatatcatggatttcaaggcacacttgaagagcaaggctggtttatctgattagaatgcttgtctagtaaccatgaactttttaactctgtatgatgaagtccctgttttccagtagcgaactatcaaatatactgttagggatagtttgggaaacacaaatccggagtggattggaggggctagaatcccctttttattcaattttgaatcagaagggtattctatcccttccggttttctccggttttctggctcccaaactagcccttaatgtgtccgactccttaagacttccctcgcaaccatactaccttatactacctggaatttttatttatatatatttgaaatgttaaaaaaaaaaaaaaaaccgcccacgcgtccgcccacgcgtccgcccacgcgtccgtctagatcgcga

SEQ ID NO: 25015 - DNA, 2862 bp, Zea mays
gtacgccgcgcctcccattacctagaacctcctcatcgatcaacatatcccgtgctcgtgcggtcgtgcccccactccctggcatagcacgcgatggccaccgactgctcgacgcaattctccagccgctgatcgcgccgcaccctttcccacccgcgcccatcatggcctcctccctccccgcgccgccggcctcgccctcttcctcctggcgcggactcacgccccgctgccctccgcctcgctgcggtcccctcctcgcctgcgcggcagcgcgttcttaccgttaccgcttccgaaccgacgacgacggcgtggtggacgtggccgtcgccgggaaagacggcgatgcggggtatgtggtcgctatcgaggctcctacccatggacagaggggcggtcttgtgctccgccccgccggctccggctccggcgtccctctggccccagccgcgccgggaggtgccctcgtggctgagttgtcctacgacgtggcccgcgcgccgttccacgtctcgttcacgctggccgacgcgatgggagcggagatacggacacaccgcgggacgagcttccgcgtgcctgttggcgtcggacggggctgcccctcgccgctcggcctgtcccagtccaaggatggggccgctaacttcgcggtttacagcaagatcgccaagggcatggtgctctgcctcttcggtggtggcggcggggacggacccgcgctggagattgagctcgacccgtacgtccaccggaccggcgatgtctggcacgtctcgatggagagcgtggaggggtacgcccgctacggcttccgcagcgggctgttcgcaatgtttggcattgaccgcccgctactcgacccgtacgccaaggtgatcggggacttcgtcgctggcgactctgttgatgaggatgggctagctgtgccatccataaggtgtctcgcgtccttgaagaatgcacccaactacgattggggcagggacaagcacccatgcttgccattggagaagctggtggtctaccgggcaaatgtggctttgttcaccaaggataggtcgagtcggctggcagacaatgccgctggtactttctccggcatgtctgcaaaggtggaacacttcaggcatcttggtgtcaatgcagttttgctggagccagttttcccattccaccaagtgaagggaccatattttccataccattttttttcacctatgagcttgtatagcagtgaatgctccagtgtttcagctatcaagtctatgaaggatatggtcaaaacaatgcacagaaatggaatagaggttctcttggaggttgttttcacgcatactgctgaaggaggggcggagtgtcagatgatatcacttcgaggcatcgatggttcctcgtactacattgctgatggaatcgctggatgcaaggcaagtgtgttgaattgcaaccatccagtgactcagaagctgattttggacagcctccgccattgggtgctcgacttccatgttgatgggttctgcttcatcaatgctcctttcctcgtcagaggtccaggtggtgagggcctctcacggcctccacttctggaagccatagcatttgatcctgttctttcaaagactaagatcattgcagatccttggtctccgcttgacatatctaatgtgcaatttccattccctcattggaaaagatgggctgagatgaacacaagattctctatggatgtgcgcaagtttcttaagggagaagcacttatcagtgatcttgctacacgtttgtgtggcagtggggacttattttcctcaaggggcccagcattttcgttcaattatgtatccaggaattctggactcactcttgttgatctagtgagcttcagcagtgatgagcttgcttctgagttcagctggaattgtggtgaagaaggaccatcggagaacaacgcagtccttcaaaccaggctaagacagatacgcaacttcttgtttattctattcatttcccttggtattcctgttcttaacatgggggatgaatgtggaaactcagctgctggttcaacatcatacaaggatagagggcctctgaactggaaagccttgaagaccgcttttgttaaggaagttaccgggtttatttcgtttctatctgcactaaggagtcgacgagcagacattttccagagatgcgagtttctaaaacttgaaaatatacattggtatgggagtgatttatctgagccatgttgggaggatcctactagcaactttctttgcctgcacataaatgcagagctggacgagaagctaccagattcgactggaggtgatttgtatatctgtttcaatgcaaacgaggagtcagcgagtgctactttaccagctattgcagaaggatccatgtggctgcgcttggttgatacatcacttgcatttccaggtttcttttccagagggtctagtcatgaaacacaccaggtgctaggattttcctcatatcaagtgaaggcacatagctgtgttttgttcgaatccaagagggttctttcatagtttgtgatgtcaaacatgaagctcgtgtggtttcagcaataattaggaactttgtggttactatattactatctaattttaggaggccctcagttccaataaattgccaattgtagatggaatgtttatgataataaagttcctcattttcatagaaaaaccaaaaaaaaaaaaaaaattactgcatttttgtaacctaaactccgtgagatgtgagctgatagcttcatttgccctgttggtgaatttgtctttactaatggatacaatgcttaacaaaaaaaaaaaaaaaaaaaaa

SEQ ID NO: 25016 - DNA, 2793 bp, Zea mays
tccctttccgcgcgcgctccccaaggtgagatcagcatctccgtctcttccccgccgctcctcactcccctaccgccacccctaaaactagccccattcccttaccagcgtccgatcacactcctcggtcccacgcttggatggattccgtcggtacaaatcggcccccgctgcgccccgttgccgccgcagctactcgacgcggcgcgcttcctgccccccctagccacctcgggctcggctaatcgttttgcggagactaagcttgggatcgcgtcagggtgtggaggagggggagggtattttggaaaggtacagggatttgatgccttgcggagtaccacgacgaaagttcagagcgggaaggcggggaggagtgtgaccaaggaaatgggacacacttcatctggcaatgaagtgcccttgaaatattcttcaggcaaagccttccccctaggagtgtcacaagttgacgatgggttaaattttgcaatattctcacaacatgcttcttctgtcaccctttgcttgaattttcctgagagaggcaaccaagatgatgtggacattgtagagtttgctttagaccgccagaggaataaaactggagatatatggcatgtgtcagtggagggtttgcctgcttctggtgttctttatgggtatcgcattaatggtcctcaagggtggcaacaaggtcatagatttgatgacagcgttattcttctggacccctatgcaaaattagtttatggtcgaaagcactttgctgttgaaaaagagaagccaagccagcttttcggaacatatgatttcgatagctcaccttttgactggggtgacaattataagcttcctaatttgcctgagacagatcttgttatatatgaaatgaatgtccgtgccttcactgccgacgagtcaagcaggcttgctccagctattcgtggaagttaccttggtgtcattgataaaattcctcatttgctggaacttggcgttaatgcagtggaactacttcctgtttttgagttcgatgagctggagttgaagaggttccctaacccaagggaccacatggtaaatacatggggatattctacaatcaacctttttgcgcccatgagtcgttatgctagtgctggtggtggacctgtggctgcttccaaagagctcaaacagatggtcaaggcatttcataattctggaattgaggttattttggatgtagtttacaaccatacaaatgaagctgatgatgttaacccttacatgacttcctttcgtggtattgataacaaggtctattacatgttagatctcaacaacagtgcacagctgctgaacttctcgggttgcgggaatacactaaactgcaaccatcctgttgtcaaggagcttgtacttgacagtttaagacattgggttaaggagtatcacatagatggatttcggtttgaccttgcgagtgttctttgtcgtggaccagatggcagtcctcttgatgcacctccacttattaaggaaattgccaaagactctgtattgtctagatgtaagatcattgctgaaccttgggactgtggtggcctttatctagtagggaggttccctaattgggacaggtgggctgaatggaacgggaagtacagagatgatattcgaagatttattaagggagatcctggtatgaagggggtgtttgcaactcgcgtttctggttctgcagatctctaccaggtgaacaatcggaagccttaccatagtgtgaactttgtaattgctcatgatggatttactttatgtgaccttgtttcatataactccaagcacaatgatgcaaatggagaaggtggtcgtgatgggtgcaatgacaactacagctggaactgtggcattgaaggagaaacaaatgatttgaatgtgctaagtcttcgttcaaggcaaatgaagaacttccatgtggcattaatgatttcccagggtactccaatgatgctgatgggagatgaatatggtcacacacgttatggaaacaacaatagctatggacatgatactcacataaataattttcagtggggccagttggaagaaaggaaggatggccatttcaggtttttctcagagatgatcaagtttcggcataaccatcctatattgagacgagacaggtttctcaacaaaaatgatgtcacttggcatgaaaatcgttgggagaaccaggacagcaaatttttggcatttacgatacatgatcacagttctggtggagacatctatttggcattcaatgctcatgagtattttgtggatgctgtaattcccccaccaccacaccataaatcttggagtcgtgtggtggataccaacctggaatcaccaaaggatattgtcccagaaggggtgccattcacaggttcagggtacaggattgctccctactcttccatcttgcttaaggcaaagccttagaaagttagaatggctgagacaagtcattctcaagagaagccatggttgcaacaagtatactcatccagatattgtccataagacaataacaacatggcaaacacaagtaatttccacacatcgtagccagaagagcctttcattaggggaagctagtattcacagtctccttaatattttagcattcctttgttccatatttgtgttgtacttagattctattaagctatttctttcatcgaacatatgttggacaatggatgccccagaaccttttgctttcattaaaaaaaaaaaaaaaaaaaaaaaaaaaaaaaa

SEQ ID NO: 25017 - DNA, 2071 bp, Zea mays
gcacgagaccattacctagaacatcctaatcgaaaaattaaaccaccgagctgggcgcctccccgtggcgctcgcggccgcattagcgcggagatcgagagacaagagagggaaggcggcggcttgccggcttaagccttctctccctccgtcgtcgcctcctccttacgtccgcttcttcctcctgaatggagacgtcagcgccgcccaatgcccccgctccgccggcgcagccacggaggcggttgccggacttccagcagtcagtgcggctcaagtacgtgaagctggggtaccactacctcatatcccacgggatgtacctgctgctgtcgccgctgatggcgctcgtcgccgtgcagctctccaccgtctccccgcatgacctcgccgacctgtgggagcagctccgcttcaacctcctctccgtcgtcgcctgctccacgctgctcgtcttcctctccaccgtttacttcctcacccgcccgcgccccgtgtacctgctcgacttcgcctgctacaagccggagtcggagcgcaagtgcacgcgcgagaccttcatgcactgctccaagctcaccggatccttcacggacgagaacctcgagttccagcgcaagatcctcgagcgctccggcctcggcgaggacacgtaccttccccccgccgtgctccgggtgccccctaacccgtgcatggacgaggcgcgtaaggaggcgcgcgccgtcatgttcggcgccatcgaccagctgctcgagaagaccggtgtcaggcccaaggacattggcgtcctagtggtcaactgcagcctgttcaacccgacgccgtcgctgtcagccatggtggtgaaccattacaagctgagggggaatattgtgagctacaacctcggcgggatgggctgcagcgccgggcttctgtccatcgacctcgccaaggatctgctgcaggtgcaccccaactcttacgccctggtgatcagcatggagaacatcacactgaattggtactttgggaacaaccggtccatgcttgtgtcgaattgcctgttccggatgggtggcgcggccatcctgctctcgaacaggcggtctgacaggcggaggtccaagtatgagctggtgcacacggtgcgcacgcacaagggcgccaacgacaagtgctttggctgcgtgacacaggaggaagatgagattggcaagattggcgtgtcactgtccaaggacctcatggcagtggccggagacgcacttaagaccaacatcaccacgctggggccgttggtgctcccattatcagagcaacttctcttcatgggcacattgattgccaagaaggtgctcaagatgaagatcaagccatacatccctgacttcaagctggctttcgagcacttctgcatccacgctggcggacgcgccgtgctggatgagctggagaagaacctggagctcaccgactggcacatggagccatcgaggatgaccctgtacaggtttggcaacacatcaagcagctcactctggtacgagctggcgtacactgaggcaaagggtaggatcaggaagcgcgacaggatctggcagatcgcatttggttctggattcaagtgcaacagcgccgtctggaaggcactccggacggtgaacccggccaaggagaagagcccctggatggatgagattgacaacttcccggtggatgttccaaagatttcaaaggttggtggcgcttgaagaaccattcttcttattattaggtggcaagtggagttgggtgattgtcaggggctgggcagagatttattccatcgtttccaccgttggttcttgtattcagttgtagcatggcatctgtgaaggaacttgagtagatgattcggttaggtagaaagggtgtgttcttcggctcgctagggttgtctgaatgcctgatatgtcctatttattcagattggagagagcaatcgatttgcattctttgctgcctgattgagatgttcacattgcaggccaacttaaacttgtaattcccctatccaattgattggttctgttctaaaaaaaaaaaa

SEQ ID NO: 25018 - DNA, 1389 bp, Zea mays
atcccggtttcgcgataccccctccctgctccctcctcccctcccctccgatcaagtcggggcaacgcgcatcactcgctttaaatccgcacctcccggcgtctccctcctcccggccggtccccttatcacctcaccttctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacagaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctggggcggccgcacgagtactttacgcatcaaaaaaaaaagaaaaaaaaataaaccattttc

SEQ ID NO: 25019 - DNA, 1397 bp, Zea mays
attgggacctcgagccggccgggaaacccctccgatcaagtcggggcaacgcgcatcactcggggtacctcgaggccggccgggaaatccgcacctcccggcggctccctcctcccggccggtccccttatcacctcaccttctcctctgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttcgtcatcggcggcggcggcgcctgttcttagaggataaggttgtcgtagcggagagggagctagccaggattttggttgagatcaggagggggagcaggcggcggcggcggcgatggggcgcggtaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagtagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagagccagcttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcatgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttccccgtttatccgcctggtgcagtatagtatcatcgtgatcgcgagtcagcagcagtgggtttgccgtatctttttttttaccactgtatgtctatatgtaagtatcaaatctgcaatgtgttaatcaccatttccgctggggcggacgcacgagtatcaaatctgcaatgtgcagcatcaaatattccattttcatgagcaaaaaaaaaaaaaaaaaagcggcc

SEQ ID NO: 25020 - DNA, 1483 bp, Zea mays
caatgccagttcgacagcggcggcccggccgccatcccggtttcgctataccccctccccctccgatccgtcgcggcagcgctcatcaccgctttaaatccgcctcctcccagcgtctccctcctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgcacggtactttacgcatgtaatatatgtgcttcatcaaatcactttcactaccatagcatgtgccggtttgtggtagtttcatgtctcacataatgggtacacattcatatcccagtggtctcggttcttcaaaaaaaaaaaaaaaaaa

SEQ ID NO: 25021 - DNA, 3286 bp, Zea mays
cctcgcggccggccgggcctttgcgcaaaagagtactctctccctcctaccacacacagcctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaacgtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtacccgtataatcaccctgcaattacctgtagctggtcatcgttaggagaaactccagtccatgcaaatgaactcccagcacttgtgctcttcgcggtatgccacgtcgttctttgcagtaggaacttcgatgcgaatgtagcaatagcatacggagcagcaatggaggctaaaactgaagatgctccaagataaagagggcgttcttggcgtccacgggggagagactttaatggtgatgtaggttcaagccaaaggatggcttgttctagtttaaaatatgtttgatctatttttaaaggaactattggaaaaggagttaaaattttatccacgattttttttgaaatgctactaaaaactggttattaggagtcattttttgggacctcttagagatccttttaggcttttaacgaacgaggcacccactagcatgcatcaagcacctctcctgctttatacaggaacataattgccctcatgtctgcagatgatagcgagatgagacatgatgacactttagaatcttttaggctgaaaagcctaatcatgtgtggtcggttccgttctttgaatcgcgttcacctgaagcaaaatgtaatcagacctttggtttctcgacgttgcaatcagatctttactgctcaattcacaccgtttaattcagtgcagttttaacgtgcttcactttattcagcttttatataattttttttttacatgtgcgccgtcagcctgcctcgtgttaggataggatgcacggttagtagaaacggagcgcgcatgaatgcatgcaagacgcagggtcaaattattttaagctttcagggtcattttattccgtaaccagatgctacatgagacggcggcgaaccgcggccgcgagacatgggcggcggtgcagatgatgatggcttcatcatgagggtctggggctctctagcaaacaagctataggaggcgccttcagaagcgtcaggcatcttgcgtggcgcggcctcccttgcgaccaccagcaggtttcctgggaaatggtctccccatatgtcgtaggtgaactctttcttcggggaaggcgcagccgcagccgcagcagcacccacgtctctcttcacagccttgtctttcaccagattggagccaggagcacgagactgtggagctgtcggtgaagacgtgggggccaatgacggagagcgccatgcgacgggggcggtcactgcagggcttggaggtggtgatgtgattcctggtgaggctgaacgagagcgaggctgctccttagcgacttgcgaccaagttttcttcttctcatgattagcgcgagttggtgatgccgttgcctcgacatcgaatctgctctcgactttgttttcatgcttcggctctgatggcgccccagaaaaagaccagccatgtttcggggttgagctctgcgacaatggcgaagacggtgttgagttcccgctgtggctgctagaaacctcaaacttccctgccagtcctgcaccaactttccgcttccttcgtttccctttgtctcgagcaatcctgatcgtgaggttttcactggtctgcggagcttctcttgaggccttatcttccactggattacctcgggacacggataccgtcgaagttgtgtgcagttgttcatcaggtttattcttgtcatctgctctctttgagctatcaacaacactggcagggtacttctcagcaacagcttcttcagttcttttgtgttccttattagtcctggactttttgctgctttgattaaggaaaagggtcttgttaatggtacttttcttgttctcctcaaaaatggtactttttttgtcatcaatcttgatgtagtcttgagagcccactgtcaaagaatctggggcataacggacaaagaccagaataagcagtgctaaagctccaaacaagattaccaacagcttccagtgggcagatctgagataagattttctgcactggttaagcatgcagaccggaattgttgcagtcatagggatcggaaagatgccagtagtcatgaccaactcaagatctctctgaaccatagctgaagagaagtcagcttgaaaagaaatgagcattcttattgattcactcggtgctaagctaaatcc

SEQ ID NO: 25022 - DNA, 1510 bp, Zea mays
  misc_feature (934)..(934): n is a, c, g, or t
  misc_feature (941)..(941): n is a, c, g, or t
  misc_feature (949)..(949): n is a, c, g, or t
  misc_feature (967)..(967): n is a, c, g, or t
  misc_feature (989)..(989): n is a, c, g, or t
  misc_feature (1009)..(1009): n is a, c, g, or t
  misc_feature (1017)..(1017): n is a, c, g, or t
  misc_feature (1073)..(1073): n is a, c, g, or t
  misc_feature (1093)..(1093): n is a, c, g, or t
  misc_feature (1100)..(1100): n is a, c, g, or t
  misc_feature (1112)..(1112): n is a, c, g, or t
  misc_feature (1119)..(1119): n is a, c, g, or t
  misc_feature (1125)..(1125): n is a, c, g, or t
  misc_feature (1129)..(1129): n is a, c, g, or t
  misc_feature (1175)..(1175): n is a, c, g, or t
  misc_feature (1202)..(1202): n is a, c, g, or t
  misc_feature (1213)..(1213): n is a, c, g, or t
  misc_feature (1220)..(1220): n is a, c, g, or t
  misc_feature (1255)..(1255): n is a, c, g, or t
  misc_feature (1288)..(1288): n is a, c, g, or t
  misc_feature (1343)..(1343): n is a, c, g, or t
  misc_feature (1356)..(1356): n is a, c, g, or t
  misc_feature (1369)..(1370): n is a, c, g, or t
  misc_feature (1376)..(1376): n is a, c, g, or t
  misc_feature (1415)..(1415): n is a, c, g, or t
  misc_feature (1426)..(1426): n is a, c, g, or t
  misc_feature (1473)..(1473): n is a, c, g, or t
  misc_feature (1476)..(1476): n is a, c, g, or t
cagatctactccaacacctgtaaggattcctctggccgtgtggcctttccggcaactatagctagggttctccttctcccctccctccgcccgcttgctcttggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgacccagagttcgtgtacgaggaagggcagtcgtctgaatccgtgacgaacacgtcctatccgcgcccgttcaccgacaccgacgactgctccgacacaacgctcaggctcgggctaccattcttcagcnccaagtnacggaganttggcatgtccggtagcngaggggtggccgatcgcttgcncttctccactctagataggnctggattnggggagagcagcagttctggatcgggaagacccaagttaccaacgcgtcgcatcanaataaggcattttgagttcngtatgangtgtgtattctnggctctnaaagtnaganctgcttttgttataatacatacatacaggcagcatggcaatacgtnacggggtaccgctgcctgcagtccgtnacctgtctgtngtctctntttctagtactcgctataatcaccctgcaattacntgtagctggtcatcgttaggagaaattccagtncatgcaaattaactcccagcacttgttctcttcgcggtatcagatatgctacgtngttctttgcagtnggaacttcgatgnnaatttngcaatagcatacggagcaggtgcagagccttcagcaatngagggtaaaantgaagaagcccaaagaaaaaaaaggggttctttggcgtcacaggggntanactttaatgatgaagtaggtcaagcaaaaggtgg

SEQ ID NO: 25023 - DNA, 1174 bp, Zea mays
ctccccaaggtgggggtcgctttcgtactactactagttgttgtgtcttgtgtgcccatgagcctagcgttttgggatgttttcttgcccctgatggtggatccactggccgccggttttctccagctggagagccattcgtgggcgtaggacgagagagaggatcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacttcaaagtggctaacgcgaaatttgtatatataatagtgtatgcgctgcgttatcttcgttctaaaaatctgtattgtttcgttgctggcgctatatttgttggtgtattatatatatgcacttagttgttatctctattctattaagaacataatatagacacatgatgct

SEQ ID NO: 25024 - DNA, 1322 bp, Zea mays
cattgggtacctcgaggccggccggccgtttggcggtgctctctgtgaaaccatgcagttgccctatctttttcctcaccccggcccgttccatcaccctcacggcaagccctgatcacatcatcctgcttgtctctccccaacctagctccatctctctttcatctactcttccatcgatcgatccatcgtactgcgtgaggatggggaggggaaagattgagatcaagaggatcgagaacaccaccagccgccaggtgaccttctgcaagcgcaggaatgggctgctgaagaaggcctacgagctctccatcctctgcgacgctgagatcgctttgatcgtcttctctacccgaggccgcctatatgaatattccagtaacagcgtaaggtcgacgatcgagaggtacaagaaagcctctgccagcacttcaggaacagctccagtgacagatgtcaactctcttcaatactttcagcaagaagcggcaaaactgcgccagcagatacaaaccttgcagaattcaaacaggcacctgatgggtgaatctactggcaatatgactgcaaaggagctaaagggccttgaaagcaggcttgaaagaggcattgggaggatccggtccaaaaagcatgagctgctgctcgcggagatcgaatatatgcagaagagggaagcagatctgcacaatgaaaacatgttcctgcgggccaaggttgcggaggctgagcgagctctggagcaggaggcggcagaagaccagacgatgatggtgccggcggcggtccgcggggctacgacggagctgaaagcgctgccggcgtcgttcgacgcgagtggctactaccagtaccagcagcatcagcatgtggtggccgccgcctccgctgcctcctcgtcgcagtacgcggagcagccccagggccagcaggagtaccaccaccagactgccctccacctcggctaccacgtcaagatcgactccgccgccgacaaaggcttcctctaggcgctcgcgcgcatgcatgcgtgaagcgtctcatctcataatctgacgtacggacgatgggtgccggacagctaacgtaaggcacgttgtcatcgcctgaccatggagtggagtggttgttgctatatgtgcttctatatagagagaaaataaggggtagatccgcgagtacctatgtacgcaagctgtatcaaacaatattgtcatgagatatatagattgactatataaaaaaaaaaaaaaaaaaaaaaaaaaaaaaaaaaaaaaacaaaaaaaaaaaaaaaaaaaaagggcggtcgttataaaaagaac

SEQ ID NO: 25025 - DNA, 478 bp, Zea mays
acttgaacttacatatgctgtttttctttatttggcatatccacatatcccgattctgtaacggttcgacaattccattaaatattctaagttggttatgcggtatagtttatagaagtgcaccttccccgtgtgcctggatgttactcctgaaagatacttagctgctggactgttaattcatttaacaaatatcacaagatggagttgcacattaatttcttctgttctatgttatctatcttagcaatctgcatctcatactgtgttttgactcaattgatatttagtgtagtttcttgctatatatgaccatgctgcatgattttagtaatgcctcacagtctcacacttctgttcatgaagtaaatattagctaacagtacacccccaaacaatgtttctgcttaatcttgaactcgcttctttttttactttgctttgcattttcagtgagcagaaatattggacactctgg

SEQ ID NO: 25026 - DNA, 927 bp, Zea mays
tgggtacctcgaggccggccgggccgggattcacgatccggacgcgaacctcgtatcaaattcgcttatgggcagccgtcctataagcggtggggagccccgcgcggcccgggaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgatgccatgcttcaccagaccggaggcagcgttcctagcaccacctaaaagcatcagtcgcggagcttcgttttgctctccgccctgcgtagtagtaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaatgacgcgcagatcatttgctttgttttgtctgctcaaacctcgaagtcgtctatgcttttcagaccatccctttgggcatgtttggttgtctcctgatccatacgttgtcagccgtaccatagtcacattgtgctgctcttgcaattgaggaacgatgataatggagggaaaatgtttttgtaagaaaaaaaaaaaaaaaaattaagttgatgaatcttgttcagttgcggcc

SEQ ID NO: 25027 - DNA, 514 bp, Zea mays
attcggcccgtgaacaggaacgcaattgcgttcatgtttgatggccgcaggcttcgcggcgagcagacccctgatgaggtgatccaattcggctttagatcccagcattgagtggaatccttgatcgatagttcttttgcctgtgcagctggagatggaggacggcgacgagatcgatgccatgcttcaccagaccggaggcagcgttcctagccccccctaaaagcatcagtcgcggagcttcgttttgctctccgccctgcgtagtagtaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgttctcccaaaaaaaaaaaaaaaaccaaaaaaaaaaaaaaaaaaaaaaaaaaaaaaaaaaaaccaaaaaaaaaaaaaaaaaagcggcc

SEQ ID NO: 25028 - DNA, 878 bp, Zea mays
gggtacctcgaggccggccggcccggggttccgcggggccggccgggggaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaatgacgcgcagatcatttgctttgttttgtctgctcgaacctcgaagtcgtctatgcttttcagattattttgggcatgtttggttgtctcctgaatcctgatccatacgttgtcagccgcaccatagtcacattgtgctgctcctgcaattgaggaacgatgataatggagggaaaatgttttagtaagaaaaaaaaaaaaattaatccggccgatggatcttgttcagtttgtataattaggccgatgattatgcgggggt

SEQ ID NO: 25029 - DNA, 1258 bp, Zea mays
gggtacctcgaggccggccgggaggacgtcaaacagagacgatccggacgcgaactcttctcaattcgcatatgggcagccgtcctataagaggcgtaccctcgaggccggccgggaaccccaaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttatttagtggtatggtttggtactttgttctgtcatcactcgtttatctatccctaatacatgccgccatgtttgtacttccaaaaaaaaaaaaaaaaaagccgccgttttgtccgctcaaacctcgaagtcgtctatgcttttcgccccatccctttgggcatgtttggttgtctcctgatccatacgttgtcagccgtaccatagtcacattgtgctgctcttgcaattgaggaacgatgataatggagggaaaatgtttttgtaagaaatagccggtgattaattaagttgatgaatcttgttcagtttgtataattcggccgatgattttgcaggtgaattgcagctgcacgccaaacacgcagcctttgtttgttcgggattgatcttccgagatttaaaattaagttttattaaaataagcaactggacaatgaatacgcgaggattcgtgaacgtctagaataaggtgcacaatgtggtctctagcttaaacgatgtggatttctggaagaatttattttgcttagatgatgaaagaatttattttgcttagatgatgaggacttttggatggagggagtataattggggaaattataatggcatcttaaagtctccgaaaaaaagaacaaatctct

SEQ ID NO: 25030 - DNA, 3992 bp, Zea mays
  misc_feature (2534)..(2534): n is a, c, g, or t
ttacagtatttactagtttacaaggtcgaatgttcatcctttaattctctagctgtttgttaacaggattgttgatcgcacaaatctgaactgggttcaatgccagaattttcaacttgttttatttcgcttgatgtttgttaatatcagaagttggatactgatatgccttgcgcctcgcatgtaatttaacaaattgtggaaaaaataacttttttgtcatcatttggggctttgtgtcagtctgcaaggcacagaagggtcggtgacgcattaaagtgccatccgtaaagtggcaaaaaaatcgaagggtcccctaattgtggtcatcatttcatatagctgtttgtttgttatttggtctgtttccctgatgctatatcaaatgattaatcttcgaagtaatcagtatgtctagtcagttgaactttgatatgcatggcatcatctcgaaccgatctgtactaggtactacggacgctggcagaattctcatctttaggacccctttggagcaaaggaaatacgaaggattttttaaggattcattccctataggaaagttttcctacatgacccttcggaacacaggatttaatcccatcagtatctttaaatttctatggattgttcctccatacaagtttttgagaaaaataacaagaggtccaacctcttggaaactttcctatggcttctatctctctacacaaattcctgcatagcatccaaaggcaaagtgagaattttttctgcgttctcaattactataggattgcaattcatagccaactctaatcctatgtttttcctatttttgttctaccgtgtgtctaaatggggccttaagattagttaaatgtccgacactgtatctgttgaagcaccgtacctttatgtttttcgtttgttttgttctctggaatccttttttatcccacgtgattctgaatagaggtttaccttaattctgttctaccgtgggtctaatgaatagaggtttatatcctataaattttaaagatcatcatatttgtttatactgttattttttttggttggaggatatctcatgtgcatgaaactgatataggctagtaatttactattatttgtagtgtctgattttattcttttgtgccaggagcttagattgctgataattgtcagtagcttttctagtattaattactgaaagaattgttaaagttgcttgacaaagcactttattctgagtttggtaaacaacttattttctacgcgcttctcgtcctgacctaggagtgccggatttgaaaaggagaattctcactattactaattggttggggtatttgagataaggcggttgtcagacattgatctatttgatagggttctaggggctgtgtgcaaatactccactgcttaactagttttaagaggaaattttgaaagtgtatgtattatgtagtctatcaatgaattgacaggtgaccttaaatgggtaatgctttgagtttttcataggtccttttttataaattttacatgtcataaaggtatcattcctaaaagtaacttgagtcatgctttaagcgtttatctaaataatttttttaaggtgtaaaatttaaatgtgttccatttgcgattatattgggttatcaatattgcttaatttactgatcgagctgctttgtgtattgctcgaacatggtgggaattttacatgtcatattgaaaaggttacacacttttgatatcgcaatctcatgtgttatctgtcacttgactcttttccatctttataataataattgtataggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgaggtgacccaattcggctttagatcccagcattgagtggaatacttgatcgatagatcttttgcctgtgcagctggagatggaggacggcgacgagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaatgacgcgcagatcatttgctttgttttgtctgctcgaacctcgaagtcgtctatgcttttcagattattttgggcatgtttggttgtctcctgaatcctgatccatacgttgtcagccgcaccatagtcacattgtgctgctcctgcaattgaggaacgatgataatggagggaaaatgttttagtaagaaattgccggtgattaattatgttgatggatcttgttcagtttntataattaggccgatgattttgcaggtgaattgcggctgcacgccaaacacgcagcctttgtttgttcgggattgatcttccgagatttaaaattaagtgttattaaaataagtaactggacaatgaagacgcattaaatgaagcaacataaatgaggagtcgtgaacgcctaggatgaggtgcaaaatatggtttctagcttaaacgatgtggatttctggaagaatttattttgcttagatgatgaggacttttggacggaggtggaagaatttattttgcttatatgatgaggacttttggacggagggagtatagttggggagattataatggcatcaagtctcaaatagtgcgatccgacatgtgcagtagcgcgaaattaaagttagccacacgattcaagatatactcgccggtaaacagatctgtgagatatgttcagttcgctcacatccgttccaccgccagtaagaagcgaagcgagatagtcaagatctaaatctggcctacaccttttagcagcacgcaaccttgtttgtttaggattatgatcttctcagatttaaaattaagtgttattaaaataagttaagactgtttaatctaggaagattataatggcagcctttaaagtctcaaatggtgcgatcggcgatctgacatgtgccgtatagcaaaatttaagaaactcgccgatctgacatgtgccgtataacaaaatttaagaaactcgccggtgatcagttcgctcccatcccctccaccaccagtaagaagcgaaccgagatcaagtcaagatctaaatccggcttgcacctttggcttgtttgcttcgaattaaatgcagttgtttagactgttgcagatgtaatctataaagacaaatattgtagatcattagaagccgatatgaattaaagccacgtaaataggctccctatttattttcttctagaattatgtaatccaacttattatataagcactcctgtttgtttccttctagattatataatccagcttatggattatataagcaattagactatgtttgttttcttctagaattatataattcagcttatggattatatgaaaacatagtgcctatttatttaccttctaaattatataatttatcttaaataagttgataggtaaacaaacaatacaaattattggataaattatgtaatctagatacctagatcatgataatctatatgtcaataggtgcttatataatctataagttgaattatataatcctggaaggaaacaaacaggagcttaatgatctgtttatggattatcataatctatgtatctagattatataatcacctaataatgtgttgttggtttgtctctttacttatttaagctagattatataatctaaaaggtaaacaaatagaacattaataacccgcttatacattaacataatctaa

SEQ ID NO: 25031 - DNA, 477 bp, Zea mays
  misc_feature (473)..(473): n is a, c, g, or t
  misc_feature (476)..(476): n is a, c, g, or t
ttctgatcgtctcgtcactagcttccctcttctggatacagcagatttgtttcaggacttgtctttaggttcagatgcaaatgaagttcctatgaactttactaagcatccgtatggtcatgcaccttatggtgcatcttctcatggaagtgaaagaaggccaaacatgaatgctggcaatctgctaaatggtggagactcgattggttcatacccgtggggttacatcccagcaaactatccttctggtggctaccctgatccgaggtttggttatgaccgcaacagcaatcacagttccttttcacatctcatgaatccacacagctcacaagaagtaccaagttttgaccaattgggatataatgatcatttgtattccaaccatggattgtatggactttacgggaatgtaattgactctggtcatgcatatggaacttttggttatgattcctggaaacttgggcgangang

SEQ ID NO: 25032 - DNA, 989 bp, Zea mays
agtttaacatatcaatattattgcttcgacgcagagatgtacttacactgcataagctcttaacacatacagttgcacatctttattgctagctaacgcaaggctactttaccctacgttaagacacacaagtcacttcaagctaattaaggatgcacgacgatcttggtgttcttcgtcatgtcggtggtggcgaggccgccgcccttgccggcgagcgggaagtagaaggggtagatctcgtagcgcaccctgcagctgctgtagttgatctggcagccctgctgcgcgccgcagtagtcgccgaacctggacagcgccgtggacaggcactgcgcgcaggtcagcggcgcgaggtcccgcgtgcactgcgccagcccgtagatggacacgaacggcgtgtactgctccttgtcccgcccgagccccgcgctgcccgccgccgacgcctgcgccgtcgccttgcccatcaccttccccaccgccttctcgaacgccttcgggttgtccatggcctgcacgttcaccaggatcacgcccgcgtccgtgtccgcctgcccgaagaagttggcgttctcgtaccgcatgaagcagtagtcgtaccatatcctcgcgtcggaactgtagctgcaggtgctggggagctgcttggcggcgtcggcaaggcaggacgcgcagtcgctggcggagacgtcgccgcggcattgcgcgaggccgtagatgatgctgttgcccttgccggcggtggacgtggcgtagcccccggtggaggaggccgaggcgacgaggtcggcgaggacggagttgatgttggccacggccttgctgctgccagcgtagctgcttcctgagcagtagctgccgatggagtccgcggccatgcccagcgggagcagcagagccaaggaaacaacaagcagcatgcagcagcgcatcctgctggactccatggcagtgtagggtatgattgaatcaagctctagagttcc

SEQ ID NO: 25033 - DNA, 3011 bp, Zea mays
atcatggccatcgcgctcgcgaatggaggaaacaagccgcccgactggcaggacttcgtggggatcatcactctgctcattatcaactccacaatcagcttcattgaggagaacaatgcgggcaatgccgctgccgctctcatggcacgcctcgcccccaaggccaaggttctcagaaatggccggtggaccgaggaggaatcggctatccttgtgccaggagacatcatcagtgtgaagcttggggacatcattccagccgatgctcgtctgcttgaaggggatccactgaaaatcgatcagtctgcactcaccggcgaatcccttccggtcaccaaaggccctggtgatggagtgtactctggctccacttgcaaacagggtgagattgaggccgttgtcattgccaccggtgtgcacacattctttggcaaggccgcacatcttgtcgattcaacaaaccaagttggtcatttccagaaggttctcactgccatagggaacttttgcatctgttcaattgctgtgggaatgctcgtggagcttgtcgtcatgtacgctatccaacacagggcttaccgacccggaatcgacaatctattggtgcttctgattggaggaattccaatcgccatgcccactgtcctttctgtgaccatggcaatcggggctcatcgcttggctcaacagggagcaattactaagagaatgacagcaattgaagaaatggctggcatggatgttctttgtagtgacaagactgggacattaaccttaaacaagttgactgtggacaagagtcttgttgaggttttccaaagaggtgttgaccaagatacagtaattttgatggctgccagagcttctcgcacagaaaatcaggatgccatagatgccacaatagttggtatgctggctgatccaaaggaggctcgtgctggtgttcaagagatccattttcttccatttaacccaactgataaaagaactgctttaacctaccttgatggagaggggagaatgcatcgtgttagcaagggagcaccagagcagatccttcatcttgcccacaacaagtcggatattgaaagaagggtcagagctgtgatcgacaaatttgctgagcgtggtctgcgagcacttggtgtggcttaccaggaagtgccagatggtaggaaagagagtcctggaggaccatggcagttcattgggctcttgcctctttttgaccccccgcgccatgatagtgcagaaactatcagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattgagaaggctgatggctttgctggtgtctttccagaacacaagtatgagatcgtgaaacgcttgcaagcaagaaaacatatatgtggcatgactggggatggtgtaaatgatgcaccagctttgaagaaggctgatattggtattgcagtagcagattctactgacgcagctcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaaccagacagttggaagttagctgagatttttgcaactggagtagttcttggtggttatttggccatgatgactgtcattttcttctgggctgcatacaagactgacttcttcccgcgactgttccacgtcgaaagcctcgagaagaccgcccaggatgactttcagaagctcgcctctgccgtgtaccttcaagtcagcacgatcagtcaggcccttatcttcgtgacgcggtcgcgcagctggtcgtttgtggagcgtcctgggttcttgctggtctttgctttcttggtggctcagctgatcgccactctgatcgctgtatatgccaactgggcgttcgctgcgatcaagggcattggatggggctgggccggtgtcatctggctctacaacatcgtcttctacttcccgctggacatcatcaagttcctcatccgctatgcgctgagtgggagggcatggaacctcgtccttgagcagaggatcgcgttcacgagcaagaagaatttcggcacggaagaaagggagcgcaagtgggcgcatgcccagaggactctccacgggctccagccgccagaggcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctgtggttcgcgggaaatgaatgatggtcatatttatgatgtcggtgtggtgcttctgtcgccaactctcgaccatactaccctcaactcaccccttgtatgctgtggcattaaccacccccggcaccaccggcaggcattgatattgagagatgaggtatagtagtctgtagcctctagtagatgatgatgaattgatgatatagtacatttttgcttgctttcttgctaaaaaaaaaaaaaaaaaaaaaaaaaaaaaaaaaaaaaaaaaaaaaaaa

SEQ ID NO: 25034 - DNA, 3272 bp, Zea mays
  misc_feature (1)..(1): n is a, c, g, or t
ntttacagagagagagctcacagcccccccccccccccacgagagctagggagatgaaatgccttttgtacatgatggaaggaaacaaattacgtacatactgcaattatatctgggttctcagccttgccatggttggtcaagcccctctatgattttatcagttgattcaggtggttgattatatggtggttcagagagctcgaggtgaatcacagagtacatatagatctctccactccagtcactatgttgggaatcctcagcctttggaggaatcatgagtgcatacttcagtggttctccagtcacttatggcgtaagatttgtctttggtgttacagcacttttgccactgttccgagtagcagagaaggacaactctggcaaactgtgaagaaaataaaagattttcacaagcggaatcttcagaatctgaataaaggagttcgtgggaatcagttgtaccaaaaactggttcagttttcgtattccaagcatactactggaagttcacactgatcggcgacaaactctcgcccaaggagaagttgaaggaggatcagcgtgaacacccactgaaagagagatggagttgaatgagaaatctgaaaagaatacgcaagaggtagatgagaagttccaaaacacaaacttgtatctcaagaacttagagatggagcttcgggagttacaagtgcttcataagcaatcagatagatctgaaagttttactgtgccaacacatgcacacactggtggtgcctgcatctagctattcagatcaaagcctgacaggtaccatagggcaaagtgaagaagaaacagaagagttgagcaagatcacgctagagaataaggatattcagcttgatatcaatataagagtgtttgatggagccgaccctatggagctgcatgtttatgattttaaaggacctggtgtaaccttatcaatgtacaatagcgatgagtttattaggccttttgctaagtcctccatggatatggctctttcaaaaaagtcgtctcttcatctcagcaccaagaatacaatcatcaagaagtatgacgacaggcatggatcatctatgtttctacaagctcgcggtcacatttattaggccttttgctaagttcatggatatggctctttcaaaaaagtcgtctcttcatctcagcaccaagaatacaatcatcaagaagtatgacgacatgcatggatcatctatgtttctacaagctcgcggtgatcaacttgctattgggaaagaaactgcacgtcgtttgggaatgggtactaatatgtacccttcctctgctccgcgcagacagaataaggatgagtcaattgcttccttgccaattgatgaattgatcgagaaggctgatggctttgctggtgtctttccagaacacaagtatgagatcgtgaaaggcttgcaagcaagaaaacatatatgtggcatgactggggatggtgtaaatgatgccccagctttgaagaaggctgatattggtattgcagtagcagactctactgatgcaactcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttttatgcttcttgcgctgatatggaagtttgacttcccaccatttatggtcctgatcattgccatcctcaatgacggtaccattatgactatctcgaaggacagagtaaaaccatctccacaaccagacagttggaagttagctgagatttttgcaactggagtagttcttggtggttatttggccatgatgactgtcattttcttctgggctgcatacaagactgactttttcccgcggctgttccacgtcgaaagcctcgagaagaccgcccaggatgactttcagaagttcgcctctgccgtgtaccttcaagtcagcacggtcagtcaggcccttatcttcgtgacacggtcgcgcagctggtcgtttgtggagcgtcctgggttcttgctggtcttcgctttcttggtggctaagctgattgccactctgatcgctgtatatgccaactgggcgttcactgcgatcaagggcattggatggggctgggccggtgtcatctggctctataacatcgtcttctacttcccgctggacatcatcaagttcctcatccgctatgcgctgagtgggagggcatggaacctcgtccttgagcagaggattgcgttcacgagcaagaagaatttcggcacggaagaaagggagcgcaagtgggcgcatgcgcagaggactctccatgggctccagccgccagaagcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatctagaccatccagcagtcctacactgtgtgactgactgactgacgacgacggggtttatagaggtttcttcttatactatacaatctgtactaggtagcaataaggatcaaggaaggaacccctatatattggctgcggttcgcaggaaatgaatgatggtaatatttatgatgtcggtgtggtgcttctgtcgccaactctcgaccatactaccctcaactcacccccggcaccaccggcaggcattgatattcagagatgaggtatagtagtctgtagcctctagtagatgctgatgaattgatgatatagtacatttttgcttgctttcttgctaaaaaaaaaaaaaaaaagaaaaaaaaaaaaaaaaaaggcccctaaaggcccaaaagcaccaacaaaaagggccctttagcgcggttaaactccagcccttggccccttcatggacataaatgtgccccctgggacaaagcatggccatcacaattccccacaacaaacgagccgtccgcccacagtgccacacaccggacggcctcaagagtgaactaactaaccctagttgcgcttaagcgcactgcccactttccaaaatggaaacctgcccacccccctgctttaatgaataaaaacccgccgcgccgagagcattaatgaatattgcaccccccgccgcgagctcgcttactgactggctgctcttgggctttcgggtgcagtgaccc

SEQ ID NO: 25035 - DNA, 4083 bp, Zea mays
aattcggcacgagggttcgcatcgcttctggttcgggtctcacctctcgcgatcaaagcagtagcgggttcagtggcttggcgaaggaaaaaaaaggaggaaaaaaaaatagcaaggctgtgcagcgaggagacgactcgactccaactgggaggcgaaaaataaaaaagaggataaggcgaggcccgaccgggcggccaccgcgctcccagatccgctccgctgccgtggagatccagctcccttgcgcgcctgagcgtggacgccggcgtctcgctcccggatcccgaccttggggttgcagctgcttcagatccagcgttaccagatctgtgacccgctggcgcctgggcacatgacaccgacggttttaatggagtttgggcagcagaggccaatgaaacggggatacgaggaaatggtcttcagggcagcctcttcccgtggttatgcagagactgttggcgagtcgggagttgcagctggtagtcctcttcgtgttgattctgaggactcatctgtgccaaagcgcaagtgcatcagcctgaacagcgttggctttgatgtgaagcgggagatcttggtgccctctaagatgtcgtcatctgaacggcggtaccttcgaaagagattccgggcagagcttgattcggtgcgggatctcctcaagaagccagagtttgcagcccctgttcctctcaatcgggcacctgctttgtcatcctcagctgcacctcgagctaagaagccacagaagtctcagcgtggtgggaccaatgttatacgtggtgcaaagggacgattcttgcctacaaaaccgcggccggagacttccactgtgttatctgaagctgcagcgtttaagcagtgtgaagctattttgaagaagcttatgactcaaaagtatagtcatatattcaatgttccagttgatattgtgaagctgcaaattcctgattattttgacattgtgaagaccccaatggatcttggtactgtcaagaaaaagcttgaatctggttcatacacaagtccatcagattttgctgctgatgtccggctgacctttaacaacgctatggcttataatccgcgggggcatgctgtgcacgacatggccatccagctgaacaagatgtttgagagtcgatggaggccaattgagaagaaattggcttctgctgccactgagaaacatgttgaggttgacagggctgactcgaagaggaggaagacacctcctgtggaccgcagtgatgtgtcaatggagtgtgcacgacagacagagccagaaacaccgaagatgacagctgaagagagggaagcctttgggaactgcttggcatccatatctgatgagttacctcctcacatatttgaactgctacaacaatgcatcgacagcaatgcagatttgtctggggatggagagatagagattgacatccatgctgtcagtgatgacttgttatttgagctgaagaaacatgttgacaagtatttgcaagagaaagagcagagccagcaggtgaaatctgagccctccgagaatgaagctgtgaatgtatctggccttagccactcttctacaaatccttgcaaaggcggcgaacctatcgaagaggatgtggacatctgtggcaatgcctcacctatcatgctagacaaagatgcacaaatcaggaatagcaagtgtggtagtccaagtagttccagcagcgactctgaatcatcttctagcgattctgattcaggcagtgactctgaaagcgaatcagaaaaagttggcagccctggaaagcttgcgaaggggactaagaaacctgatcagctggtggagcaagaaaagagtgatgttattagtccagctgatgccaaccgtcctgctgctattgtggggcttcatggggaggacagtgagtcaaagcctgcaccagggggggaaaactcagaacccgatacacaagtctcaccagacaggctattgcgagcagcccttttgaggagccgttatgctgatgtgattgtcaaagctcgtggcattcttagtcagggtggagacaaacaggaggagctggaaaagctacagaaggaagagaaagagcgcttgttggctgaaggtactgcagccatggaggcttgtagagccgaagctgaagctgaaaagaagcgtaaacggaattttgagagggagaaggctcgtcaggccctacaggagatggagagaactgtagaaattaatgataacctccatctcaaggatttggaattgcttggaacagccacaacagaacatattgtaagctctgttgatgagactagtccagaacgctctcatgatggcatggccggctatcatccaggagctgtcaatcctttggagcaacttggactgttcataaaggtagacgatgaggaagacgacgagcagtgttccctgcattaaagaaagaagagaaaggagaaatcagctgatggtgctgtgtttttccatgccctgtcacgggctaggggctggtgccaacctattgatccaaagtgatcacctgttgcgggccatcatgtgtggcaatggttctaaactggggtggtgagagccgtccattttgttaaaaatatgcatgggaaggatgaagatcatcttgcatagtcatttgcttccaggaggcgcacaggaggtggagtaaaaacgaacgtatttatggtgcctagaggacggttttttcagccactgccaaaacggcttgaatgacgccaccgaagtagtggagttcaaatggctcattgtttgccgcaacctcaatttcaagcgggtttgttcagcggcttatagcttcttctctccttttgttgtctcatctgttttagattgtagaatttgggctagttgcttcctgctgtaaatccgaattttgatgtagtgacggaagtgctacctttttgttgagcatgatcgaaaagtttacaagaaaaatcgtttttttgtagatgaacgtccagtcttgtctgtagctacaatttcttgcgcaatcagtgtaacatccgttgtgtttatattctgctcgacaacgagtacggatttaagcacgtgatatcagtgaataagacggactctgggctctaattattttcatctatcgcggtttaatatcgcatctatttcatttgtcgcaagtgcgacatcgtttttatttttatctatccgggctcttccgaaattttcgtgatgttcggaacatagttgtccgaaaattggtgcgtccggtgattatttaaaattcatcgctcgcgcaaatacgaaattcggaagctcgacccactcggacgattttatcccggacaaattagtttaaactcgacgattaaaatgctcggggtaaaataattcgaatcacgtgaaatcgtgcgagaggttaggatctaatttgttctttagcccacactgtagaataatcaaatcaactgtgttttcgtgatggataattttttttatctgatttcgaccaaactagtgttgtcttaaatattgaatctgtctgtttacgtgccgttcgagaaaaacgatgcgccagctcattgtcgaattattctgtagtcgaatattcgtatagcaagcaaaattcgtctaaatataaccgaaacgaatgcaaattaaaattaattgaattgtttctctagcaaattgaccaagatggataaatcaaatattcgggtcgaaagcagatgagtttatctgatcccgagaatatccaccatagtaagcgcagtccaaaaatatcaaagttaatattgttttgtttgatttgtttgcatctatatcagactcaaatcctagagcatcagatatttctgtactcgtttgtttcagaacaaaggaaagtcttctacaaccctatccttgccatcgcttgggttttttttcagcaaacaacgctagcgctcatattcttatcttgagtcattgtcaccattcttatcctctcgtatgatttcctcttcatccagaaatcagcaattgaaatgtcactcacgcattcttctcacatacggctccttgggatatttctcggtgcacatgcccag

SEQ ID NO: 25036 - DNA, 2296 bp, Zea mays
tgacctgttccatcccgccagcccttccgctcccacgacccaaccccactgcccggagcccccgagccttctcgaatcttgcgagaaccccaggggcgaggagcagatgtcggcgaggctacgggtggcggacgtccgcgcggagcttcagcgccgcggcctcgatgtatccggcaccaagcctgctctcgtgcggaggctggacgccgcaatttgcgaggcggagaaggccgtggtggctgctgcgccaaccagtgtggcaaatgggtatgacgtagccgtagatggcaaaaggaactgcgggaataataagaggaaaaggtccggggatgggggtgaagagggaaacggcgatacgtgtacagatgtgacaaaactagagggcatgagctatcgtgagctgcagggattggccaaggcacgtggagttgcggcaaatgggggcaagaaagatgttatccagaggttgctctcggcgactgctggtcctgctgcagttgcagatggtggtcctctgggcgccaaggaagtcataaaaggtggtgatgaggaggttgaggtgaaaaaggagaagatggttactgccacgaagaagggagctgcagtgctggatcagcacattcccgatcacataaaagtgaactatcatgtcttgcaagtgggcgatgaaatctatgatgccaccttgaaccagactaatgttggagacaacaacaataagttctatatcattcaagttttagaatctgatgctggtggaagctttatggtttacaatagatggggaagagttggggtacgaggtcaagataaactacatggtccctccccaacacgagaccaagcaatatatgaatttgaggggaagttccacaacaaaaccaataatcattggtctgatcgcaagaacttcaaatgttatgcaaagaaatacacttggcttgaaatggattatggtgaaactgagaaagaaatagagaaaggttccattactgatcagataaaagagacaaaacttgaaactagaattgcgcagttcatatccctgatctgcaatattagcatgatgaagcaaagaatggtggaaataggttataatgctgaaaagcttccccttggaaagctaaggaaagctacaatacttaagggttatcatgttttgaaaaggatatccgatgttatttcaaaggcggacaggagacatcttgagcaattgactggggaattctacaccgtgattcctcatgactttggtttcagaaagatgcgtgaatttattatcgatactcctcagaaactaaaagctaagctggagatggttgaagcccttggtgagattgaaattgcaactaaacttttggaggatgattcaagtgaccaggatgatccgttgtatgctcgatacaagcaacttcattgtgatttcacacctcttgaagctgattcagatgagtactctatgataaaatcatatttgagaaatacacatggaaaaacacactctggttatacggtggacatagtgcaaatatttaaggtttcaaggcatggtgaaacagagcgatttcaaaaatttgctagtacaagaaataggatgcttttgtggcatggttctcggttgagcaactgggctgggatcctttctcagggtctgcgaatcgctcctcctgaagcacctgttactggttacatgtttggcaagggtgtttactttgctgacatgttttcaaagagtgcaaactattgctacgcctctgaagcatgtagatctggagtactgcttttatgtgaggttgcattgggcgatatgaatgagctactgaatgcagattacgatgctaataacctgcccaaaggaaaattaagttccaagggagttggtcaaacagcacctaacatggtcgagtctaaggtcgctgacgatggtgttgttgttccccttggcgaacccaaacaggaaccttccaaaaggggtggcttgctttataatgagtacatagtgtacaacgtagaccagataagaatgcggtatgtcttacatgttaacttcaatttcaagagacggtagatgttgcaaagagctgaaactgttgctgagatcttagcagaacatatgtggacttatagcaccaggtgccctcagcctcattttctgagcaaatttggtagcctttgcatttcgattttggtttcaggcttctagccccattgatgattgatactgagtgtatatatgaaccattgatatccaccttccatgtacttaagtttttttaacatgtcccatgcataataa

SEQ ID NO: 25037 - DNA, 821 bp, Zea mays
gtccttctccttcccttccctcccccaccgggccccccccccccccgcgctgcctgcccccttcgatctcctgctctctttccccttctctctctatctactgttcttgcttgagctgcgatcctcttcctgaggcgcgggcgttggatgggatacgtggttggctccgcgccatctcctccggtggcgatgagctccaagtccacctgctgctgcttatgagatcttgctgaatgaattttgtggtttttgagccatcctggtaaaccttggcatggccagtggagagacaaacgcagggaacacccagagggggaatacccttccaaatggtgacatctatgttggcaactttgctggtttagttcctcatggatttggaaagtatatgtggacagatggaactctttattatggcgagtgggatacaagcaagatgagtggtagaggagcaattcagtggccttcaggtgcttcatatgatggagatctttgtggaggtttcattgacggaacaggcagtttcaaaggagttgatggatctgtatataaaggttcttggaggatgaatagaaagcatggaatgggcacaatggtttacgccaacgatgatacttacgaaggtttatggaatgagggcttgccagatggatttggtaaatatacatgggttgatggcaacatctacattggactttggaaatctggtaaaatgaatggcagaggagtgatgcaatggacaaatggcgatactctttgactggtattggcttaatggactggctcatgggaaagtttttgcaaatatgcatcaggagcat

SEQ ID NO: 25038 - DNA, 1498 bp, Zea mays
ctccaggtaccggtccggaattcccgggtcgtcccacgcgagtgaacaactcgtcactgggataggctcggccggccgaccccagacctttccccttccgtccccggccggcgccaacgccactccagtgagccgagggcggagacggtcacggtgggcagagtgacacgccgcacgcctctccgccccgctccgctccagattgcgcgcacccacccatggcgctcgccgcttcccaccacggcctcctgcccttcgcccccgctgccacgcctaccccgtcacgggggcacctgcgcttccgcgccgcgcgccctctgccccgccccgcccggagaatttgttgccaatctatcaactcagctaatgtgttgggagcttcttcaacgacatctgatgaggcagtcccagtcccagttgtccagatagatcaggactcagaccgtgatgcgaccattgtgcagctaagttttggagatcgtttgggggcgctacttgacacgatgaaagcactcaaggaccttggccttgatgtcacaaaaggaagtgtgacaactgactcagctgtcacacaaacaaagttccacatcatgcgatttgggcgcaaggttgaggaccctgacatgttagaaaggattcggctaaccatcatcaacaaccttctccagtaccatcctgaatcaagtgagaagttagccatgggtgaattttttgggataaaacctcctgagaagaaggtagatgttgatattgcaacacatatagttgttgaagatgacggaccaaaaagaagcatactttacatagagaccgccgaccggcctggcctacttcttgagataatcaagatcatcgcggacacaaatattgatgtggaatcagctgagattgatactgaaggtttggttgcgaaggacaagtttcatgtaagttacagaggtggaaaactaaacagctccttatctcaggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgccgacaaggtgcatccatatgtgcataggtggcactgaatcggggctcactggaccagtttgatattgtagtaatatatatacagctgggagcaacataatttaggtttcgatcatcattatcccatttgattcctgttataagggatcacattggaaaaccctcacatgattgatgttgtctgtattctgtaagttggtgcaatccatttgcatgtaaaactcagctgcgtactgtggcgttctatgtagtggaataaataaaagagcattacgaaaaaaaaaaaaaaaaaaaaactgcattccgggcccggtacccaaaaaaaaaactcgagactagtctcgtgc

SEQ ID NO: 25039 - DNA, 1419 bp, Zea mays
cccctgagattgatactgaagtatgctacgtttcaccccccttgctttttatagttcctaagaccattaaagcctgttagatgatatttggcattctgtacagggtttggttgcgaaggacaagtttcatgtaagttacagaggtggaaaactaaacagctccttatctcaggtctacttccttggtcattcgagcaacatcataaccatttccttaacgttatttttttctgtcttcgttgtgttcactatgcacactttattttgctttttatataggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgccgacaaggtgcatccatatgtgcataggtggcactgaatcggggctcactggaccagtttgatattgtagtaatatatatactgagcgggctgttttagccgcgaggccggccgatgaccagcatatccttgttcagtgtgtcgcattggggctgtcgcggtgtgggcaggtcgcgtttcacgaatcggtgttacggtgtgtctgtatgggattgctaaaggagctcctcccacttcctgattttcttaggaggtcggtccaaaacgcaggagggaactcaaatgaggttatcaaggctcaggtcaataaacaccttgatagtgttcttttcaaagaggcaggcccagtgactggggttctttgcaaccagtattcatatgccaatgacaaggctaaaagctttgttgaaacttgtgtatgggggtacgcacaggagatttatcgtcatcttcgtgcagtagtgtttctgcaccgggggaagcaggatggcttgattacggcgattgacaagaatgctgaggcctcatttcttatggttgtagtctttgcagccgaggtcgctaaacacaggctaaatgctaagtcctccgaggggttccaacctgaggttgctgctagaatcttggtggcgttctcttgtgtggaacatcttaggcgactgcgtctccctgagtacactgaggcagtccggagtgctgtgcttgccaatcaagagaatgcagcagctaccgctttgttcatcgagtcaataccttcatatactgaactgacaagtaaaccagatttactggccttggatggaacaacaacatataactggtacagagatgaggttcagacatcacgcatgctgttttacttgcgggttgtgccaactttgtgtagcctcattccagttcatacgatgcaggataaactgggctcgatcatggtcttatatctacacatccaaatg

SEQ ID NO: 25040 - DNA, 1778 bp, Zea mays
acgataggctcggtcagcccaccccagacctttccccttccgtccccggccggcgccaacgccactccagtgagccgagggcggagacggtcacggtgggcagagtgacacgccgcacgcctctccgccccgctccgctccagattgcgcgcacccacccatggcgctcgccgcttcccaccacggcttcctgcccttcgcccccgctgccacgcctaccccgtcacgggggcacctgcgcttccgcgccgcgcgccttctgccccgccccgcccggagaatttgttgccaatctatcaactcagctaatgtgttgggagcttcttcaacgacatctgatgaggcagtcccagtcccagttgtccagatagatcaggactcagaccgtgatgcgaccattgtgcagctaagttttggagatcgtttgggggcgctacttgacacgtgggcgcaaggttgaggaccctgacatgttagaaaggattcggctaaccatcatcaacaaccttctccagtaccatcctgaatcaagtgagaagttagccatgggtgaattttttgggataaaacctcctgagaagaaggcaagtgcaatactgtaaggtgccgtttggttcacatattggtaacgtaatgggtaaccaataagtcaataatgttacatcatgtttgtttaagtccaaccgtaatcatatatcacactaaaaatggataccgtccattcaaacttgttaccgctggtactcgaatgtgaatcattattattactatttatgttacatttcgtgaaccaaacaacacttaaagtgtaatgcattcccattctgtaatttcagatgctgttctgtatcgtgttatctcggtttggccatctttttaactatgatctgtgagttatcactattttaggaaatggaaatttataaacagttaggctacaaatttactttgttatgctattggtttgtgcttcgacctttgatacattattaagcctgaatttgcattctttgatttatgaactggtaggtagatgttgatattgcaacacatatagttgttgaagatgacggaccaaaaagaagcatactttacatagagaccgccgaccggcctggcctacttcttgagataatcaagatcatcgcggacacaaatattgatgtggaatcagctgagattgatactgaaggtttggttgcgaaggacaagtttcatgtaagttacagaggtggaaaactaaacagctccttatctcaggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgccgacaaggtgcatccatatgtgcataggtggcactgaatcggggctcactggaccagtttgatattgtagtaatatatatacagctgggagcaacataatttaggtttcgatcatcattatcccatttgattcctgttataagggatcacattggaaaaccctcacatgattgatgttgtctgtattctgtaagttggtgcaatccatttgcatgtaaaactcagctgcgtactgtggcgttctatgtagtggaataaataaaagagcattacgaaatcaccgagcagcttgctcctgctttccaatccggtgtgcttattgtttacagtcaaa

SEQ ID NO: 25041 - DNA, 1427 bp, Zea mays
ccgctttccgttccgtccccggccggcgccaacgccaacgccaacgccactccagtaagccgaagcgaggaggtggagacggtcacggtgggcagagtggcacgactctcgattccgcctcgctccagattgctgtgctcgcccactcactcactcacccatggcgctcgccgcctcccaccaccgcctcctgcccgtcgcccccgcccccgccgccacccgtaccccgtcgcgggggcacctgcgcttccgcgcctcgcgacctctgccccgaccccgctcccggagaatttgttgtcaatctatcaactcaactaatgttttgggagcttcttcgaagacatctgatgaggcaatcccagtcccagttgtccagatagatcaagactcagaccgtgatgcaaccattgtgcagctaagttttggagatcgtttgggggcattacttgacacgatgaaagctctcaaggaccttggccttgatgtctcaaaaggaagtgtggcaactgactcagctgtcacacaaacaaagttccacatcatgcgattcgggcgcaaggttgaggatcctgacatgttagaaaggatacggctaaccatcatcaacaacctgctccagtatcatcctgaatcaagtgagaagttggcaatgggtgaattttttgggataaaacctcctgtgaagaaggttgatatcgatattgcaacacatatagttgttgaagacgacgggccaaaaagaagcatgctttacatagagacagccgatcggcctggcctacttcttgagataatcaagatcatcgcggacacaaatattgatgtggagtcagctgagattgatactgaaggtttggttgcgaaggacaagttccatgtgagttacagaggtgcaaaactaaacagctcctcatctcaggtgttgatcaattgtctgcgttattacctccgaaggcctgagacagatgaagacagctattgactgttgtgttgttgaaccttgctagtactacattaaaaccagaaacttcaaagtttggcttgagttccttctctatgagcccccctgtactgctgcaaatggagtttccattgtagctgataaagtgcaggcaaggcacatgctaatgtgcataggtggcattgaaattgggctcacagtcactgaaccagtttgatattttgtagtcatatacagctgggagcaacagaagttaggtgtcgatcatcattatcccatttggttcctgttacaagggatcacattggaaggtcatcacatgattgacattgtctgtaagttggtacaatccgtttgcatgtaaaactcagctgtggagtgtggtgttctctttggatgaaataaaaagaaagagcattacgaaatcaaaaaaaaaaaaaaaaaaaaaacacgaaaaaagcttgtg

SEQ ID NO: 25042 - DNA, 913 bp, Zea mays
ccggccgggaccccacccgctttccgttccgtccccggccggcgccaccgccagccccgccgccactccagtaagccgaagcgaggaggtggagacggtcacggtgggcagagtggcacgactctcgattccgccccgctccagattgctgtgctcgcccactcactcacccatggcgctcgccgcctcccaccaccgcctcctgcccgtcgcccccacccccgctgccacccgtaccccgtcgcgggggcacctgcgcttccgcgccgcgcgacctctgccccgctcccggagaatttgttgtcaatctatcaactcaactaatgttttgggagcttcttcgaagacatctgatgaggcaatcccagtcccagttgtccagatagatcaagactcagaccgtgatgcaaccattgtgcagctaagttttggagatcgtttgggggcattacttgacacgatgaaagctctcaaggaccttggccttgatgtctcaaaaggaagtgtggcaactgactcagctgtcacacaaacaaagttccacatcatgcgattcgggcgcaaggttgaggatcctgacatgttagaaaggatacggctaaccatcatcaacaacctgctccagtatcatcctgaatcaagtgagaagttggcaatgggtgaattttttgggataaaacctcctgtgaagaaggttgatatcgatattgcaacacatatagttgttgaagacgacgggccaaaaagaagcatgctttacatagagacagccgatcggcctggcctacttcttgagataatcaagatcatcgcggacacaaatattgatgtggagtcagctgagattgatactgaaagtttggttgcgaaggacaagttccatgtgagttacagaggtgcaaaactaaacagc

SEQ ID NO: 25043 - DNA, 538 bp, Zea mays
gaagagagctcactagtcccccccccccccacacgaattcgattctctcttatctcgacgagaaaaccctactgcgaaaaaactccgatctctctggcgagaagtaaatttttatctctgagcttggtttcaccatttctctatctctatctcctcgctgggttacggtttggtaaggtcagtgttctctaaggctgaaatttgggggtttctcagtctcgatgtggtcgtgctccgttaggattcttcacaatcattagggttatatttcttacaaactgatgctcattttctcttccctgtctatggctttatctgtgatccttcaaaagcttagtgtcttcggccctggtttgaatccttctttcccttactgcatcgccaatcactcctttgcctcccgttaattgagttgctctctttcaacttaattacattagtctgcttcctttgctgtctagtctggatagtgttgcaaatcaagtagtatcttctttagacattcttggctgagagatttacactaaaagcatagaat
